United States Patent 9,782,462 (MODIFIED POLYNUCLEOTIDES FOR THE PRODUCTION OF PROTEINS ASSOCIATED WITH HUMAN DISEASE) - sequence listing, part 48

SEQ ID NO: 90420 - DNA, 4419 bp, Artificial Sequence
  Description of Artificial Sequence: Synthetic coding sequence
atggacaacgccctgttctgcctggccgccgtgagcaacctggacatcgagagcaagctgagcgtgtactacagagccccctggcaccagcagagaaacatcttcctgcccgccaccagacccccctgcgtggaggagctgcacagacacgccagacagagcctgcaggccctgagaagagagcacagaagcagaagcgacagaagagagcagagagccgccgcccccctgagcatcgccgccccccccctgcccgcctacccccccgcccacagccagagaagaagagagttcaaggacagacacttcctgaccttcaacagcaccagaagccccagccccaccgagtgctgccacatgaccccctggagcagaaagagccacccccccgaggacgaggacaccgacgtgatgctgggccagagacccaagaaccccatccacaacatccccagcaccctggacaagcagaccaactggagcaaggccctgcccctgcccacccccgaggagaagatgaagcaggacgcccaggtgatcagcagctgcatcatccccatcaacgtgaccggcgtgggcttcgacagagaggccagcatcagatgcagcctggtgcacagccagagcgtgctgcagagaagaagaaagctgagaagaagaaagaccatcagcggcatccccagaagagtgcagcaggagatcgacagcgacgagagccccgtggccagagagagaaacgtgatcgtgcacaccaaccccgaccccagcaacaccgtgaacagaatcagcggcaccagagacagcgagtgccagaccgaggacatcctgatcgccgcccccagcagaagaagaatcagagcccagagaggccagagcatcgccgccagcctgagccacagcgccggcaacatcagcgccctggccgacaagggcgacaccatgttcacccccgccgtgagcagcagaaccagaagcagaagcctgcccagagagggcaacagaggcggcgacgccgagcccaaggtgggcgccaagcccagcgcctacgaggagggcgagagcttcgtgggcgaccacgagagaacccccaacgacttcagcgaggcccccagcagccccagcgcccaggaccaccagcccaccctgggcctggcctgcagccagcacctgcacagcccccagcacaagctgagcgagagaggcagaagcagactgagcagaatggccgccgacagcggcagctgcgacatcagcagcaacagcgacaccttcggcagccccatccactgcatcagcaccgccggcgtgctgctgagcagccacatggaccagaaggacgaccaccagagcagcagcggcaactggagcggcagcagcagcacctgccccagccagaccagcgagaccatcccccccgccgccagcccccccctgaccggcagcagccactgcgacagcgagctgagcctgaacaccgccccccacgccaacgaggacgccagcgtgttcgtgaccgagcagtacaacgaccacctggacaaggtgagaggccacagagccaacagcttcaccagcaccgtggccgacctgctggacgaccccaacaacagcaacaccagcgacagcgagtggaactacctgcaccaccaccacgacgccagctgcagacaggacttcagccccgagagacccaaggccgacagcctgggctgccccagcttcaccagcatggccacctacgacagcttcctggagaagagccccagcgacaaggccgacaccagcagccacttcagcgtggacaccgagggctactacaccagcatgcacttcgactgcggcctgaagggcaacaagagctacgtgtgccactacgccgccctgggccccgagaacggccagggcgtgggcgccagccccggcctgcccgactgcgcctggcaggactacctggaccacaagagacagggcagacccagcatcagcttcagaaagcccaaggccaagcccaccccccccaagagaagcagcagcctgagaaagagcgacggcaacgccgacatcagcgagaagaaggagcccaagatcagcagcggccagcacctgccccacagcagcagagagatgaagctgcccctggacttcgccaacacccccagcagaatggagaacgccaacctgcccaccaagcaggagcccagctggatcaaccagagcgagcagggcatcaaggagccccagctggacgccagcgacatcccccccttcaaggacgaggtggccgagagcacccactacgccgacctgtggctgctgaacgacctgaagaccaacgacccctacagaagcctgagcaacagcagcaccgccaccggcaccaccgtgatcgagtgcatcaagagccccgagagcagcgagagccagaccagccagagcgagagcagagccaccacccccagcctgcccagcgtggacaacgagttcaagctggccagccccgagaagctggccggcctggccagccccagcagcggctacagcagccagagcgagacccccaccagcagcttccccaccgccttcttcagcggccccctgagccccggcggcagcaagagaaagcccaaggtgcccgagagaaagagcagcctgcagcagcccagcctgaaggacggcaccatcagcctgagcaaggacctggagctgcccatcatcccccccacccacctggacctgagcgccctgcacaacgtgctgaacaagcccttccaccacagacaccccctgcacgtgttcacccacaacaagcagaacaccgtgggcgagaccctgagaagcaaccccccccccagcctggccatcacccccaccatcctgaagagcgtgaacctgagaagcatcaacaagagcgaggaggtgaagcagaaggaggagaacaacaccgacctgccctacctggaggagagcaccctgaccaccgccgccctgagccccagcaagatcagaccccacaccgccaacaagagcgtgagcagacagtacagcaccgaggacaccatcctgagcttcctggacagcagcgccgtggagatgggccccgacaagctgcacctggagaagaacagcaccttcgacgtgaagaacagatgcgaccccgagaccatcaccagcgccggcagcagcctgctggacagcaacgtgaccaaggaccaggtgagaaccgagaccgagcccatccccgagaacacccccaccaagaactgcgccttccccaccgagggcttccagagagtgagcgccgccagacccaacgacctggacggcaagatcatccagtacggccccggccccgacgagaccctggagcaggtgcagaaggcccccagcgccggcctggaggaggtggcccagcccgagagcgtggacgtgatcaccagccagagcgacagccccaccagagccaccgacgtgagcaaccagttcaagcaccagttcgtgatgagcagacaccacgacaaggtgcccggcaccatcagctacgagagcgagatcaccagcgtgaacagcttccccgagaagtgcagcaagcaggagaacatcgccagcggcatcagcgccaagagcgccagcgacaacagcaaggccgaggagacccagggcaacgtggacgaggccagcctgaaggagagcagccccagcgacgacagcatcatcagccccctgagcgaggacagccaggccgaggccgagggcgtgttcgtgagccccaacaagcccagaaccaccgaggacctgttcgccgtgatccacagaagcaagagaaaggtgctgggcagaaaggacagcggcgacatgagcgtgagaagcaagagcagagcccccctgagcagcagcagcagcagcgccagcagcatcaccagccccagcagcaacgtgaccacccccaacagccagagaagccccggcctgatctacagaaacgccaagaagagcaacaccagcaacgaggagttcaagctgctgctgctgaagaagggcagcagaagcgacagcagctacagaatgagcgccaccgagatcctgaagagccccatcctgcccaagccccccggcgagctgaccgccgagagcccccagagcaccgacgacgcccaccagggcagccagggcgccgaggccctgagccccctgagcccctgcagccccagagtgaacgccgagggcttcagcagcaagagcttcgccaccagcgccagcgccagagtgggcagaagcagagccccccccgccgccagcagcagcagatacagcgtgagatgcagactgtacaacacccccatgcaggccatcagcgagggcgagaccgagaacagcgacggcagcccccacgacgacagaagcagccagagcagcacctag

SEQ ID NO: 90421 - DNA, 4893 bp, Artificial Sequence
  Description of Artificial Sequence: Synthetic coding sequence
atgcccttcgccaagagaatcgtggagccccagtggctgtgcagacagagaagacccgcccccggccccgccgtggacgccagcggcggcagcgccgagccccccccccccctgcagccccccggcagaagagacctggacgaggtggaggcccccggccccgaggagcccgccagagccgtgcccgcccccagcggcctgccccccccccccccccccctgcccgcccccgccgaccagacccagcccccccacggcgaggccagcgtggccggcgaggagagcaccgccggcatccccgaggccgcccccgccgccggcgaggccagcagcgccgccgccgccgccgccgtgctgctgatgctggacctgtgcgccgtgagcaacgccgccctggccagagtgctgagacagctgagcgacgtggccagacacgcctgcagcctgttccaggagctggagagcgacatccagctgacccacagaagagtgtgggccctgcagggcaagctgggcggcgtgcagagagtgctgagcaccctggaccccaagcaggaggccgtgcccgtgagcaacctggacatcgagagcaagctgagcgtgtactacagagccccctggcaccagcagagaaacatcttcctgcccgccaccagacccccctgcgtggaggagctgcacagacacgccagacagagcctgcaggccctgagaagagagcacagaagcagaagcgacagaagagagcagagagccgccgcccccctgagcatcgccgccccccccctgcccgcctacccccccgcccacagccagagaagaagagagttcaaggacagacacttcctgaccagccacccccccgaggacgaggacaccgacgtgatgctgggccagagacccaagaaccccatccacaacatccccagcaccctggacaagcagaccaactggagcaaggccctgcccctgcccacccccgaggagaagatgaagcaggacgcccaggtgatcagcagctgcatcatccccatcaacgtgaccggcgtgggcttcgacagagaggccagcatcagatgcagcctggtgcacagccagagcgtgctgcagagaagaagaaagctgagaagaagaaagaccatcagcggcatccccagaagagtgcagcaggagatcgacagcgacgagagccccgtggccagagagagaaacgtgatcgtgcacaccaaccccgaccccagcaacaccgtgaacagaatcagcggcaccagagacagcgagtgccagaccgaggacatcctgatcgccgcccccagcagaagaagaatcagagcccagagaggccagagcatcgccgccagcctgagccacagcgccggcaacatcagcgccctggccgacaagggcgacaccatgttcacccccgccgtgagcagcagaaccagaagcagaagcctgcccagagagggcaacagaggcggcgacgccgagcccaaggtgggcgccaagcccagcgcctacgaggagggcgagagcttcgtgggcgaccacgagagaacccccaacgacttcagcgaggcccccagcagccccagcgcccaggaccaccagcccaccctgggcctggcctgcagccagcacctgcacagcccccagcacaagctgagcgagagaggcagaagcagactgagcagaatggccgccgacagcggcagctgcgacatcagcagcaacagcgacaccttcggcagccccatccactgcatcagcaccgccggcgtgctgctgagcagccacatggaccagaaggacgaccaccagagcagcagcggcaactggagcggcagcagcagcacctgccccagccagaccagcgagaccatcccccccgccgccagcccccccctgaccggcagcagccactgcgacagcgagctgagcctgaacaccgccccccacgccaacgaggacgccagcgtgttcgtgaccgagcagtacaacgaccacctggacaaggtgagaggccacagagccaacagcttcaccagcaccgtggccgacctgctggacgaccccaacaacagcaacaccagcgacagcgagtggaactacctgcaccaccaccacgacgccagctgcagacaggacttcagccccgagagacccaaggccgacagcctgggctgccccagcttcaccagcatggccacctacgacagcttcctggagaagagccccagcgacaaggccgacaccagcagccacttcagcgtggacaccgagggctactacaccagcatgcacttcgactgcggcctgaagggcaacaagagctacgtgtgccactacgccgccctgggccccgagaacggccagggcgtgggcgccagccccggcctgcccgactgcgcctggcaggactacctggaccacaagagacagggcagacccagcatcagcttcagaaagcccaaggccaagcccaccccccccaagagaagcagcagcctgagaaagagcgacggcaacgccgacatcagcgagaagaaggagcccaagatcagcagcggccagcacctgccccacagcagcagagagatgaagctgcccctggacttcgccaacacccccagcagaatggagaacgccaacctgcccaccaagcaggagcccagctggatcaaccagagcgagcagggcatcaaggagccccagctggacgccagcgacatcccccccttcaaggacgaggtggccgagagcacccactacgccgacctgtggctgctgaacgacctgaagaccaacgacccctacagaagcctgagcaacagcagcaccgccaccggcaccaccgtgatcgagtgcatcaagagccccgagagcagcgagagccagaccagccagagcgagagcagagccaccacccccagcctgcccagcgtggacaacgagttcaagctggccagccccgagaagctggccggcctggccagccccagcagcggctacagcagccagagcgagacccccaccagcagcttccccaccgccttcttcagcggccccctgagccccggcggcagcaagagaaagcccaaggtgcccgagagaaagagcagcctgcagcagcccagcctgaaggacggcaccatcagcctgagcaaggacctggagctgcccatcatcccccccacccacctggacctgagcgccctgcacaacgtgctgaacaagcccttccaccacagacaccccctgcacgtgttcacccacaacaagcagaacaccgtgggcgagaccctgagaagcaaccccccccccagcctggccatcacccccaccatcctgaagagcgtgaacctgagaagcatcaacaagagcgaggaggtgaagcagaaggaggagaacaacaccgacctgccctacctggaggagagcaccctgaccaccgccgccctgagccccagcaagatcagaccccacaccgccaacaagagcgtgagcagacagtacagcaccgaggacaccatcctgagcttcctggacagcagcgccgtggagatgggccccgacaagctgcacctggagaagaacagcaccttcgacgtgaagaacagatgcgaccccgagaccatcaccagcgccggcagcagcctgctggacagcaacgtgaccaaggaccaggtgagaaccgagaccgagcccatccccgagaacacccccaccaagaactgcgccttccccaccgagggcttccagagagtgagcgccgccagacccaacgacctggacggcaagatcatccagtacggccccggccccgacgagaccctggagcaggtgcagaaggcccccagcgccggcctggaggaggtggcccagcccgagagcgtggacgtgatcaccagccagagcgacagccccaccagagccaccgacgtgagcaaccagttcaagcaccagttcgtgatgagcagacaccacgacaaggtgcccggcaccatcagctacgagagcgagatcaccagcgtgaacagcttccccgagaagtgcagcaagcaggagaacatcgccagcggcatcagcgccaagagcgccagcgacaacagcaaggccgaggagacccagggcaacgtggacgaggccagcctgaaggagagcagccccagcgacgacagcatcatcagccccctgagcgaggacagccaggccgaggccgagggcgtgttcgtgagccccaacaagcccagaaccaccgaggacctgttcgccgtgatccacagaagcaagagaaaggtgctgggcagaaaggacagcggcgacatgagcgtgagaagcaagagcagagcccccctgagcagcagcagcagcagcgccagcagcatcaccagccccagcagcaacgtgaccacccccaacagccagagaagccccggcctgatctacagaaacgccaagaagagcaacaccagcaacgaggagttcaagctgctgctgctgaagaagggcagcagaagcgacagcagctacagaatgagcgccaccgagatcctgaagagccccatcctgcccaagccccccggcgagctgaccgccgagagcccccagagcaccgacgacgcccaccagggcagccagggcgccgaggccctgagccccctgagcccctgcagccccagagtgaacgccgagggcttcagcagcaagagcttcgccaccagcgccagcgccagagtgggcagaagcagagccccccccgccgccagcagcagcagatacagcgtgagatgcagactgtacaacacccccatgcaggccatcagcgagggcgagaccgagaacagcgacggcagcccccacgacgacagaagcagccagagcagcacctag

SEQ ID NO: 90422 - DNA, 4425 bp, Artificial Sequence
  Description of Artificial Sequence: Synthetic coding sequence
atggccctggcctgctgcatgcccaagaacgccgccgtgagcaacctggacatcgagagcaagctgagcgtgtactacagagccccctggcaccagcagagaaacatcttcctgcccgccaccagacccccctgcgtggaggagctgcacagacacgccagacagagcctgcaggccctgagaagagagcacagaagcagaagcgacagaagagagcagagagccgccgcccccctgagcatcgccgccccccccctgcccgcctacccccccgcccacagccagagaagaagagagttcaaggacagacacttcctgaccttcaacagcaccagaagccccagccccaccgagtgctgccacatgaccccctggagcagaaagagccacccccccgaggacgaggacaccgacgtgatgctgggccagagacccaagaaccccatccacaacatccccagcaccctggacaagcagaccaactggagcaaggccctgcccctgcccacccccgaggagaagatgaagcaggacgcccaggtgatcagcagctgcatcatccccatcaacgtgaccggcgtgggcttcgacagagaggccagcatcagatgcagcctggtgcacagccagagcgtgctgcagagaagaagaaagctgagaagaagaaagaccatcagcggcatccccagaagagtgcagcaggagatcgacagcgacgagagccccgtggccagagagagaaacgtgatcgtgcacaccaaccccgaccccagcaacaccgtgaacagaatcagcggcaccagagacagcgagtgccagaccgaggacatcctgatcgccgcccccagcagaagaagaatcagagcccagagaggccagagcatcgccgccagcctgagccacagcgccggcaacatcagcgccctggccgacaagggcgacaccatgttcacccccgccgtgagcagcagaaccagaagcagaagcctgcccagagagggcaacagaggcggcgacgccgagcccaaggtgggcgccaagcccagcgcctacgaggagggcgagagcttcgtgggcgaccacgagagaacccccaacgacttcagcgaggcccccagcagccccagcgcccaggaccaccagcccaccctgggcctggcctgcagccagcacctgcacagcccccagcacaagctgagcgagagaggcagaagcagactgagcagaatggccgccgacagcggcagctgcgacatcagcagcaacagcgacaccttcggcagccccatccactgcatcagcaccgccggcgtgctgctgagcagccacatggaccagaaggacgaccaccagagcagcagcggcaactggagcggcagcagcagcacctgccccagccagaccagcgagaccatcccccccgccgccagcccccccctgaccggcagcagccactgcgacagcgagctgagcctgaacaccgccccccacgccaacgaggacgccagcgtgttcgtgaccgagcagtacaacgaccacctggacaaggtgagaggccacagagccaacagcttcaccagcaccgtggccgacctgctggacgaccccaacaacagcaacaccagcgacagcgagtggaactacctgcaccaccaccacgacgccagctgcagacaggacttcagccccgagagacccaaggccgacagcctgggctgccccagcttcaccagcatggccacctacgacagcttcctggagaagagccccagcgacaaggccgacaccagcagccacttcagcgtggacaccgagggctactacaccagcatgcacttcgactgcggcctgaagggcaacaagagctacgtgtgccactacgccgccctgggccccgagaacggccagggcgtgggcgccagccccggcctgcccgactgcgcctggcaggactacctggaccacaagagacagggcagacccagcatcagcttcagaaagcccaaggccaagcccaccccccccaagagaagcagcagcctgagaaagagcgacggcaacgccgacatcagcgagaagaaggagcccaagatcagcagcggccagcacctgccccacagcagcagagagatgaagctgcccctggacttcgccaacacccccagcagaatggagaacgccaacctgcccaccaagcaggagcccagctggatcaaccagagcgagcagggcatcaaggagccccagctggacgccagcgacatcccccccttcaaggacgaggtggccgagagcacccactacgccgacctgtggctgctgaacgacctgaagaccaacgacccctacagaagcctgagcaacagcagcaccgccaccggcaccaccgtgatcgagtgcatcaagagccccgagagcagcgagagccagaccagccagagcgagagcagagccaccacccccagcctgcccagcgtggacaacgagttcaagctggccagccccgagaagctggccggcctggccagccccagcagcggctacagcagccagagcgagacccccaccagcagcttccccaccgccttcttcagcggccccctgagccccggcggcagcaagagaaagcccaaggtgcccgagagaaagagcagcctgcagcagcccagcctgaaggacggcaccatcagcctgagcaaggacctggagctgcccatcatcccccccacccacctggacctgagcgccctgcacaacgtgctgaacaagcccttccaccacagacaccccctgcacgtgttcacccacaacaagcagaacaccgtgggcgagaccctgagaagcaaccccccccccagcctggccatcacccccaccatcctgaagagcgtgaacctgagaagcatcaacaagagcgaggaggtgaagcagaaggaggagaacaacaccgacctgccctacctggaggagagcaccctgaccaccgccgccctgagccccagcaagatcagaccccacaccgccaacaagagcgtgagcagacagtacagcaccgaggacaccatcctgagcttcctggacagcagcgccgtggagatgggccccgacaagctgcacctggagaagaacagcaccttcgacgtgaagaacagatgcgaccccgagaccatcaccagcgccggcagcagcctgctggacagcaacgtgaccaaggaccaggtgagaaccgagaccgagcccatccccgagaacacccccaccaagaactgcgccttccccaccgagggcttccagagagtgagcgccgccagacccaacgacctggacggcaagatcatccagtacggccccggccccgacgagaccctggagcaggtgcagaaggcccccagcgccggcctggaggaggtggcccagcccgagagcgtggacgtgatcaccagccagagcgacagccccaccagagccaccgacgtgagcaaccagttcaagcaccagttcgtgatgagcagacaccacgacaaggtgcccggcaccatcagctacgagagcgagatcaccagcgtgaacagcttccccgagaagtgcagcaagcaggagaacatcgccagcggcatcagcgccaagagcgccagcgacaacagcaaggccgaggagacccagggcaacgtggacgaggccagcctgaaggagagcagccccagcgacgacagcatcatcagccccctgagcgaggacagccaggccgaggccgagggcgtgttcgtgagccccaacaagcccagaaccaccgaggacctgttcgccgtgatccacagaagcaagagaaaggtgctgggcagaaaggacagcggcgacatgagcgtgagaagcaagagcagagcccccctgagcagcagcagcagcagcgccagcagcatcaccagccccagcagcaacgtgaccacccccaacagccagagaagccccggcctgatctacagaaacgccaagaagagcaacaccagcaacgaggagttcaagctgctgctgctgaagaagggcagcagaagcgacagcagctacagaatgagcgccaccgagatcctgaagagccccatcctgcccaagccccccggcgagctgaccgccgagagcccccagagcaccgacgacgcccaccagggcagccagggcgccgaggccctgagccccctgagcccctgcagccccagagtgaacgccgagggcttcagcagcaagagcttcgccaccagcgccagcgccagagtgggcagaagcagagccccccccgccgccagcagcagcagatacagcgtgagatgcagactgtacaacacccccatgcaggccatcagcgagggcgagaccgagaacagcgacggcagcccccacgacgacagaagcagccagagcagcacctag

SEQ ID NO: 90423 - DNA, 255 bp, Artificial Sequence
  Description of Artificial Sequence: Synthetic coding sequence
cccgagctgcaggtgtgcgtgttctgcagaaacaacaaggaggccatggccctgtacaccacccacatcctgaagggccccgacggcagagtgctgtgccccgtgctgagaagatacacctgccccctgtgcggcgccagcggcgacaacgcccacaccatcaagtactgccccctgagcaaggtgccccccccccccgccagacccccccccagaagcgccagagacggcccccccggcaagaagctgagatag

SEQ ID NO: 90424 - DNA, 879 bp, Artificial Sequence
  Description of Artificial Sequence: Synthetic coding sequence
atggaggccttcccctgggcccccagaagccccagaagaggcagagcccccccccccatggccctggtgcccagcgccagatacgtgagcgcccccggccccgcccacccccagcccttcagcagctggaacgactacctgggcctggccaccctgatcaccaaggccgtggacggcgagcccagattcggctgcgccagaggcggcaacggcggcggcggcagcccccccagcagcagcagcagcagctgctgcagcccccacaccggcgccggccccggcgccctgggccccgccctgggcccccccgactacgacgaggacgacgacgacgacagcgacgagcccggcagcagaggcagatacctgggcagcgccctggagctgagagccctggagctgtgcgccggccccgccgaggccggcctgctggaggagagattcgccgagctgagccccttcgccggcagagccgccgccgtgctgctgggctgcgcccccgccgccgccgccgccgccaccaccaccagcgaggccacccccagagaggagagagcccccgcctgggccgccgagcccagactgcacgccgccagcggcgccgccgccgccagactgctgaagcccgagctgcaggtgtgcgtgttctgcagaaacaacaaggaggccatggccctgtacaccacccacatcctgaagggccccgacggcagagtgctgtgccccgtgctgagaagatacacctgccccctgtgcggcgccagcggcgacaacgcccacaccatcaagtactgccccctgagcaaggtgccccccccccccgccagacccccccccagaagcgccagagacggcccccccggcaagaagctgagatag

SEQ ID NO: 90425 - DNA, 3456 bp, Artificial Sequence
  Description of Artificial Sequence: Synthetic coding sequence
atgctgagaagagtgaccgtggccgccgtgtgcgccaccagaagaaagctgtgcgaggccggcagagagctggccgccctgtggggcatcgagaccagaggcagatgcgaggacagcgccgccgccagacccttccccatcctggccatgcccggcagaaacaaggccaagagcacctgcagctgccccgacctgcagcccaacggccaggacctgggcgagaacagcagagtggccagactgggcgccgacgagagcgaggaggagggcagaagaggcagcctgagcaacgccggcgaccccgagatcgtgaagagccccagcgaccccaagcagtacagatacatcaagctgcagaacggcctgcaggccctgctgatcagcgacctgagcaacatggagggcaagaccggcaacaccaccgacgacgaggaggaggaggaggtggaggaggaggaggaggacgacgacgaggacagcggcgccgagatcgaggacgacgacgaggagggcttcgacgacgaggacgagttcgacgacgagcacgacgacgacctggacaccgaggacaacgagctggaggagctggaggagagagccgaggccagaaagaagaccaccgagaagcagagcgccgccgccctgtgcgtgggcgtgggcagcttcgccgaccccgacgacctgcccggcctggcccacttcctggagcacatggtgttcatgggcagcctgaagtaccccgacgagaacggcttcgacgccttcctgaagaagcacggcggcagcgacaacgccagcaccgactgcgagagaaccgtgttccagttcgacgtgcagagaaagtacttcaaggaggccctggacagatgggcccagttcttcatccaccccctgatgatcagagacgccatcgacagagaggtggaggccgtggacagcgagtaccagctggccagacccagcgacgccaacagaaaggagatgctgttcggcagcctggccagacccggccaccccatgggcaagttcttctggggcaacgccgagaccctgaagcacgagcccagaaagaacaacatcgacacccacgccagactgagagagttctggatgagatactacagcagccactacatgaccctggtggtgcagagcaaggagaccctggacaccctggagaagtgggtgaccgagatcttcagccagatccccaacaacggcctgcccagacccaacttcggccacctgaccgaccccttcgacacccccgccttcaacaagctgtacagagtggtgcccatcagaaagatccacgccctgaccatcacctgggccctgcccccccagcagcagcactacagagtgaagcccctgcactacatcagctggctggtgggccacgagggcaagggcagcatcctgagcttcctgagaaagaagtgctgggccctggccctgttcggcggcaacggcgagaccggcttcgagcagaacagcacctacagcgtgttcagcatcagcatcaccctgaccgacgagggctacgagcacttctacgaggtggcctacaccgtgttccagtacctgaagatgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgccaccgacttcaccctgaaggccttcgactgccccgagaccgagtaccccgtgaagatcgtgaacaccccccagggctgcctgtggtacaagaaggacaacaagttcaagatccccaaggcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggctaccacgtgtaccccacctgcagaaacaccagcggcatcctgggcttcagcgtgaccgtgggcacccaggccaccaagtacaacagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccgactgcatcatccccatcaccgacatcagagccttcaccaccaccctgaacctgctgccctaccacaagatcgtgaagtag

SEQ ID NO: 90426 - DNA, 3660 bp, Artificial Sequence
  Description of Artificial Sequence: Synthetic coding sequence
atgctgagaagagtgaccgtggccgccgtgtgcgccaccagaagaaagctgtgcgaggccggcagagagctggccgccctgtggggcatcgagaccagaggcagatgcgaggacagcgccgccgccagacccttccccatcctggccatgcccggcagaaacaaggccaagagcacctgcagctgccccgacctgcagcccaacggccaggacctgggcgagaacagcagagtggccagactgggcgccgacgagagcgaggaggagggcagaagaggcagcctgagcaacgccggcgaccccgagatcgtgaagagccccagcgaccccaagcagtacagatacatcaagctgcagaacggcctgcaggccctgctgatcagcgacctgagcaacatggagggcaagaccggcaacaccaccgacgacgaggaggaggaggaggtggaggaggaggaggaggacgacgacgaggacagcggcgccgagatcgaggacgacgacgaggagggcttcgacgacgaggacgagttcgacgacgagcacgacgacgacctggacaccgaggacaacgagctggaggagctggaggagagagccgaggccagaaagaagaccaccgagaagcagcagctgcagagcctgttcctgctgtggagcaagctgaccgacagactgtggttcaagagcacctacagcaagatgagcagcaccctgctggtggagaccagaaacctgtacggcgtggtgggcgccgagagcagaagcgcccccgtgcagcacctggccggctggcaggccgaggagcagcagggcgagaccgacaccgtgctgagcgccgccgccctgtgcgtgggcgtgggcagcttcgccgaccccgacgacctgcccggcctggcccacttcctggagcacatggtgttcatgggcagcctgaagtaccccgacgagaacggcttcgacgccttcctgaagaagcacggcggcagcgacaacgccagcaccgactgcgagagaaccgtgttccagttcgacgtgcagagaaagtacttcaaggaggccctggacagatgggcccagttcttcatccaccccctgatgatcagagacgccatcgacagagaggtggaggccgtggacagcgagtaccagctggccagacccagcgacgccaacagaaaggagatgctgttcggcagcctggccagacccggccaccccatgggcaagttcttctggggcaacgccgagaccctgaagcacgagcccagaaagaacaacatcgacacccacgccagactgagagagttctggatgagatactacagcagccactacatgaccctggtggtgcagagcaaggagaccctggacaccctggagaagtgggtgaccgagatcttcagccagatccccaacaacggcctgcccagacccaacttcggccacctgaccgaccccttcgacacccccgccttcaacaagctgtacagagtggtgcccatcagaaagatccacgccctgaccatcacctgggccctgcccccccagcagcagcactacagagtgaagcccctgcactacatcagctggctggtgggccacgagggcaagggcagcatcctgagcttcctgagaaagaagtgctgggccctggccctgttcggcggcaacggcgagaccggcttcgagcagaacagcacctacagcgtgttcagcatcagcatcaccctgaccgacgagggctacgagcacttctacgaggtggcctacaccgtgttccagtacctgaagatgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgccaccgacttcaccctgaaggccttcgactgccccgagaccgagtaccccgtgaagatcgtgaacaccccccagggctgcctgtggtacaagaaggacaacaagttcaagatccccaaggcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggctaccacgtgtaccccacctgcagaaacaccagcggcatcctgggcttcagcgtgaccgtgggcacccaggccaccaagtacaacagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccgactgcatcatccccatcaccgacatcagagccttcaccaccaccctgaacctgctgccctaccacaagatcgtgaagtag

SEQ ID NO: 90427 - DNA, 1662 bp, Artificial Sequence
  Description of Artificial Sequence: Synthetic coding sequence
atgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggcagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccgactgcatcatccccatcaccgacatcagagccttcaccaccaccctgaacctgctgccctaccacaagatcgtgaagtag

SEQ ID NO: 90428 - DNA, 1617 bp, Artificial Sequence
  Description of Artificial Sequence: Synthetic coding sequence
tgaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggcagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccgactgcatcatccccatcaccgacatcagagccttcaccaccaccctgaacctgctgccctaccacaagatcgtgaagtag

SEQ ID NO: 90429 - DNA, 3264 bp, Artificial Sequence
  Description of Artificial Sequence: Synthetic coding sequence
atggagggcaagaccggcaacaccaccgacgacgaggaggaggaggaggtggaggaggaggaggaggacgacgacgaggacagcggcgccgagatcgaggacgacgacgaggagggcttcgacgacgaggacgagttcgacgacgagcacgacgacgacctggacaccgaggacaacgagctggaggagctggaggagagagccgaggccagaaagaagaccaccgagaagcagcagctgcagagcctgttcctgctgtggagcaagctgaccgacagactgtggttcaagagcacctacagcaagatgagcagcaccctgctggtggagaccagaaacctgtacggcgtggtgggcgccgagagcagaagcgcccccgtgcagcacctggccggctggcaggccgaggagcagcagggcgagaccgacaccgtgctgagcgccgccgccctgtgcgtgggcgtgggcagcttcgccgaccccgacgacctgcccggcctggcccacttcctggagcacatggtgttcatgggcagcctgaagtaccccgacgagaacggcttcgacgccttcctgaagaagcacggcggcagcgacaacgccagcaccgactgcgagagaaccgtgttccagttcgacgtgcagagaaagtacttcaaggaggccctggacagatgggcccagttcttcatccaccccctgatgatcagagacgccatcgacagagaggtggaggccgtggacagcgagtaccagctggccagacccagcgacgccaacagaaaggagatgctgttcggcagcctggccagacccggccaccccatgggcaagttcttctggggcaacgccgagaccctgaagcacgagcccagaaagaacaacatcgacacccacgccagactgagagagttctggatgagatactacagcagccactacatgaccctggtggtgcagagcaaggagaccctggacaccctggagaagtgggtgaccgagatcttcagccagatccccaacaacggcctgcccagacccaacttcggccacctgaccgaccccttcgacacccccgccttcaacaagctgtacagagtggtgcccatcagaaagatccacgccctgaccatcacctgggccctgcccccccagcagcagcactacagagtgaagcccctgcactacatcagctggctggtgggccacgagggcaagggcagcatcctgagcttcctgagaaagaagtgctgggccctggccctgttcggcggcaacggcgagaccggcttcgagcagaacagcacctacagcgtgttcagcatcagcatcaccctgaccgacgagggctacgagcacttctacgaggtggcctacaccgtgttccagtacctgaagatgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgccaccgacttcaccctgaaggccttcgactgccccgagaccgagtaccccgtgaagatcgtgaacaccccccagggctgcctgtggtacaagaaggacaacaagttcaagatccccaaggcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggctaccacgtgtaccccacctgcagaaacaccagcggcatcctgggcttcagcgtgaccgtgggcacccaggccaccaagtacaacagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccgactgcatcatccccatcaccgacatcagagccttcaccaccaccctgaacctgctgccctaccacaagatcgtgaagtag

SEQ ID NO: 90430 - DNA, 2244 bp, Artificial Sequence
  Description of Artificial Sequence: Synthetic coding sequence
atggagggcaagaccggcaacaccaccgacgacgaggaggaggaggaggtggaggaggaggaggaggacgacgacgaggacagcggcgccgagatcgaggacgacgacgaggagggcttcgacgacgaggacgagttcgacgacgagcacgacgacgacctggacaccgaggacaacgagctggaggagctggaggagagagccgaggccagaaagaagaccaccgagaagcagagcgccgccgccctgtgcgtgggcgtgggcagcttcgccgaccccgacgacctgcccggcctggcccacttcctggagcacatggtgttcatgggcagcctgaagtaccccgacgagaacggcttcgacgccttcctgaagaagcacggcggcagcgacaacgccagcaccgactgcgagagaaccgtgttccagttcgacgtgcagagaaagtacttcaaggaggccctggacagatgggcccagttcttcatccaccccctgatgatcagagacgccatcgacagagaggtggaggccgtggacagcgagtaccagctggccagacccagcgacgccaacagaaaggagatgctgttcggcagcctggccagacccggccaccccatgggcaagttcttctggggcaacgccgagaccctgaagcacgagcccagaaagaacaacatcgacacccacgccagactgagagagttctggatgagatactacagcagccactacatgaccctggtggtgcagagcaaggagaccctggacaccctggagaagtgggtgaccgagatcttcagccagatccccaacaacggcctgcccagacccaacttcggccacctgaccgaccccttcgacacccccgccttcaacaagctgtacagagtggtgcccatcagaaagatccacgccctgaccatcacctgggccctgcccccccagcagcagcactacagagtgaagcccctgcactacatcagctggctggtgggccacgagggcaagggcagcatcctgagcttcctgagaaagaagtgctgggccctggccctgttcggcggcaacggcgagaccggcttcgagcagaacagcacctacagcgtgttcagcatcagcatcaccctgaccgacgagggctacgagcacttctacgaggtggcctacaccgtgttccagtacctgaagatgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgccaccgacttcaccctgaaggccttcgactgccccgagaccgagtaccccgtgaagatcgtgaacaccccccagggctgcctgtggtacaagaaggacaacaagttcaagatccccaaggcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgtgctgtgccagtgggcccaggacagcgagacctag

SEQ ID NO: 90431 - DNA, 3447 bp, Artificial Sequence
  Description of Artificial Sequence: Synthetic coding sequence
atgctgagaagagtgaccgtggccgccgtgtgcgccaccagaagaaagctgtgcgaggccggcagagagctggccgccctgtggggcatcgagaccagaggcagatgcgaggacagcgccgccgccagacccttccccatcctggccatgcccggcagaaacaaggccaagagcacctgcagctgccccgacctgcagcccaacggccaggacctgggcgagaacagcagagtggccagactgggcgccgacgagagcgaggaggagggcagaagaggcagcctgagcaacgccggcgaccccgagatcgtgaagagccccagcgaccccaagcagtacagatacatcaagctgcagaacggcctgcaggccctgctgatcagcgacctgagcaacatggagggcaagaccggcaacaccaccgacgacgaggaggaggaggaggtggaggaggaggaggaggacgacgacgaggacagcggcgccgagatcgaggacgacgacgaggagggcttcgacgacgaggacgagttcgacgacgagcacgacgacgacctggacaccgaggacaacgagctggaggagctggaggagagagccgaggccagaaagaagaccaccgagaagcagagcgccgccgccctgtgcgtgggcgtgggcagcttcgccgaccccgacgacctgcccggcctggcccacttcctggagcacatggtgttcatgggcagcctgaagtaccccgacgagaacggcttcgacgccttcctgaagaagcacggcggcagcgacaacgccagcaccgactgcgagagaaccgtgttccagttcgacgtgcagagaaagtacttcaaggaggccctggacagatgggcccagttcttcatccaccccctgatgatcagagacgccatcgacagagaggtggaggccgtggacagcgagtaccagctggccagacccagcgacgccaacagaaaggagatgctgttcggcagcctggccagacccggccaccccatgggcaagttcttctggggcaacgccgagaccctgaagcacgagcccagaaagaacaacatcgacacccacgccagactgagagagttctggatgagatactacagcagccactacatgaccctggtggtgcagagcaaggagaccctggacaccctggagaagtgggtgaccgagatcttcagccagatccccaacaacggcctgcccagacccaacttcggccacctgaccgaccccttcgacacccccgccttcaacaagctgtacagagtggtgcccatcagaaagatccacgccctgaccatcacctgggccctgcccccccagcagcagcactacagagtgaagcccctgcactacatcagctggctggtgggccacgagggcaagggcagcatcctgagcttcctgagaaagaagtgctgggccctggccctgttcggcggcaacggcgagaccggcttcgagcagaacagcacctacagcgtgttcagcatcagcatcaccctgaccgacgagggctacgagcacttctacgaggtggcctacaccgtgttccagtacctgaagatgctgcagaagctgggccccgagaagagaatcttcgaggagatcagaaagatcgaggacaacgagttccactaccaggagcagaccgaccccgtggagtacgtggagaacatgtgcgagaacatgcagctgtaccccctgcaggacatcctgaccggcgaccagctgctgttcgagtacaagcccgaggtgatcggcgaggccctgaaccagctggtgccccagaaggccaacctggtgctgctgagcggcgccaacgagggcaagtgcgacctgaaggagaagtggttcggcacccagtacagcatcgaggacatcgagaacagctgggccgagctgtggaacagcaacttcgagctgaaccccgacctgcacctgcccgccgagaacaagtacatcgccaccgacttcaccctgaaggccttcgactgccccgagaccgagtaccccgtgaagatcgtgaacaccccccagggctgcctgtggtacaagaaggacaacaagttcaagatccccaaggcctacatcagattccacctgatcagccccctgatccagaagagcgccgccaacgtggtgctgttcgacatcttcgtgaacatcctgacccacaacctggccgagcccgcctacgaggccgacgtggcccagctggagtacaagctggtggccggcgagcacggcctgatcatcagagtgaagggcttcaaccacaagctgcccctgctgttccagctgatcatcgactacctggccgagttcaacagcacccccgccgtgttcaccatgatcaccgagcagctgaagaagacctacttcaacatcctgatcaagcccgagaccctggccaaggacgtgagactgctgatcctggagtacgccagatggagcatgatcgacaagtaccaggccctgatggacggcctgagcctggagagcctgctgagcttcgtgaaggagttcaagagccagctgttcgtggagggcctggtgcagggcaacgtgaccagcaccgagagcatggacttcctgaagtacgtggtggacaagctgaacttcaagcccctggagcaggagatgcccgtgcagttccaggtggtggagctgcccagcggccaccacctgtgcaaggtgaaggccctgaacaagggcgacgccaacagcgaggtgaccgtgtactaccagagcggcaccagaagcctgagagagtacaccctgatggagctgctggtgatgcacatggaggagccctgcttcgacttcctgagaaccaagcagaccctgggctaccacgtgtaccccacctgcagaaacaccagcggcatcctgggcttcagcgtgaccgtgggcacccaggccaccaagtacaacagcgaggtggtggacaagaagatcgaggagttcctgagcagcttcgaggagaagatcgagaacctgaccgaggaggccttcaacacccaggtgaccgccctgatcaagctgaaggagtgcgaggacacccacctgggcgaggaggtggacagaaactggaacgaggtggtgacccagcagtacctgttcgacagactggcccacgagatcgaggccctgaagagcttcagcaagagcgacctggtgaactggttcaaggcccacagaggccccggcagcaagatgctgagcgtgcacgtggtgggctacggcaagtacgagctggaggaggacggcacccccagcagcgaggacagcaacagcagctgcgaggtgatgcagctgacctacctgcccaccagccccctgctggccatcgtgagcagccccctgctgatcagcggcctgagccagcagcacagcaccttcagccccaccatcaagtag

SEQ ID NO: 90432 - DNA, 1587 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccgtgttcagaggctacgccgagagaaagagaagaaagagagagaacgacagcgccagcgtgatccagagaaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90433 - DNA, 984 bp, Artificial Sequence
  Description of Artificial Sequence: Synthetic coding sequence
atgtacagcgtggacagagtgagcgacgacatccccatcagaacctggttccccaaggagaacctgttcagcttccagaccgccaccaccaccatgcaggccgtgttcagaggctacgccgagagaaagagaagaaagagagagaacgacagcgccagcgtgatccagagaaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90434 - DNA, 438 bp, Artificial Sequence
  Description of Artificial Sequence: Synthetic coding sequence
atggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgtgagccccgcccccggcctgccccccaccgacgccctgctgagaccccaccccggccccgcccccgccccccaggtgcccagagtgctgtggagatgctggctgtag

SEQ ID NO: 90435 - DNA, 1587 bp, Artificial Sequence; identical to SEQ ID NO: 90432
  Description of Artificial Sequence: Synthetic coding sequence

SEQ ID NO: 90436 - DNA, 1503 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccatcagcgtgttcagaggctacgccgagagaaagagaagaaagagagagaacgacagcgccagcgtgatccagagaaacttcagaaagcacctgagaatggtgggcagcagaagagtgaaggcccagagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90437 - DNA, 1518 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90438 - DNA, 1593 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccatcagcgtgttcagaggctacgccgagagaaagagaagaaagagagagaacgacagcgccagcgtgatccagagaaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90439 - DNA, 585 bp, Artificial Sequence
  Description of Artificial Sequence: Synthetic coding sequence
atgggcctgggccccctgagcagcagcctgagcccccagctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90440 - DNA, 1524 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccgtgggcaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90441 - DNA, 1524 bp, Artificial Sequence
  Description of Artificial Sequence: Synthetic coding sequence
atgggcgccgccgccagcagaagaagagccctgagaagcgaggccatgagcagcgtggccgccaaggtgagagccgccagagccttcggcgagtacctgagccagagccaccccgagaacagaaacggcgccgaccacctgctggccgacgcctacagcggccacgacggcagccccgagatgcagcccgccccccagaacaagagaagactgagcctggtgagcaacggctgctacgagggcagcctgagcgaggagcccagcatcagaaagcccgccggcgagggcccccagcccagagtgtacaccatcagcggcgagcccgccctgctgcccagccccgaggccgaggccatcgagctggccgtggtgaagggcagaagacagagacacccccaccaccacagccagcccctgagagccagccccggcggcagcagagaggacgtgagcagaccctgccagagctgggccggcagcagacagggcagcaaggagtgccccggctgcgcccagctggcccccggccccacccccagagccttcggcctggaccagccccccctgcccgagaccagcggcagaagaaagaagctggagagaatgtacagcgtggacagagtgagcgacgacatccccatcagaacctggttccccaaggagaacctgttcagcttccagaccgccaccaccaccatgcaggccatcagcaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90442 - DNA, 984 bp, Artificial Sequence
  Description of Artificial Sequence: Synthetic coding sequence
atgcagctgggcagaagactggaccccgagagacaggccctgcacctgtgcagcggcgtggagggcgagccctggaaggccgtggccggcagagccctgggcggcatctgcctgtgggtgggcggcggcgccagaagccagggcgagcactggctgcccacccccaagggcaacttcagaaagcacctgagaatggtgggcagcagaagagtgaaggcccagaccttcgccgagagaagagagagaagcttcagcagaagctggagcgaccccacccccatgaaggccgacaccagccacgacagcagagacagcagcgacctgcagagcagccactgcaccctggacgaggccttcgaggacctggactgggacaccgagaagggcctggaggccgtggcctgcgacaccgagggcttcgtgccccccaaggtgatgctgatcagcagcaaggtgcccaaggccgagtacatccccaccatcatcagaagagacgaccccagcatcatccccatcctgtacgaccacgagcacgccaccttcgaggacatcctggaggagatcgagagaaagctgaacgtgtaccacaagggcgccaagatctggaagatgctgatcttctgccagggcggccccggccacctgtacctgctgaagaacaaggtggccaccttcgccaaggtggagaaggaggaggacatgatccacttctggaagagactgagcagactgatgagcaaggtgaaccccgagcccaacgtgatccacatcatgggctgctacatcctgggcaaccccaacggcgagaagctgttccagaacctgagaaccctgatgaccccctacagagtgaccttcgagagccccctggagctgagcgcccagggcaagcagatgatcgagacctacttcgacttcagactgtacagactgtggaagagcagacagcacagcaagctgctggacttcgacgacgtgctgtag

SEQ ID NO: 90443 - DNA, 648 bp, Artificial Sequence
  Description of Artificial Sequence: Synthetic coding sequence
atgcccggcgaggccaccgagaccgtgcccgccaccgagcaggagctgccccagccccaggccgagaccggcagcggcaccgagagcgacagcgacgagagcgtgcccgagctggaggagcaggacagcacccaggccaccacccagcaggcccagctggccgccgccgccgagatcgacgaggagcccgtgagcaaggccaagcagagcagaagcgagaagaaggccagaaaggccatgagcaagctgggcctgagacaggtgaccggcgtgaccagagtgaccatcagaaagagcaagaacatcctgttcgtgatcaccaagcccgacgtgtacaagagccccgccagcgacacctacatcgtgttcggcgaggccaagatcgaggacctgagccagcaggcccagctggccgccgccgagaagttcaaggtgcagggcgaggccgtgagcaacatccaggagaacacccagacccccaccgtgcaggaggagagcgaggaggaggaggtggacgagaccggcgtggaggtgaaggacatcgagctggtgatgagccaggccaacgtgagcagagccaaggccgtgagagccctgaagaacaacagcaacgacatcgtgaacgccatcatggagctgaccatgtag

SEQ ID NO: 90444 - DNA, 648 bp, Artificial Sequence; identical to SEQ ID NO: 90443
  Description of Artificial Sequence: Synthetic coding sequence

SEQ ID NO: 90445 - DNA, 6237 bp, Artificial Sequence
  Description of Artificial Sequence: Synthetic coding sequence
atgcccggcgaggccaccgagaccgtgcccgccaccgagcaggagctgccccagccccaggccgagaccgccgtgctgcccatgagcagcgccctgagcgtgaccgccgccctgggccagcccggccccaccctgccccccccctgcagccccgccccccagcagtgccccctgagcgccgccaaccaggccagccccttccccagccccagcaccatcgccagcacccccctggaggtgcccttcccccagagcagcagcggcaccgccctgcccctgggcaccgcccccgaggcccccaccttcctgcccaacctgatcggcccccccatcagccccgccgccctggccctggccagccccatgatcgcccccaccctgaagggcacccccagcagcagcgcccccctggccctggtggccctggccccccacagcgtgcagaagagcagcgccttcccccccaacctgctgaccagcccccccagcgtggccgtggccgagagcggcagcgtgatcaccctgagcgcccccatcgcccccagcgagcccaagaccaacctgaacaaggtgcccagcgaggtggtgcccaaccccaagggcacccccagccccccctgcatcgtgagcaccgtgccctaccactgcgtgacccccatggccagcatccagagcggcgtggccagcctgccccagaccacccccaccaccaccctggccatcgccagcccccaggtgaaggacaccaccatcagcagcgtgctgatcagcccccagaaccccggcagcctgagcctgaagggccccgtgagcccccccgccgccctgagcctgagcacccagagcctgcccgtggtgaccagcagccagaagaccgccggccccaacaccccccccgacttccccatcagcctgggcagccacctggcccccctgcaccagagcagcttcggcagcgtgcagctgctgggccagaccggccccagcgccctgagcgaccccaccgtgaagaccatcagcgtggaccacagcagcaccggcgccagctaccccagccagagaagcgtgatcccccccctgcccagcagaaacgaggtggtgcccgccaccgtggccgccttccccgtggtggcccccagcgtggacaagggccccagcaccatcagcagcatcacctgcagccccagcggcagcctgaacgtggccaccagcttcagcctgagccccaccaccagcctgatcctgaagagcagccccaacgccacctaccactaccccctggtggcccagatgcccgtgagcagcgtgggcaccacccccctggtggtgaccaacccctgcaccatcgccgccgcccccaccaccaccttcgaggtggccacctgcgtgagcccccccatgagcagcggccccatcagcaacatcgagcccaccagccccgccgccctggtgatggcccccgtggcccccaaggagcccagcacccaggtggccaccaccctgagaatccccgtgagcccccccctgcccgaccccgaggacctgaagaacctgcccagcagcgtgctggtgaagttccccacccagaaggacctgcagaccgtgcccgccagcctggagggcgcccccttcagccccgcccaggccggcctgaccaccaagaaggaccccaccgtgctgcccctggtgcaggccgcccccaagaacagccccagcttccagagcaccagcagcagccccgagatccccctgagccccgaggccaccctggccaagaagagcctgggcgagcccctgcccatcggcaagcccgccagcagcatgaccagccccctgggcgtgaacagcagcgccagcgtgatcaagaccgacagctacgccggccccgacagcgccggccccctgctgaagagcagcctgatcacccccaccgtggccgccttccccctggagagcgccgaccccgccggcgtggcccccaccaccgccaagggcaccagcacctacaccaccaccgccagccccttcctggagggcaccgtgagcctggcccccaagaaccaccccgtgaaggagggcaccctgaccaccctgcccctggtgcccaccgccagcgagaactgccccgtggcccccagcccccagaacacctgcgcccccctggccaccctggtgctggcccccgagatccccaagagcgtgcccagccccagcctgccccccgccggcaccccccccggcaccaagaaggtggacggcatcagccacaccagcgccctggcccccgtggccagcagccccaaggagtgccccaccgaggacagcggcgccagcgccaccgccagcagcaagggcaccctgacctacctggccgacagccccagccccctgggcgtgagcgtgagcccccagaccaagagaccccccaccaagaagggcagcgccggccccgacacccccatcggcaacctgagcagccccgtgagccccgtggaggccagcttcctgcccgagaacagcctgagcttccagggcagcaaggacagccccgccaccacccacagccccaccccccccagccccaagggcgcccccacccccagcgccgtgacccccctgagccccaagggcgtgaccctgccccccaaggagacccccacccccagcgtggtgaacctgcccttccccaaggagggccccgccacccccgcccccaagcaggcccccgccctgagcatgaccagcagcagccccaagaaggccagagccacccccgcccccaagggcatccccgccagccccagccccaagggcgcccccaccccccccgccgccaccccccccagccccaagggcggccccgccacccccagccccaagtgggcccccaccccccccgccgccaccccccccagccccaagggcggccccgccacccccagccccaagggcgcccccaccccccccgccgccaccccccccagccccaagggcggccccgccacccccagccccaagggcgcccccaccccccccgccgtgaccccccccagccccaagggcagccccgccgccacccccttccccaagggcgccagcaccccccccgccgccaccccccccagccccaagggcagccccgccgccacccccctgcccaagggcgcccccaccacccccgccgccaccctgcccagccccaagggcggccccgccacccccagcctgaagggcgcccccaccccccccgccgccaccccccccagccccaagggcggccccgccacccccagccccaagggcgcccccatgccccccgccgccaccccccccagccccaagggcggcctggccacccccccccacaagggcgcccccaccacccccgccgccaccccccccagccccaagggcggcctggccacccccccccccaagggcgcccccaccacccccgccgccaccccccccagccccaagggcggcctggccacccccccccccaagggcgcccccaccacccccgccgccaccccccccagccccaagggcggcctggccacccccagccccaagggcgcccccaccacccccgccgccaccccccccagccccaagggcggcctggccacccccagccccaagggcgcccccaccacccccgccgccaccccccccagccccaagggcggcctggccacccccagccccaagggcgcccccaccacccccgccgccaccccccccagccccaagggcggccccgccacccccccccccaagggcgcccccaccccccccgccgccaccccccccagcctgaagggcggcctggccacccccccccacaagggcgcccccaaccccgccgtggtgaccccccccagccccaagggcggccccgccaccagcccccccaagggcgcccccaccccccccgccgccaccccccccagccccaagggcagccccggcacccccccccccaagggcgcccccaccccccccgccgtgaccccccccagccccaagggcacccccaccctgcccgccaccacccccagcagcaagggcggccccaccacccccagcagcaaggagggccccaccccccccgccgccacccccagccacaagggcggccccgccatgaccccccccagccccaagagaggccccgccatccccagccccaagggcgaccccaccagccccgccgtgatccccctgagccccaagaaggcccccgccacccccgtgaccagagagggcgccgccacccccagcaagggcgacctgaccccccccgccgtgacccccgtgagcctgaagaaggcccccgccaccagcgcccccaagggcggccccgccacccccagcagcaagggcgaccccaccctgcccgccgtgaccccccccagccccaaggagccccccgcccccaagcaggtggccaccagcagcagccccaagaaggcccccgccacccccgcccccatgggcgcccccaccctgcccgccgtgatccccagcagccccaaggaggtgcccgccacccccagcagcagaagagaccccatcgcccccaccgccaccctgctgagcaagaagacccccgccaccctggcccccaaggaggccctgatcccccccgccatgaccgtgcccagccccaagaagacccccgccatccccacccccaaggaggcccccgccacccccagcagcaaggaggccagcagcccccccgccgtgacccccagcacctacaagggcgcccccagccccaaggagctgctgatcccccccgccgtgaccagccccagccccaaggaggcccccaccccccccgccgtgaccccccccagccccgagaagggccccgccacccccgcccccaagggcacccccaccagcccccccgtgacccccagcagcctgaaggacagccccaccagccccgccagcgtgacctgcaagatgggcgccaccgtgccccaggccagcaagggcctgcccgccaagaagggccccaccgccctgaaggaggtgctggtggcccccgcccccgagagcacccccatcatcaccgcccccaccagaaagggcccccagaccaagaagagcagcgccaccagcccccccatctgccccgaccccagcgccaagaacggcagcaagggccccctgagcaccgtggcccccgcccccctgctgcccgtgcagaaggacagcagcaagaccgccaagggcaaggacgccagccacagccccaagggccccctggccccccccgagagcaaggccagcacccccctgaccgccgccgccttcgagaaggtgctgcccaagcccgagagcgccagcgtgagcgccgcccccagcccccccgtgagcctgcccctggcccccagccccgtgcccaccctgccccccaagcagcagttcctgcccagcagccccggcctggtgctggagagccccagcaagcccctggcccccgccgacgaggacgagctgctgcccctgatcccccccgagcccatcagcggcggcgtgcccttccagagcgtgctggtgaacatgcccacccccaagagcgccggcatccccgtgcccacccccagcgccaagcagcccgtgaccaagaacaacaagggcagcggcaccgagagcgacagcgacgagagcgtgcccgagctggaggagcaggacagcacccaggccaccacccagcaggcccagctggccgccgccgccgagatcgacgaggagcccgtgagcaaggccaagcagagcagaagcgagaagaaggccagaaaggccatgagcaagctgggcctgagacaggtgaccggcgtgaccagagtgaccatcagaaagagcaagaacatcctgttcgtgatcaccaagcccgacgtgtacaagagccccgccagcgacacctacatcgtgttcggcgaggccaagatcgaggacctgagccagcaggcccagctggccgccgccgagaagttcaaggtgcagggcgaggccgtgagcaacatccaggagaacacccagacccccaccgtgcaggaggagagcgaggaggaggaggtggacgagaccggcgtggaggtgaaggacatcgagctggtgatgagccaggccaacgtgagcagagccaaggccgtgagagccctgaagaacaacagcaacgacatcgtgaacgccatcatggagctgaccatgtag

SEQ ID NO: 90446 - DNA, 648 bp, Artificial Sequence; identical to SEQ ID NO: 90443
  Description of Artificial Sequence: Synthetic coding sequence

SEQ ID NO: 90447 - DNA, 21 bp, Artificial Sequence
  Description of Artificial Sequence: Synthetic coding sequence
atgcccggcgaggccacctag

SEQ ID NO: 90448 - DNA, 597 bp, Artificial Sequence
  Description of Artificial Sequence: Synthetic coding sequence
atgcccggcgaggccaccgagaccgtgcccgccaccgagcaggagctgccccagccccaggccgagaccggcagcggcaccgagagcgacagcgacgagagcgtgcccgagctggaggagcaggacagcacccaggccaccacccagcaggcccagctggccgccgccgccgagatcgacgaggagcccgtgagcaaggccaagcagagcagaagcgagaagaaggccagaaaggccatgagcaagctgggcctgagacaggtgaccggcgtgaccagagtgaccatcagaaagagcaagaacatcctgttcgtgatcaccaagcccgacgtgtacaagagccccgccagcgacacctacatcgtgttcggcgaggccaagatcgaggacctgagccagcaggcccagctggccgccgccgagaagttcaaggtgcagggcgaggccgtgagcaacatccaggagaacacccagacccccaccgtgcaggaggagagcgaggaggaggaggtggacgagaccggcgtggaggtgaaggacatcgagctggtgatgagccaggccaacgtgagcagagccaaggccgtgagagcctag

SEQ ID NO: 90449 - DNA, 381 bp, Artificial Sequence
  Description of Artificial Sequence: Synthetic coding sequence
atgcccggcgaggccaccgagaccgtgcccgccaccgagcaggagctgccccagccccaggccgagaccggcagcggcaccgagagcgacagcgacgagagcgtgcccgagctggaggagcaggacagcacccaggccaccacccagcaggcccagctggccgccgccgccgagatcgacgaggagcccgtgagcaaggccaagcagagcagaagcgagaagaaggccagaaaggccatgagcaagctgggcctgagacaggtgaccggcgtgaccagagtgaccatcagaaagagcaagaacatcctgttcgtgatcaccaagcccgacgtgtacaagagccccgccagcgacacctacatcgtgttcggcgaggcctag

SEQ ID NO: 90450 - DNA, 648 bp, Artificial Sequence; identical to SEQ ID NO: 90443
  Description of Artificial Sequence: Synthetic coding sequence

SEQ ID NO: 90451 - DNA, 2778 bp, Artificial Sequence
  Description of Artificial Sequence: Synthetic coding sequence
atgcccggcgaggccaccgagaccgtgcccgccaccgagcaggagctgccccagccccaggccgagaccgccgtgctgcccatgagcagcgccctgagcgtgaccgccgccctgggccagcccggccccaccctgccccccccctgcagccccgccccccagcagtgccccctgagcgccgccaaccaggccagccccttccccagccccagcaccatcgccagcacccccctggaggtgcccttcccccagagcagcagcggcaccgccctgcccctgggcaccgcccccgaggcccccaccttcctgcccaacctgatcggcccccccatcagccccgccgccctggccctggccagccccatgatcgcccccaccctgaagggcacccccagcagcagcgcccccctggccctggtggccctggccccccacagcgtgcagaagagcagcgccttcccccccaacctgctgaccagcccccccagcgtggccgtggccgagagcggcagcgtgatcaccctgagcgcccccatcgcccccagcgagcccaagaccaacctgaacaaggtgcccagcgaggtggtgcccaaccccaagggcacccccagccccccctgcatcgtgagcaccgtgccctaccactgcgtgacccccatggccagcatccagagcggcgtggccagcctgccccagaccacccccaccaccaccctggccatcgccagcccccaggtgaaggacaccaccatcagcagcgtgctgatcagcccccagaaccccggcagcctgagcctgaagggccccgtgagcccccccgccgccctgagcctgagcacccagagcctgcccgtggtgaccagcagccagaagaccgccggccccaacaccccccccgacttccccatcagcctgggcagccacctggcccccctgcaccagagcagcttcggcagcgtgcagctgctgggccagaccggccccagcgccctgagcgaccccaccgtgaagaccatcagcgtggaccacagcagcaccggcgccagctaccccagccagagaagcgtgatcccccccctgcccagcagaaacgaggtggtgcccgccaccgtggccgccttccccgtggtggcccccagcgtggacaagggccccagcaccatcagcagcatcacctgcagccccagcggcagcctgaacgtggccaccagcttcagcctgagccccaccaccagcctgatcctgaagagcagccccaacgccacctaccactaccccctggtggcccagatgcccgtgagcagcgtgggcaccacccccctggtggtgaccaacccctgcaccatcgccgccgcccccaccaccaccttcgaggtggccacctgcgtgagcccccccatgagcagcggccccatcagcaacatcgagcccaccagccccgccgccctggtgatggcccccgtggcccccaaggagcccagcacccaggtggccaccaccctgagaatccccgtgagcccccccctgcccgaccccgaggacctgaagaacctgcccagcagcgtgctggtgaagttccccacccagaaggacctgcagaccgtgcccgccagcctggagggcgcccccttcagccccgcccaggccggcctgaccaccaagaaggaccccaccgtgctgcccctggtgcaggccgcccccaagaacagccccagcttccagagcaccagcagcagccccgagatccccctgagccccgaggccaccctggccaagaagagcctgggcgagcccctgcccatcgtggccgccttccccctggagagcgccgaccccgccggcgtggcccccaccaccgccaaggccgccgccttcgagaaggtgctgcccaagcccgagagcgccagcgtgagcgccgcccccagcccccccgtgagcctgcccctggcccccagccccgtgcccaccctgccccccaagcagcagttcctgcccagcagccccggcctggtgctggagagccccagcaagcccctggcccccgccgacgaggacgagctgctgcccctgatcccccccgagcccatcagcggcggcgtgcccttccagagcgtgctggtgaacatgcccacccccaagagcgccggcatccccgtgcccacccccagcgccaagcagcccgtgaccaagaacaacaagggcagcggcaccgagagcgacagcgacgagagcgtgcccgagctggaggagcaggacagcacccaggccaccacccagcaggcccagctggccgccgccgccgagatcgacgaggagcccgtgagcaaggccaagcagagcagaagcgagaagaaggccagaaaggccatgagcaagctgggcctgagacaggtgaccggcgtgaccagagtgaccatcagaaagagcaagaacatcctgttcgtgatcaccaagcccgacgtgtacaagagccccgccagcgacacctacatcgtgttcggcgaggccaagatcgaggacctgagccagcaggcccagctggccgccgccgagaagttcaaggtgcagggcgaggccgtgagcaacatccaggagaacacccagacccccaccgtgcaggaggagagcgaggaggaggaggtggacgagaccggcgtggaggtgaaggacatcgagctggtgatgagccaggccaacgtgagcagagccaaggccgtgagagccctgaagaacaacagcaacgacatcgtgaacgccatcatggagctgaccatgtag

SEQ ID NO: 90452 - DNA, 306 bp, Artificial Sequence
  Description of Artificial Sequence: Synthetic coding sequence
atgcccctggaggacgaggtggtgcccccccaggtgctgagcgagcccaacgaggaggccggcgccgccctgagccccctgcccgaggtgcccccctggaccggcgaggtgagccccgcccagagagacggcggcgccctgggcagaggcccctgggacagcagcgacagaagcgccctgctgaagagcaagctgagagccctgctgaccgcccccagaagcctgagaagaagcagctgcttcggcggcagaatggacagaatcggcgcccagagcggcctgggctgcaacagcttcagatactag

SEQ ID NO: 90453 - DNA, 456 bp, Artificial Sequence
  Description of Artificial Sequence: Synthetic coding sequence
atgagcagcttcagcaccaccaccgtgagcttcctgctgctgctggccttccagctgctgggccagaccagagccaaccccatgtacaacgccgtgagcaacgccgacctgatggacttcaagaacctgctggaccacctggaggagaagatgcccctggaggacgaggtggtgcccccccaggtgctgagcgagcccaacgaggaggccggcgccgccctgagccccctgcccgaggtgcccccctggaccggcgaggtgagccccgcccagagagacggcggcgccctgggcagaggcccctgggacagcagcgacagaagcgccctgctgaagagcaagctgagagccctgctgaccgcccccagaagcctgagaagaagcagctgcttcggcggcagaatggacagaatcggcgcccagagcggcctgggctgcaacagcttcagatactag

SEQ ID NO: 90454 - DNA, 768 bp, Artificial Sequence
  Description of Artificial Sequence: Synthetic coding sequence
atggagcagtacgccaacaacctggaggagctggtggaggagagaacccaggcctacctggaggagaagagaaaggccgaggccctgctgtaccagatcctgccccacagcgtggccgagcagctgaagagaggcgagaccgtgcaggccgaggccttcgacagcgtgaccatctacttcagcgacatcgtgggcttcaccgccctgagcgccgagagcacccccatgcaggtggtgaccctgctgaacgacctgtacacctgcttcgacgccgtgatcgacaacttcgacgtgtacaaggtggagaccatcggcgacgcctacatggtggtgagcggcctgcccgtgagaaacggcagactgcacgcctgcgaggtggccagaatggccctggccctgctggacgccgtgagaagcttcagaatcagacacagaccccaggagcagctgagactgagaatcggcatccacaccggccccgtgtgcgccggcgtggtgggcctgaagatgcccagatactgcctgttcggcgacaccgtgaacaccgccagcagaatggagagcaacggcgaggccctgaagatccacctgagcagcgagaccaaggccgtgctggaggagttcggcggcttcgagctggagctgagaggcgacgtggagatgaaggtggagggcgaggccagcgccctgcccaccttctggggccccagaggcagctaccccagccaggccgccaacgccacccccatccccaaggccctgatctag

SEQ ID NO: 90455 - DNA, 3186 bp, Artificial Sequence
  Description of Artificial Sequence: Synthetic coding sequence
atgcccggccccagaagacccgccggcagcagactgagactgctgctgctgctgctgctgccccccctgctgctgctgctgagaggcagccacgccggcaacctgaccgtggccgtggtgctgcccctggccaacaccagctacccctggagctgggccagagtgggccccgccgtggagctggccctggcccaggtgaaggccagacccgacctgctgcccggctggaccgtgagaaccgtgctgggcagcagcgagaacgccctgggcgtgtgcagcgacaccgccgcccccctggccgccgtggacctgaagtgggagcacaaccccgccgtgttcctgggccccggctgcgtgtacgccgccgcccccgtgggcagattcaccgcccactggagagtgcccctgctgaccgccggcgcccccgccctgggcttcggcgtgaaggacgagtacgccctgaccaccagagccggccccagctacgccaagctgggcgacttcgtggccgccctgcacagaagactgggctgggagagacaggccctgatgctgtacgcctacagacccggcgacgaggagcactgcttcttcctggtggagggcctgttcatgagagtgagagacagactgaacatcaccgtggaccacctggagttcgccgaggacgacctgagccactacaccagactgctgagaaccatgcccagaaagggcagagtgatctacatctgcagcagccccgacgccttcagaaccctgatgctgctggccctggaggccggcctgtgcggcgaggactacgtgttcttccacctggacatcttcggccagagcctgcagggcggccagggccccgcccccagaagaccctgggagagaggcgacggccaggacgtgagcgccagacaggccttccaggccgccaagatcatcacctacaaggaccccgacaaccccgagtacctggagttcctgaagcagctgaagcacctggcctacgagcagttcaacttcaccatggaggacggcctggtgaacaccatccccgccagcttccacgacggcctgctgctgtacatccaggccgtgaccgagaccctggcccacggcggcaccgtgaccgacggcgagaacatcacccagagaatgtggaacagaagcttccagggcgtgaccggctacctgaagatcgacagcagcggcgacagagagaccgacttcagcctgtgggacatggaccccgagaacggcgccttcagagtggtgctgaactacaacggcaccagccaggagctggtggccgtgagcggcagaaagctgaactggcccctgggctaccccccccccgacatccccaagtgcggcttcgacaacgaggaccccgcctgcaaccaggaccacctgagcaccctggaggtgctggccctggtgggcagcctgagcctgctgggcatcctgatcgtgagcttcttcatctacagaaagatgcagctggagaaggagctggccagcgagctgtggagagtgagatgggaggacgtggagcccagcagcctggagagacacctgagaagcgccggcagcagactgaccctgagcggcagaggcagcaactacggcagcctgctgaccaccgagggccagttccaggtgttcgccaagaccgcctactacaagggcaacctggtggccgtgaagagagtgaacagaaagagaatcgagctgaccagaaaggtgctgttcgagctgaagcacatgagagacgtgcagaacgagcacctgaccagattcgtgggcgcctgcaccgacccccccaacatctgcatcctgaccgagtactgccccagaggcagcctgcaggacatcctggagaacgagagcatcaccctggactggatgttcagatacagcctgaccaacgacatcgtgaagggcatgctgttcctgcacaacggcgccatctgcagccacggcaacctgaagagcagcaactgcgtggtggacggcagattcgtgctgaagatcaccgactacggcctggagagcttcagagacctggaccccgagcagggccacaccgtgtacgccaagaagctgtggaccgcccccgagctgctgagaatggccagcccccccgtgagaggcagccaggccggcgacgtgtacagcttcggcatcatcctgcaggagatcgccctgagaagcggcgtgttccacgtggagggcctggacctgagccccaaggagatcatcgagagagtgaccagaggcgagcagccccccttcagacccagcctggccctgcagagccacctggaggagctgggcctgctgatgcagagatgctgggccgaggacccccaggagagaccccccttccagcagatcagactgaccctgagaaagttcaacagagagaacagcagcaacatcctggacaacctgctgagcagaatggagcagtacgccaacaacctggaggagctggtggaggagagaacccaggcctacctggaggagaagagaaaggccgaggccctgctgtaccagatcctgccccacagcgtggccgagcagctgaagagaggcgagaccgtgcaggccgaggccttcgacagcgtgaccatctacttcagcgacatcgtgggcttcaccgccctgagcgccgagagcacccccatgcaggtggtgaccctgctgaacgacctgtacacctgcttcgacgccgtgatcgacaacttcgacgtgtacaaggtggagaccatcggcgacgcctacatggtggtgagcggcctgcccgtgagaaacggcagactgcacgcctgcgaggtggccagaatggccctggccctgctggacgccgtgagaagcttcagaatcagacacagaccccaggagcagctgagactgagaatcggcatccacaccggccccgtgtgcgccggcgtggtgggcctgaagatgcccagatactgcctgttcggcgacaccgtgaacaccgccagcagaatggagagcaacggcgaggccctgaagatccacctgagcagcgagaccaaggccgtgctggaggagttcggcggcttcgagctggagctgagaggcgacgtggagatgaagggcaagggcaaggtgagaacctactggctgctgggcgagagaggcagcagcaccagaggctag

SEQ ID NO: 90456 - DNA, 1623 bp, Artificial Sequence
  Description of Artificial Sequence: Synthetic coding sequence
aagatgcagctggagaaggagctggccagcgagctgtggagagtgagatgggaggacgtggagcccagcagcctggagagacacctgagaagcgccggcagcagactgaccctgagcggcagaggcagcaactacggcagcctgctgaccaccgagggccagttccaggtgttcgccaagaccgcctactacaagatgagagacgtgcagaacgagcacctgaccagattcgtgggcgcctgcaccgacccccccaacatctgcatcctgaccgagtactgccccagaggcagcctgcaggacatcctggagaacgagagcatcaccctggactggatgttcagatacagcctgaccaacgacatcgtgaagggcatgctgttcctgcacaacggcgccatctgcagccacggcaacctgaagagcagcaactgcgtggtggacggcagattcgtgctgaagatcaccgactacggcctggagagcttcagagacctggaccccgagcagggccacaccgtgtacgccaagaagctgtggaccgcccccgagctgctgagaatggccagcccccccgtgagaggcagccaggccggcgacgtgtacagcttcggcatcatcctgcaggagatcgccctgagaagcggcgtgttccacgtggagggcctggacctgagccccaaggagatcatcgagagagtgaccagaggcgagcagccccccttcagacccagcctggccctgcagagccacctggaggagctgggcctgctgatgcagagatgctgggccgaggacccccaggagagaccccccttccagcagatcagactgaccctgagaaagttcaacagagagaacagcagcaacatcctggacaacctgctgagcagaatggagcagtacgccaacaacctggaggagctggtggaggagagaacccaggcctacctggaggagaagagaaaggccgaggccctgctgtaccagatcctgccccacagcgtggccgagcagctgaagagaggcgagaccgtgcaggccgaggccttcgacagcgtgaccatctacttcagcgacatcgtgggcttcaccgccctgagcgccgagagcacccccatgcaggtggtgaccctgctgaacgacctgtacacctgcttcgacgccgtgatcgacaacttcgacgtgtacaaggtggagaccatcggcgacgcctacatggtggtgagcggcctgcccgtgagaaacggcagactgcacgcctgcgaggtggccagaatggccctggccctgctggacgccgtgagaagcttcagaatcagacacagaccccaggagcagctgagactgagaatcggcatccacaccggccccgtgtgcgccggcgtggtgggcctgaagatgcccagatactgcctgttcggcgacaccgtgaacaccgccagcagaatggagagcaacggcgaggccctgaagatccacctgagcagcgagaccaaggccgtgctggaggagttcggcggcttcgagctggagctgagaggcgacgtggagatgaagggcaagggcaaggtgagaacctactggctgctgggcgagagaggcagcagcaccagaggctag

SEQ ID NO: 90457 - DNA, 3144 bp, Artificial Sequence
  Description of Artificial Sequence: Synthetic coding sequence
atggccctgcccagcctgctgctgctggtggccgccctggccggcggcgtgagaccccccggcgccagaaacctgaccctggccgtggtgctgcccgagcacaacctgagctacgcctgggcctggcccagagtgggccccgccgtggccctggccgtggaggccctgggcagagccctgcccgtggacctgagattcgtgagcagcgagctggagggcgcctgcagcgagtacctggcccccctgagcgccgtggacctgaagctgtaccacgaccccgacctgctgctgggccccggctgcgtgtaccccgccgccagcgtggccagattcgccagccactggagactgcccctgctgaccgccggcgccgtggccagcggcttcagcgccaagaacgaccactacagaaccctggtgagaaccggccccagcgcccccaagctgggcgagttcgtggtgaccctgcacggccacttcaactggaccgccagagccgccctgctgtacctggacgccagaaccgacgacagaccccactacttcaccatcgagggcgtgttcgaggccctgcagggcagcaacctgagcgtgcagcaccaggtgtacgccagagagcccggcggccccgagcaggccacccacttcatcagagccaacggcagaatcgtgtacatctgcggccccctggagatgctgcacgagatcctgctgcaggcccagagagagaacctgaccaacggcgactacgtgttcttctacctggacgtgttcggcgagagcctgagagccggccccaccagagccaccggcagaccctggcaggacaacagaaccagagagcaggcccaggccctgagagaggccttccagaccgtgctggtgatcacctacagagagccccccaaccccgagtaccaggagttccagaacagactgctgatcagagccagagaggacttcggcgtggagctgggccccagcctgatgaacctgatcgccggctgcttctacgacggcatcctgctgtacgccgaggtgctgaacgagaccatccaggagggcggcaccagagaggacggcctgagaatcgtggagaagatgcagggcagaagataccacggcgtgaccggcctggtggtgatggacaagaacaacgacagagagaccgacttcgtgctgtgggccatgggcgacctggacagcggcgacttccagcccgccgcccactacagcggcgccgagaagcagatctggtggaccggcagacccatcccctgggtgaagggcgccccccccagcgacaaccccccctgcgccttcgacctggacgaccccagctgcgacaagacccccctgagcaccctggccatcgtggccctgggcaccggcatcaccttcatcatgttcggcgtgagcagcttcctgatcttcagaaagctgatgctggagaaggagctggccagcatgctgtggagaatcagatgggaggagctgcagttcggcaacagcgagagataccacaagggcgccggcagcagactgaccctgagcctgagaggcagcagctacggcagcctgatgaccgcccacggcaagtaccagatcttcgccaacaccggccacttcaagggcaacgtggtggccatcaagcacgtgaacaagaagagaatcgagctgaccagacaggtgctgttcgagctgaagcacatgagagacgtgcagttcaaccacctgaccagattcatcggcgcctgcatcgacccccccaacatctgcatcgtgaccgagtactgccccagaggcagcctgcaggacatcctggagaacgacagcatcaacctggactggatgttcagatacagcctgatcaacgacctggtgaagggcatggccttcctgcacaacagcatcatcagcagccacggcagcctgaagagcagcaactgcgtggtggacagcagattcgtgctgaagatcaccgactacggcctggccagcttcagaagcaccgccgagcccgacgacagccacgccctgtacgccaagaagctgtggaccgcccccgagctgctgagcggcaaccccctgcccaccaccggcatgcagaaggccgacgtgtacagcttcggcatcatcctgcaggagatcgccctgagaagcggccccttctacctggagggcctggacctgagccccaaggagatcgtgcagaaggtgagaaacggccagagaccctacttcagacccagcatcgacagaacccagctgaacgaggagctggtgctgctgatggagagatgctgggcccaggaccccgccgagagacccgacttcggccagatcaagggcttcatcagaagattcaacaaggagggcggcaccagcatcctggacaacctgctgctgagaatggagcagtacgccaacaacctggagaagctggtggaggagagaacccaggcctacctggaggagaagagaaaggccgaggccctgctgtaccagatcctgccccacagcgtggccgagcagctgaagagaggcgagaccgtgcaggccgaggccttcgacagcgtgaccatctacttcagcgacatcgtgggcttcaccgccctgagcgccgagagcacccccatgcaggtggtgaccctgctgaacgacctgtacacctgcttcgacgccatcatcgacaacttcgacgtgtacaaggtggagaccatcggcgacgcctacatggtggtgagcggcctgcccggcagaaacggccagagacacgcccccgagatcgccagaatggccctggccctgctggacgccgtgagcagcttcagaatcagacacagaccccacgaccagctgagactgagaatcggcgtgcacaccggccccgtgtgcgccggcgtggtgggcctgaagatgcccagatactgcctgttcggcgacaccgtgaacaccgccagcagaatggagagcaacggccaggccctgaagatccacgtgagcagcaccaccaaggacgccctggacgagctgggctgcttccagctggagctgagaggcgacgtggagatgaagggcaagggcaagatgagaacctactggctgctgggcgagagaaagggcccccccggcctgctgtag

SEQ ID NO: 90458 - DNA, 1626 bp, Artificial Sequence
  Description of Artificial Sequence: Synthetic coding sequence
atgcccagcctgctggtgctgaccttcagcccctgcgtgctgctgggctgggccctgctggccggcggcaccggcggcggcggcgtgggcggcggcggcggcggcgccggcatcggcggcggcagacaggagagagaggccctgcccccccagaagatcgaggtgctggtgctgctgccccaggacgacagctacctgttcagcctgaccagagtgagacccgccatcgagtacgccctgagaagcgtggagggcaacggcaccggcagaagactgctgccccccggcaccagattccaggtggcctacgaggacagcgactgcggcaacagagccctgttcagcctggtggacagagtggccgccgccagaggcgccaagcccgacctgatcctgggccccgtgtgcgagtacgccgccgcccccgtggccagactggccagccactgggacctgcccatgctgagcgccggcgccctggccgccggcttccagcacaaggacagcgagtacagccacctgaccagagtggcccccgcctacgccaagatgggcgagatgatgctggccctgttcagacaccaccactggagcagagccgccctggtgtacagcgacgacaagctggagagaaactgctacttcaccctggagggcgtgcacgaggtgttccaggaggagggcctgcacaccagcatctacagcttcgacgagaccaaggacctggacctggaggacatcgtgagaaacatccaggccagcgagagagtggtgatcatgtgcgccagcagcgacaccatcagaagcatcatgctggtggcccacagacacggcatgaccagcggcgactacgccttcttcaacatcgagctgttcaacagcagcagctacggcgacggcagctggaagagaggcgacaagcacgacttcgaggccaagcaggcctacagcagcctgcagaccgtgaccctgctgagaaccgtgaagcccgagttcgagaagttcagcatggaggtgaagagcagcgtggagaagcagggcctgaacatggaggactacgtgaacatgttcgtggagggcttccacgacgccatcctgctgtacgtgctggccctgcacgaggtgctgagagccggctacagcaagaaggacggcggcaagatcatccagcagacctggaacagaaccttcgagggcatcgccggccaggtgagcatcgacgccaacggcgacagatacggcgacttcagcgtgatcgccatgaccgacgtggaggccggcacccaggaggtgatcggcgactacttcggcaaggagggcagattcgagatgagacccaacgtgaagtacccctggggccccctgaagctgagaatcgacgagaacagaatcgtggagcacaccaacagcagcccctgcaagagcagcggcggcctggaggagagcgccgtgaccggcatcgtggtgggcgccctgctgggcgccggcctgctgatggccttctacttcttcagaaagaagtacagaatcaccatcgagagaagaacccagcaggaggagagcaacctgggcaagcacagagagctgagagaggacagcatcagaagccacttcagcgtggcctag

SEQ ID NO: 90459 - DNA, 1623 bp, Artificial Sequence
  Description of Artificial Sequence: Synthetic coding sequence
atgcccagcctgctggtgctgaccttcagcccctgcgtgctgctgggctgggccctgctggccggcggcaccggcggcggcggcgtgggcggcggcggcggcggcgccggcatcggcggcggcagacaggagagagaggccctgcccccccagaagatcgaggtgctggtgctgctgccccaggacgacagctacctgttcagcctgaccagagtgagacccgccatcgagtacgccctgagaagcgtggagggcaacggcaccggcagaagactgctgccccccggcaccagattccaggtggcctacgaggacagcgactgcggcaacagagccctgttcagcctggtggacagagtggccgccgccagaggcgccaagcccgacctgatcctgggccccgtgtgcgagtacgccgccgcccccgtggccagactggccagccactgggacctgcccatgctgagcgccggcgccctggccgccggcttccagcacaaggacagcgagtacagccacctgaccagagtggcccccgcctacgccaagatgggcgagatgatgctggccctgttcagacaccaccactggagcagagccgccctggtgtacagcgacgacaagctggagagaaactgctacttcaccctggagggcgtgcacgaggtgttccaggaggagggcctgcacaccagcatctacagcttcgacgagaccaaggacctggacctggaggacatcgtgagaaacatccaggccagcgagagagtggtgatcatgtgcgccagcagcgacaccatcagaagcatcatgctggtggcccacagacacggcatgaccagcggcgactacgccttcttcaacatcgagctgttcaacagcagcagctacggcgacggcagctggaagagaggcgacaagcacgacttcgaggccaagcaggcctacagcagcctgcagaccgtgaccctgctgagaaccgtgaagcccgagttcgagaagttcagcatggaggtgaagagcagcgtggagaagcagggcctgaacatggaggactacgtgaacatgttcgtggagggcttccacgacgccatcctgctgtacgtgctggccctgcacgaggtgctgagagccggctacagcaagaaggacggcggcaagatcatccagcagacctggaacagaaccttcgagggcatcgccggccaggtgagcatcgacgccaacggcgacagatacggcgacttcagcgtgatcgccatgaccgacgtggaggccggcacccaggaggtgatcggcgactacttcggcaaggagggcagattcgagatgagacccaacgtgaagtacccctggggccccctgaagctgagaatcgacgagaacagaatcgtggagcacaccaacagcagcccctgcaagagctgcggcctggaggagagcgccgtgaccggcatcgtggtgggcgccctgctgggcgccggcctgctgatggccttctacttcttcagaaagaagtacagaatcaccatcgagagaagaacccagcaggaggagagcaacctgggcaagcacagagagctgagagaggacagcatcagaagccacttcagcgtggcctag

SEQ ID NO: 90460 - DNA, 975 bp, Artificial Sequence
  Description of Artificial Sequence: Synthetic coding sequence
atggagcccagcgccctgggcccctggagcctgttccccgacctggcccccagagaccaggagggccaggtgctggcccccagaagatgcttcagaagagagtgcggccagaacgagaaggtggtgatcatgtgcgccagcagcgacaccatcagaagcatcatgctggtggcccacagacacggcatgaccagcggcgactacgccttcttcaacatcgagctgttcaacagcagcagctacggcgacggcagctggaagagaggcgacaagcacgacttcgaggccaagcaggcctacagcagcctgcagaccgtgaccctgctgagaaccgtgaagcccgagttcgagaagttcagcatggaggtgaagagcagcgtggagaagcagggcctgaacatggaggactacgtgaacatgttcgtggagggcttccacgacgccatcctgctgtacgtgctggccctgcacgaggtgctgagagccggctacagcaagaaggacggcggcaagatcatccagcagacctggaacagaaccttcgagggcatcgccggccaggtgagcatcgacgccaacggcgacagatacggcgacttcagcgtgatcgccatgaccgacgtggaggccggcacccaggaggtgatcggcgactacttcggcaaggagggcagattcgagatgagacccaacgtgaagtacccctggggccccctgaagctgagaatcgacgagaacagaatcgtggagcacaccaacagcagcccctgcaagagctgcggcctggaggagagcgccgtgaccggcatcgtggtgggcgccctgctgggcgccggcctgctgatggccttctacttcttcagaaagaagtacagaatcaccatcgagagaagaacccagcaggaggagagcaacctgggcaagcacagagagctgagagaggacagcatcagaagccacttcagcgtggcctag

SEQ ID NO: 90461 - DNA, 915 bp, Artificial Sequence
  Description of Artificial Sequence: Synthetic coding sequence
atgagcagcaccctgcccgccctgctgtgcgtgggcctgtgcctgagccagagaatcagcgcccagcagcagaccctgcccaagcccttcatctgggccgagccccacttcatggtgcccaaggagaagcaggtgaccatctgctgccagggcaactacggcgccgtggagtaccagctgcacttcgagggcagcctgttcgccgtggacagacccaagccccccgagagaatcaacaaggtgaagttctacatccccgacatgaacagcagaatggccggccagtacagctgcatctacagagtgggcgagctgtggagcgagcccagcaacctgctggacctggtggtgaccgagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgccgacacctggggcacctacctgctgaccaccgagaccggcctgcagaaggaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 90462 - DNA, 864 bp, Artificial Sequence
  Description of Artificial Sequence: Synthetic coding sequence
atgagcagcaccctgcccgccctgctgtgcgtgggcctgtgcctgagccagagaatcagcgcccagcagcagaccctgcccaagcccttcatctgggccgagccccacttcatggtgcccaaggagaagcaggtgaccatctgctgccagggcaactacggcgccgtggagtaccagctgcacttcgagggcagcctgttcgccgtggacagacccaagccccccgagagaatcaacaaggtgaagttctacatccccgacatgaacagcagaatggccggccagtacagctgcatctacagagtgggcgagctgtggagcgagcccagcaacctgctggacctggtggtgaccgagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 90463 - DNA, 630 bp, Artificial Sequence
  Description of Artificial Sequence: Synthetic coding sequence
atgagcagcaccctgcccgccctgctgtgcgtgggcctgtgcctgagccagagaatcagcgcccagcagcagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgccgacacctggggcacctacctgctgaccaccgagaccggcctgcagaaggaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 90464 - DNA, 594 bp, Artificial Sequence
  Description of Artificial Sequence: Synthetic coding sequence
atgagcagcaccctgcccgccctgctgtgcgtggagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgccgacacctggggcacctacctgctgaccaccgagaccggcctgcagaaggaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 90465 - DNA, 912 bp, Artificial Sequence
  Description of Artificial Sequence: Synthetic coding sequence
atgagcagcaccctgcccgccctgctgtgcgtgggcctgtgcctgagccagagaatcagcgcccagcagcagaccctgcccaagcccttcatctgggccgagccccacttcatggtgcccaaggagaagcaggtgaccatctgctgccagggcaactacggcgccgtggagtaccagctgcacttcgagggcagcctgttcgccgtggacagacccaagccccccgagagaatcaacaaggtgaagttctacatccccgacatgaacagcagaatggccggccagtacagctgcatctacagagtgggcgagctgtggagcgagcccagcaacctgctggacctggtggtgaccgagatgtacgacacccccaccctgagcgtgcaccccggccccgaggtgatcagcggcgagaaggtgaccttctactgcagactggacaccgccaccagcatgttcctgctgctgaaggagggcagaagcagccacgtgcagagaggctacggcaaggtgcaggccgagttccccctgggccccgtgaccaccgcccacagaggcacctacagatgcttcggcagctacaacaaccacgcctggagcttccccagcgagcccgtgaagctgctggtgaccggcgacatcgagaacaccagcctggcccccgaggaccccaccttccccgacacctggggcacctacctgctgaccaccgagaccggcctgcagaaggaccacgccctgtgggaccacaccgcccagaacctgctgagaatgggcctggccttcctggtgctggtggccctggtgtggttcctggtggaggactggctgagcagaaagagaaccagagagagagccagcagagccagcacctgggagggcagaagaagactgaacacccagaccctgtag

SEQ ID NO: 90466 - DNA, 777 bp, Artificial Sequence
  Description of Artificial Sequence: Synthetic coding sequence
atggcctggagagccctgcaccccctgctgctgctgctgctgctgttccccggcagccaggcccagagcaaggcccaggtgctgcagagcgtggccggccagaccctgaccgtgagatgccagtacccccccaccggcagcctgtacgagaagaagggctggtgcaaggaggccagcgccctggtgtgcatcagactggtgaccagcagcaagcccagaaccatggcctggaccagcagattcaccatctgggacgaccccgacgccggcttcttcaccgtgaccatgaccgacctgagagaggaggacagcggccactactggtgcagaatctacagacccagcgacaacagcgtgagcaagagcgtgagattctacctggtggtgagccccgccagcgccagcacccagaccagctggacccccagagacctggtgagcagccagacccagacccagagctgcgtgccccccaccgccggcgccagacaggcccccgagagccccagcaccatccccgtgcccagccagccccagaacagcaccctgagacccggccccgccgcccccatcgccctggtgcccgtgttctgcggcctgctggtggccaagagcctggtgctgagcgccctgctggtgtggtgggtgctgagaaacagacacatgcagcaccagggcagaagcctgctgcaccccgcccagcccagaccccaggcccacagacacttccccctgagccacagagcccccggcggcacctacggcggcaagccctag

SEQ ID NO: 90467 - DNA, 813 bp, Artificial Sequence
  Description of Artificial Sequence: Synthetic coding sequence
atggcctggagagccctgcaccccctgctgctgctgctgctgctgttccccggcagccaggcccagagcaaggcccaggtgctgcagagcgtggccggccagaccctgaccgtgagatgccagtacccccccaccggcagcctgtacgagaagaagggctggtgcaaggaggccagcgccctggtgtgcatcagactggtgaccagcagcaagcccagaaccatggcctggaccagcagattcaccatctgggacgaccccgacgccggcttcttcaccgtgaccatgaccgacctgagagaggaggacagcggccactactggtgcagaatctacagacccagcgacaacagcgtgagcaagagcgtgagattctacctggtggtgagccccgccagcgccagcacccagaccagctggacccccagagacctggtgagcagccagacccagacccagagctgcgtgccccccaccgccggcgccagacaggcccccgagagccccagcaccatccccgtgcccagccaccccagcagccccctgcccgtgcccctgcccagcagaccccagaacagcaccctgagacccggccccgccgcccccatcgccctggtgcccgtgttctgcggcctgctggtggccaagagcctggtgctgagcgccctgctggtgtggtgggtgctgagaaacagacacatgcagcaccagggcagaagcctgctgcaccccgcccagcccagaccccaggcccacagacacttccccctgagccacagagcccccggcggcacctacggcggcaagccctag

SEQ ID NO: 90468 - DNA, 831 bp, Artificial Sequence
  Description of Artificial Sequence: Synthetic coding sequence
atggcctggagagccctgcaccccctgctgctgctgctgctgctgttccccggcagccaggcccagagcaaggcccaggtgctgcagagcgtggccggccagaccctgaccgtgagatgccagtacccccccaccggcagcctgtacgagaagaagggctggtgcaaggaggccagcgccctggtgtgcatcagactggtgaccagcagcaagcccagaaccatggcctggaccagcagattcaccatctgggacgaccccgacgccggcttcttcaccgtgaccatgaccgacctgagagaggaggacagcggccactactggtgcagaatctacagacccagcgacaacagcgtgagcaagagcgtgagattctacctggtggtgagccccgccagcgccagcacccagaccagctggacccccagagacctggtgagcagccagacccagacccagagctgcgtgccccccaccgccggcgccagacaggcccccgagagccccagcaccatccccgtgcccagccagccccagaacagcaccctgagacccggccccgccgcccccatcgccctggtgcccgtgttctgcggcctgctggtggccaagagcctggtgctgagcgccctgctggtgtggtggggcgacatctggtggaagaccatgatggagctgagaagcctggacacccagaaggccacctgccacctgcagcaggtgaccgacctgccctggaccagcgtgagcagccccgtggagagagagatcctgtaccacaccgtggccagaaccaagatcagcgacgacgacgacgagcacaccctgtag

SEQ ID NO: 90469 - DNA, 606 bp, Artificial Sequence
  Description of Artificial Sequence: Synthetic coding sequence
atggcctggatgctgctgctgatcctgatcatggtgcaccccggcagctgcgccctgtgggtgagccagccccccgagatcagaaccctggagggcagcagcgccttcctgccctgcagcttcaacgccagccagggcagactggccatcggcagcgtgacctggttcagagacgaggtggtgcccggcaaggaggtgagaaacggcacccccgagttcagaggcagactggcccccctggccagcagcagattcctgcacgaccaccaggccgagctgcacatcagagacgtgagaggccacgacgccagcatctacgtgtgcagagtggaggtgctgggcctgggcgtgggcaccggcaacggcaccagactggtggtggagaaggagcacccccagctgggcgccggcaccgtgctgctgctgagagccggcttctacgccgtgagcttcctgagcgtggccgtgggcagcaccgtgtactaccagggcaagtgcctgacctggaagggccccagaagacagctgcccgccgtggtgcccgcccccctgccccccccctgcggcagcagcgcccacctgctgccccccgtgcccggcggctag

SEQ ID NO: 90470 - DNA, 498 bp, Artificial Sequence
  Description of Artificial Sequence: Synthetic coding sequence
atggcctggatgctgctgctgatcctgatcatggtgcaccccggcagctgcgccctgtgggtgagccagccccccgagatcagaaccctggagggcagcagcgccttcctgccctgcagcttcaacgccagccagggcagactggccatcggcagcgtgacctggttcagagacgaggtggtgcccggcaaggaggccgagctgcacatcagagacgtgagaggccacgacgccagcatctacgtgtgcagagtggaggtgctgggcctgggcgtgggcaccggcaacggcaccagactggtggtggagaaggagcacccccagctgggcgccggcaccgtgctgctgctgagagccggcttctacgccgtgagcttcctgagcgtggccgtgggcagcaccgtgtactaccagggcaagtgccactgccacatgggcacccactgccacagcagcgacggccccagaggcgtgatccccgagcccagatgcccctag

SEQ ID NO: 90471 - DNA, 573 bp, Artificial Sequence
  Description of Artificial Sequence: Synthetic coding sequence
atggcctggatgctgctgctgatcctgatcatggtgcaccccggcagctgcgccctgtgggtgagccagccccccgagatcagaaccctggagggcagcagcgccttcctgccctgcagcttcaacgccagccagggcagactggccatcggcagcgtgacctggttcagagacgaggtggtgcccggcaaggaggtgagaaacggcacccccgagttcagaggcagactggcccccctggccagcagcagattcctgcacgaccaccaggccgagctgcacatcagagacgtgagaggccacgacgccagcatctacgtgtgcagagtggaggtgctgggcctgggcgtgggcaccggcaacggcaccagactggtggtggagaaggagcacccccagctgggcgccggcaccgtgctgctgctgagagccggcttctacgccgtgagcttcctgagcgtggccgtgggcagcaccgtgtactaccagggcaagtgccactgccacatgggcacccactgccacagcagcgacggccccagaggcgtgatccccgagcccagatgcccctag

SEQ ID NO: 90472 - DNA, 534 bp, Artificial Sequence
  Description of Artificial Sequence: Synthetic coding sequence
atggcctggatgctgctgctgatcctgatcatggtgcaccccggcagctgcgccctgtgggtgagccagccccccgagatcagaaccctggagggcagcagcgccttcctgccctgcagcttcaacgccagccagggcagactggccatcggcagcgtgacctggttcagagacgaggtggtgcccggcaaggaggtgagaaacggcacccccgagttcagaggcagactggcccccctggccagcagcagattcctgcacgaccaccaggccgagctgcacatcagagacgtgagaggccacgacgccagcatctacgtgtgcagagtggaggtgctgggcctgggcgtgggcaccggcaacggcaccagactggtggtggagaaggagcacccccagctgggcgccggcaccgtgctgctgctgagagccggcttctacgccgtgagcttcctgagcgtggccgtgggcagcaccgtgtactaccagggcaagtacgccaagagcaccctgagcggcttcccccagctgtag

SEQ ID NO: 90473 - DNA, 573 bp, Artificial Sequence; identical to SEQ ID NO: 90471
  Description of Artificial Sequence: Synthetic coding sequence

SEQ ID NO: 90474 - DNA, 606 bp, Artificial Sequence; identical to SEQ ID NO: 90469
  Description of Artificial Sequence: Synthetic coding sequence

SEQ ID NO: 90475 - DNA, 534 bp, Artificial Sequence; identical to SEQ ID NO: 90472
  Description of Artificial Sequence: Synthetic coding sequence

SEQ ID NO: 90476 - DNA, 498 bp, Artificial Sequence; identical to SEQ ID NO: 90470
  Description of Artificial Sequence: Synthetic coding sequence

SEQ ID NO: 90477 - DNA, 573 bp, Artificial Sequence; identical to SEQ ID NO: 90471
  Description of Artificial Sequence: Synthetic coding sequence

SEQ ID NO: 90478 - DNA, 606 bp, Artificial Sequence; identical to SEQ ID NO: 90469
  Description of Artificial Sequence: Synthetic coding sequence

SEQ ID NO: 90479 - DNA, 573 bp, Artificial Sequence; identical to SEQ ID NO: 90471
  Description of Artificial Sequence: Synthetic coding sequence

SEQ ID NO: 90480 - DNA, 498 bp, Artificial Sequence; identical to SEQ ID NO: 90470
  Description of Artificial Sequence: Synthetic coding sequence

SEQ ID NO: 90481 - DNA, 498 bp, Artificial Sequence; identical to SEQ ID NO: 90470
  Description of Artificial Sequence: Synthetic coding sequence

SEQ ID NO: 90482 - DNA, 498 bp, Artificial Sequence; identical to SEQ ID NO: 90470
  Description of Artificial Sequence: Synthetic coding sequence

SEQ ID NO: 90483 - DNA, 606 bp, Artificial Sequence; identical to SEQ ID NO: 90469
  Description of Artificial Sequence: Synthetic coding sequence

SEQ ID NO: 90484 - DNA, 606 bp, Artificial Sequence; identical to SEQ ID NO: 90469
  Description of Artificial Sequence: Synthetic coding sequence

SEQ ID NO: 90485 - DNA, 534 bp, Artificial Sequence; identical to SEQ ID NO: 90472
  Description of Artificial Sequence: Synthetic coding sequence

SEQ ID NO: 90486 - DNA, 534 bp, Artificial Sequence; identical to SEQ ID NO: 90472
  Description of Artificial Sequence: Synthetic coding sequence

SEQ ID NO: 90487 - DNA, 606 bp, Artificial Sequence; identical to SEQ ID NO: 90469
  Description of Artificial Sequence: Synthetic coding sequence

SEQ ID NO: 90488 - DNA, 534 bp, Artificial Sequence; identical to SEQ ID NO: 90472
  Description of Artificial Sequence: Synthetic coding sequence

SEQ ID NO: 90489 - DNA, 573 bp, Artificial Sequence; identical to SEQ ID NO: 90471
  Description of Artificial Sequence: Synthetic coding sequence

SEQ ID NO: 90490 - DNA, 606 bp, Artificial Sequence; identical to SEQ ID NO: 90469
  Description of Artificial Sequence: Synthetic coding sequence

SEQ ID NO: 90491 - DNA, 498 bp, Artificial Sequence; identical to SEQ ID NO: 90470
  Description of Artificial Sequence: Synthetic coding sequence

SEQ ID NO: 90492 - DNA, 534 bp, Artificial Sequence; identical to SEQ ID NO: 90472
  Description of Artificial Sequence: Synthetic coding sequence

SEQ ID NO: 90493 - DNA, 573 bp, Artificial Sequence; identical to SEQ ID NO: 90471
  Description of Artificial Sequence: Synthetic coding sequence

SEQ ID NO: 90494 - DNA, 534 bp, Artificial Sequence; identical to SEQ ID NO: 90472
  Description of Artificial Sequence: Synthetic coding sequence

SEQ ID NO: 90495 - DNA, 606 bp, Artificial Sequence; identical to SEQ ID NO: 90469
  Description of Artificial Sequence: Synthetic coding sequence

SEQ ID NO: 90496 - DNA, 573 bp, Artificial Sequence; identical to SEQ ID NO: 90471
  Description of Artificial Sequence: Synthetic coding sequence

SEQ ID NO: 90497 - DNA, 498 bp, Artificial Sequence; identical to SEQ ID NO: 90470
  Description of Artificial Sequence: Synthetic coding sequence

SEQ ID NO: 90498 - DNA, 498 bp, Artificial Sequence; identical to SEQ ID NO: 90470
  Description of Artificial Sequence: Synthetic coding sequence

SEQ ID NO: 90499 - DNA, 534 bp, Artificial Sequence; identical to SEQ ID NO: 90472
  Description of Artificial Sequence: Synthetic coding sequence

SEQ ID NO: 90500 - DNA, 573 bp, Artificial Sequence; identical to SEQ ID NO: 90471
  Description of Artificial Sequence: Synthetic coding sequence

SEQ ID NO: 90501 - DNA, 486 bp, Artificial Sequence
  Description of Artificial Sequence: Synthetic coding sequence
atggacgacatctacaaggccgccgtggagcagctgaccgaggagcagaagaacgagttcaaggccgccttcgacatcttcgtgctgggcgccgaggacggctgcatcagcaccaaggagctgggcaaggtgatgagaatgctgggccagaaccccacccccgaggagctgcaggagatgatcgacgaggtggacgaggacggcagcggcaccgtggacttcgacgagttcctggtgatgatggtgagatgcatgaaggacgacagcaagggcaagagcgaggaggagctgagcgacctgttcagaatgttcgacaagaacgccgacggctacatcgacctggacgagctgaagatcatgctgcaggccaccggcgagaccatcaccgaggacgacatcgaggagctgatgaaggacggcgacaagaacaacgacggcagaatcgactacgacgagttcctggagttcatgaagggcgtggagtag

SEQ ID NO: 90502 - DNA, 315 bp, Artificial Sequence
  Description of Artificial Sequence: Synthetic coding sequence
atgggcgcccaggacagaccccagtgccacttcgacatcgagatcaacagagagcccgtgggcagaatcatgttccagctgttcagcgacatctgccccaagacctgcaagaacttcctgtgcctgtgcagcggcgagaagggcctgggcaagaccaccggcaagaagctgtgctacaagggcagcaccttccacagagtggtgaagaacttcatgatccagggcggcgacttcagcgagggcaacggcaagggcggcgagagcatctacggcggctacttcaaggagaacgtggtgttctgcaagatgaagtag

SEQ ID NO: 90503 - DNA, 2805 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggaggagaaggtgctgagaaacaacaagaacttcagcaccgtggacatccagaagaacggcgtgaagttcaccaacagcaagctgaccagcctgaacgaggagtacaccaagaacaagaccgagtacgaggaggcccaggacgccatcgtgaaggagatcgtgaacatcagcagcggctacgtggagcccatgcagaccctgaacgacgtgctggcccagctggacgccgtggtgagcttcgcccacgtgagcaacggcgcccccgtgccctacgtgagacccgccatcctggagaagggccagggcagaatcatcctgaaggccagcagacacgcctgcgtggaggtgcaggacgagatcgccttcatccccaacgacgtgtacttcgagaaggacaagcagatgttccacatcatcaccggccccaacatgggcggcaagagcacctacatcagacagaccggcgtgatcgtgctgatggcccagatcggctgcttcgtgccctgcgagagcgccgaggtgagcatcgtggactgcatcctggccagagtgggcgccggcgacagccagctgaagggcgtgagcaccttcatggccgagatgctggagaccgccagcatcctgagaagcgccaccaaggacagcctgatcatcatcgacgagctgggcagaggcaccagcacctacgacggcttcggcctggcctgggccatcagcgagtacatcgccaccaagatcggcgccttctgcatgttcgccacccacttccacgagctgaccgccctggccaaccagatccccaccgtgaacaacctgcacgtgaccgccctgaccaccgaggagaccctgaccatgctgtaccaggtgaagaagggcgtgtgcgaccagagcttcggcatccacgtggccgagctggccaacttccccaagcacgtgatcgagtgcgccaagcagaaggccctggagctggaggagttccagtacatcggcgagagccagggctacgacatcatggagcccgccgccaagaagtgctacctggagagagagcagggcgagaagatcatccaggagttcctgagcaaggtgaagcagatgcccttcaccgagatgagcgaggagaacatcaccatcaagctgaagcagctgaaggccgaggtgatcgccaagaacaacagcttcgtgaacgagatcatcagcagaatcaaggtgaccacctag

SEQ ID NO: 90504 - DNA, 435 bp, Artificial Sequence
  Description of Artificial Sequence: Synthetic coding sequence
atgaccgaggaggtgatcgtgatcgccaagtgggactacaccgcccagcaggaccaggagctggacatcaagaagaacgagagactgtggctgctggacgacagcaagacctggtggagagtgagaaacgccgccaacagaaccggctacgtgcccagcaactacgtggagagaaagaacagcctgaagaagggcagcctggtgaagaacctgaaggacaccctgggcctgggcaagaccagaagaaagaccagcgccagagacgccagccccacccccagcaccgacgccgagtaccccgccaacggcagcggcgccgacagaatctacgacctgaacatccccgccttcgtgaagttcgcctacgtggccgagagagaggacgagctgagcctggtgaagggcagcagagtgaccgtgatggagaagtgctag

SEQ ID NO: 90505 - DNA, 1143 bp, Artificial Sequence
  Description of Artificial Sequence: Synthetic coding sequence
atgaccgaggaggtgatcgtgatcgccaagtgggactacaccgcccagcaggaccaggagctggacatcaagaagaacgagagactgtggctgctggacgacagcaagacctggtggagagtgagaaacgccgccaacagaaccggctacgtgcccagcaactacgtggagagaaagaacagcctgaagaagggcagcctggtgaagaacctgaaggacaccctgggcctgggcaagaccagaagaaagaccagcgccagagacgccagccccacccccagcaccgacgccgagtaccccgccaacggcagcggcgccgacagaatctacgacctgaacatccccgccttcgtgaagttcgcctacgtggccgagagagaggacgagctgagcctggtgaagggcagcagagtgaccgtgatggagaagtgcagcgacggctggtggagaggcagctacaacggccagatcggctggttccccagcaactacgtgctggaggaggtggacgaggccgccgccgagagccccagcttcctgagcctgagaaagggcgccagcctgagcaacggccagggcagcagagtgctgcacgtggtgcagaccctgtaccccttcagcagcgtgaccgaggaggagctgaacttcgagaagggcgagaccatggaggtgatcgagaagcccgagaacgaccccgagtggtggaagtgcaagaacgccagaggccaggtgggcctggtgcccaagaactacgtggtggtgctgagcgacggccccgccctgcaccccgcccacgccccccagatcagctacaccggccccagcagcagcggcagattcgccggcagagagtggtactacggcaacgtgaccagacaccaggccgagtgcgccctgaacgagagaggcgtggagggcgacttcctgatcagagacagcgagagcagccccagcgacttcagcgtgagcctgaaggccagcggcaagaacaagcacttcaaggtgcagctggtggacaacgtgtactgcatcggccagagaagattccacaccatggacgagctggtggagcactacaagaaggcccccatcttcaccagcgagcacggcgagaagctgtacctggtgagagccctgcagtag

SEQ ID NO: 90506 - DNA, 333 bp, Artificial Sequence
  Description of Artificial Sequence: Synthetic coding sequence
atgaccgaggaggtgatcgtgatcgccaagtgggactacaccgcccagcaggaccaggagctggacatcaagaagaacgagagactgtggctgctggacgacagcaagacctggtggagagtgagaaacgccgccaacagaaccggctacgtgcccagcaactacgtggagagaaagaacagcctgaagaagggcagcctggtgaagaacctgaaggacaccctgggcctgggcaagaccagaagaaagaccagcgccagagacgccagccccacccccagcaccgacgccgagtaccccgccaacggcagcggcgccgacagaatctactag

SEQ ID NO: 90507 - DNA, 252 bp, Artificial Sequence
  Description of Artificial Sequence: Synthetic coding sequence
atgaccgaggaggtgatcgtgatcgccaagtgggactacaccgcccagcaggaccaggagctggacatcaagaagaacgagagactgtggctgctggacgacagcaagacctggtggagagtgagaaacgccgccaacagaaccggctacgtgcccagcaactacgtggagagaaagaacagcctgaagaagggcagcctggtgaagaacctgaaggacaccctggcccagagactgctgagagtgccctag

SEQ ID NO: 90508 - DNA, 252 bp, Artificial Sequence; identical to SEQ ID NO: 90507
  Description of Artificial Sequence: Synthetic coding sequence

SEQ ID NO: 90509 - DNA, 2169 bp, Artificial Sequence
  Description of Artificial Sequence: Synthetic coding sequence
atgtacagagccctgtacgccttcagaagcgccgagcccaacgccctggccttcgccgccggcgagaccttcctggtgctggagagaagcagcgcccactggtggctggccgccagagccagaagcggcgagaccggctacgtgccccccgcctacctgagaagactgcagggcctggagcaggacgtgctgcaggccatcgacagagccatcgaggccgtgcacaacaccgccatgagagacggcggcaagtacagcctggagcagagaggcgtgctgcagaagctgatccaccacagaaaggagaccctgagcagaagaggccccagcgccagcagcgtggccgtgatgaccagcagcaccagcgaccaccacctggacgccgccgccgccagacagcccaacggcgtgtgcagagccggcttcgagagacagcacagcctgcccagcagcgagcacctgggcgccgacggcggcctgtaccagatccccctgcccagcagccagatccccccccagcccagaagagccgcccccaccaccccccccccccccgtgaagagaagagacagagaggccctgatggccagcggcagcggcggccacaacaccatgcccagcggcggcaacagcgtgagcagcggcagcagcgtgagcagcaccagcctggacaccctgtacaccagcagcagccccagcgagcccggcagcagctgcagccccacccccccccccgtgcccagaagaggcacccacaccaccgtgagccaggtgcagcccccccccagcaaggccagcgcccccgagccccccgccgaggaggaggtggccaccggcaccaccagcgccagcgacgacctggaggccctgggcaccctgagcctgggcaccaccgaggagaaggccgccgccgaggccgccgtgcccagaaccatcggcgccgagctgatggagctggtgagaagaaacaccggcctgagccacgagctgtgcagagtggccatcggcatcatcgtgggccacatccaggccagcgtgcccgccagcagccccgtgatggagcaggtgctgctgagcctggtggagggcaaggacctgagcatggccctgcccagcggccaggtgtgccacgaccagcagagactggaggtgatcttcgccgacctggccagaagaaaggacgacgcccagcagagaagctgggccctgtacgaggacgagggcgtgatcagatgctacctggaggagctgctgcacatcctgaccgacgccgaccccgaggtgtgcaagaagatgtgcaagagaaacgagttcgagagcgtgctggccctggtggcctactaccagatggagcacagagccagcctgagactgctgctgctgaagtgcttcggcgccatgtgcagcctggacgccgccatcatcagcaccctggtgagcagcgtgctgcccgtggagctggccagagacatgcagaccgacacccaggaccaccagaagctgtgctacagcgccctgatcctggccatggtgttcagcatgggcgaggccgtgccctacgcccactacgagcacctgggcacccccttcgcccagttcctgctgaacatcgtggaggacggcctgcccctggacaccaccgagcagctgcccgacctgtgcgtgaacctgctgctggccctgaacctgcacctgcccgccgccgaccagaacgtgatcatggccgccctgagcaagcacgccaacgtgaagatcttcagcgagaagctgctgctgctgctgaacagaggcgacgaccccgtgagaatcttcaagcacgagccccagcccccccacagcgtgctgaagttcctgcaggacgtgttcggcagccccgccaccgccgccatcttctaccacaccgacatgatggccctgatcgacatcaccgtgagacacatcgccgacctgagccccggcgacaagctgagaatggagtacctgagcctgatgcacgccatcgtgagaaccaccccctacctgcagcacagacacagactgcccgacctgcaggccatcctgagaagaatcctgaacgaggaggagaccagcccccagtgccagatggacagaatgatcgtgagagagatgtgcaaggagttcctggtgctgggcgaggcccccagctag

SEQ ID NO: 90510 - DNA, 2169 bp, Artificial Sequence
  Description of Artificial Sequence: Synthetic coding sequence
atgtacagagccctgtacgccttcagaagcgccgagcccaacgccctggccttcgccgccggcgagaccttcctggtgctggagagaagcagcgcccactggtggctggccgccagagccagaagcggcgagaccggctacgtgccccccgcctacctgagaagactgcagggcctggagcaggacgtgctgcaggccatcgacagagccatcgaggccgtgcacaacaccgccatgagagacggcggcaagtacagcctggagcagagaggcgtgctgcagaagctgatccaccacagaaaggagaccctgagcagaagaggccccagcgccagcagcgtggccgtgatgaccagcagcaccagcgaccaccacctggacgccgccgccgccagacagcccaacggcgtgtgcagagccggcttcgagagacagcacagcctgcccagcagcgagcacctgggcgccgacggcggcctgtaccagatccccctgcccagcagccagatccccccccagcccagaagagccgcccccaccaccccccccccccccgtgaagagaagagacagagaggccctgatggccagcggcagcggcggccacaacaccatgcccagcggcggcaacagcgtgagcagcggcagcagcgtgagcagcaccagcctggacaccctgtacaccagcagcagccccagcgagcccggcagcagctgcagccccacccccccccccgtgcccagaagaggcacccacaccaccgtgagccaggtgcagcccccccccagcaaggccagcgcccccgagccccccgccgaggaggaggtggccaccggcaccaccagcgccagcgacgacctggaggccctgggcaccctgagcctgggcaccaccgaggagaaggccgccgccgaggccgccgtgcccagaaccatcggcgccgagctgatggagctggtgagaagaaacaccggcctgagccacgagctgtgcagagtggccatcggcatcatcgtgggccacatccaggccagcgtgcccgccagcagccccgtgatggagcaggtgctgctgagcctggtggagggcaaggacctgagcatggccctgcccagcggccaggtgtgccacgaccagcagagactggaggtgatcttcgccgacctggccagaagaaaggacgacgcccagcagagaagctgggccctgtacgaggacgagggcgtgatcagatgctacctggaggagctgctgcacatcctgaccgacgccgaccccgaggtgtgcaagaagatgtgcaagagaaacgagttcgagagcgtgctggccctggtggcctactaccagatggagcacagagccagcctgagactgctgctgctgaagtgcttcggcgccatgtgcagcctggacgccgccatcatcagcaccctggtgagcagcgtgctgcccgtggagctggccagagacatgcagaccgacacccaggaccaccagaagctgtgctacagcgccctgatcctggccatggtgttcagcatgggcgaggccgtgccctacgcccactacgagcacctgggcacccccttcgcccagttcctgctgaacatcgtggaggacggcctgcccctggacaccaccgagcagctgcccgacctgtgcgtgaacctgctgctggccctgaacctgcacctgcccgccgccgaccagaacgtgatcatggccgccctgagcaagcacgccaacgtgaagatcttcagcgagaagctgctgctgctgctgaacagaggcgacgaccccgtgagaatcttcaagcacgagccccagcccccccacagcgtgctgaagttcctgcaggacgtgttcggcagccccgccaccgccgccatcttctaccacaccgacatgatggccctgatcgacatcaccgtgagacacatcgccgacctgagccccggcgacaagggccccttcggcgccggccagagaccctggcccggcgtgcccagactgctggagcccggcagcacccccagcagagagccccaccccgtggagagaagcggcgtgcccgccctgaccagcagctgggccagcggctgccccagacccctgcaccccgccctgcagctggtgatcgacagcgccttcggcggcagaagcgtgtag

SEQ ID NO: 90511 - DNA, 2148 bp, Artificial Sequence
  Description of Artificial Sequence: Synthetic coding sequence
atgtacagagccctgtacgccttcagaagcgccgagcccaacgccctggccttcgccgccggcgagaccttcctggtgctggagagaagcagcgcccactggtggctggccgccagagccagaagcggcgagaccggctacgtgccccccgcctacctgagaagactgcagggcctggagcaggacgtgctgcaggccatcgacagagccatcgaggccgtgcacaacaccgccatgagagacggcggcaagtacagcctggagcagagaggcgtgctgcagaagctgatccaccacagaaaggagaccctgagcagaagaggccccagcgccagcagcgtggccgtgatgaccagcagcaccagcgaccaccacctggacgccgccgccgccagacagcccaacggcgtgtgcagagccggcttcgagagacagcacagcctgcccagcagcgagcacctgggcgccgacggcggcctgtaccagatccccccccagcccagaagagccgcccccaccaccccccccccccccgtgaagagaagagacagagaggccctgatggccagcggcagcggcggccacaacaccatgcccagcggcggcaacagcgtgagcagcggcagcagcgtgagcagcaccagcctggacaccctgtacaccagcagcagccccagcgagcccggcagcagctgcagccccacccccccccccgtgcccagaagaggcacccacaccaccgtgagccaggtgcagcccccccccagcaaggccagcgcccccgagccccccgccgaggaggaggtggccaccggcaccaccagcgccagcgacgacctggaggccctgggcaccctgagcctgggcaccaccgaggagaaggccgccgccgaggccgccgtgcccagaaccatcggcgccgagctgatggagctggtgagaagaaacaccggcctgagccacgagctgtgcagagtggccatcggcatcatcgtgggccacatccaggccagcgtgcccgccagcagccccgtgatggagcaggtgctgctgagcctggtggagggcaaggacctgagcatggccctgcccagcggccaggtgtgccacgaccagcagagactggaggtgatcttcgccgacctggccagaagaaaggacgacgcccagcagagaagctgggccctgtacgaggacgagggcgtgatcagatgctacctggaggagctgctgcacatcctgaccgacgccgaccccgaggtgtgcaagaagatgtgcaagagaaacgagttcgagagcgtgctggccctggtggcctactaccagatggagcacagagccagcctgagactgctgctgctgaagtgcttcggcgccatgtgcagcctggacgccgccatcatcagcaccctggtgagcagcgtgctgcccgtggagctggccagagacatgcagaccgacacccaggaccaccagaagctgtgctacagcgccctgatcctggccatggtgttcagcatgggcgaggccgtgccctacgcccactacgagcacctgggcacccccttcgcccagttcctgctgaacatcgtggaggacggcctgcccctggacaccaccgagcagctgcccgacctgtgcgtgaacctgctgctggccctgaacctgcacctgcccgccgccgaccagaacgtgatcatggccgccctgagcaagcacgccaacgtgaagatcttcagcgagaagctgctgctgctgctgaacagaggcgacgaccccgtgagaatcttcaagcacgagccccagcccccccacagcgtgctgaagttcctgcaggacgtgttcggcagccccgccaccgccgccatcttctaccacaccgacatgatggccctgatcgacatcaccgtgagacacatcgccgacctgagccccggcgacaagctgagaatggagtacctgagcctgatgcacgccatcgtgagaaccaccccctacctgcagcacagacacagactgcccgacctgcaggccatcctgagaagaatcctgaacgaggaggagaccagcccccagtgccagatggacagaatgatcgtgagagagatgtgcaaggagttcctggtgctgggcgaggcccccagctag

SEQ ID NO: 90512 - DNA, 3405 bp, Artificial Sequence
  Description of Artificial Sequence: Synthetic coding sequence
atgagcagaagcgtgctgcagcccagccagcagaagctggccgagaagctgaccatcctgaacgacagaggcgtgggcatgctgaccagactgtacaacatcaagaagcagggccaggtgtggaaggcctgcggcgaccccaaggccaagcccagctacctgatcgacaagaacctggagagcgccgtgaagttcatcgtgagaaagttccccgccgtggagaccagaaacaacaaccagcagctggcccagctgcagaaggagaagagcgagatcctgaagaacctggccctgtactacttcaccttcgtggacgtgatggagttcaaggaccacgtgtgcgagctgctgaacaccatcgacgtgtgccaggtgttcttcgacatcaccgtgaacttcgacctgaccaagaactacctggacctgatcatcacctacaccaccctgatgatcctgctgagcagaatcgaggagagaaaggccatcatcggcctgtacaactacgcccacgagatgacccacggcgccagcgacagagagtaccccagactgggccagatgatcgtggactacgagaaccccctgaagaagatgatggaggagttcgtgccccacagcaagagcctgagcgacgccctgatcagcctgcagatggtgtaccccagaagaaacctgagcgccgaccagtggagaaacgcccagctgctgagcctgatcagcgcccccagcaccatgctgaaccccgcccagagcgacaccatgccctgcgagtacctgagcctggacgccatggagaagtggatcatcttcggcttcatcctgtgccacggcatcctgaacaccgacgccaccgccctgaacctgtggaagctggccctgcagagcagcagctgcctgagcctgttcagagacgaggtgttccacatccacaaggccgccgaggacctgttcgtgaacatcagaggctacaacaagagaatcaacgacatcagagagtgcaaggaggccgccgtgagccacgccggcagcatgcacagagagagaagaaagttcctgagaagcgccctgaaggagctggccaccgtgctgagcgaccagcccggcctgctgggccccaaggccctgttcgtgttcatggccctgagcttcgccagagacgagatcatctggctgctgagacacgccgacaacatgcccaagaagagcgccgacgacttcatcgacaagcacatcgccgagctgatcttctacatggaggagctgagagcccacgtgagaaagtacggccccgtgatgcagagatactacgtgcagtacctgagcggcttcgacgccgtggtgctgaacgagctggtgcagaacctgagcgtgtgccccgaggacgagagcatcatcatgagcagcttcgtgaacaccatgaccagcctgagcgtgaagcaggtggaggacggcgaggtgttcgacttcagaggcatgagactggactggttcagactgcaggcctacaccagcgtgagcaaggccagcctgggcctggccgaccacagagagctgggcaagatgatgaacaccatcatcttccacaccaagatggtggacagcctggtggagatgctggtggagaccagcgacctgagcatcttctgcttctacagcagagccttcgagaagatgttccagcagtgcctggagctgcccagccagagcagatacagcatcgccttccccctgctgtgcacccacttcatgagctgcacccacgagctgtgccccgaggagagacaccacatcggcgacagaagcctgagcctgtgcaacatgttcctggacgagatggccaagcaggccagaaacctgatcaccgacatctgcaccgagcagtgcaccctgagcgaccagctgctgcccaagcactgcgccaagaccatcagccaggccgtgaacaagaagagcaagaagcagaccggcaagaagggcgagcccgagagagagaagcccggcgtggagagcatgagaaagaacagactggtggtgaccaacctggacaagctgcacaccgccctgagcgagctgtgcttcagcatcaactacgtgcccaacatggtggtgtgggagcacaccttcacccccagagagtacctgaccagccacctggagatcagattcaccaagagcatcgtgggcatgaccatgtacaaccaggccacccaggagatcgccaagcccagcgagctgctgaccagcgtgagagcctacatgaccgtgctgcagagcatcgagaactacgtgcagatcgacatcaccagagtgttcaacaacgtgctgctgcagcagacccagcacctggacagccacggcgagcccaccatcaccagcctgtacaccaactggtacctggagaccctgctgagacaggtgagcaacggccacatcgcctacttccccgccatgaaggccttcgtgaacctgcccaccgagaacgagctgaccttcaacgccgaggagtacagcgacatcagcgagatgagaagcctgagcgagctgctgggcccctacggcatgaagttcctgagcgagagcctgatgtggcacatcagcagccaggtggccgagctgaagaagctggtggtggagaacgtggacgtgctgacccagatgagaaccagcttcgacaagcccgaccagatggccgccctgttcaagagactgagcagcgtggacagcgtgctgaagagaatgaccatcatcggcgtgatcctgagcttcagaagcctggcccaggaggccctgagagacgtgctgagctaccacatccccttcctggtgagcagcatcgaggacttcaaggaccacatccccagagagaccgacatgaaggtggccatgaacgtgtacgagctgagcagcgccgccggcctgccctgcgagatcgaccccgccctggtggtggccctgagcagccagaagagcgagaacatcagccccgaggaggagtacaagatcgcctgcctgctgatggtgttcgtggccgtgagcctgcccaccctggccagcaacgtgatgagccagtacagccccgccatcgagggccactgcaacaacatccactgcctggccaaggccatcaaccagatcgccgccgccctgttcaccatccacaagggcagcatcgaggacagactgaaggagttcctggccctggccagcagcagcctgctgaagatcggccaggagaccgacaagaccaccaccagaaacagagagagcgtgtacctgctgctggacatgatcgtgcaggagagccccttcctgaccatggacctgctggagagctgcttcccctacgtgctgctgagaaacgcctaccacgccgtgtacaagcagagcgtgaccagcagcgcctag

SEQ ID NO: 90513 - DNA, 3387 bp, Artificial Sequence
  Description of Artificial Sequence: Synthetic coding sequence
atgagcagaagcgtgctgcagcccagccagcagaagctggccgagaagctgaccatcctgaacgacagaggcgtgggcatgctgaccagactgtacaacatcaagaaggcctgcggcgaccccaaggccaagcccagctacctgatcgacaagaacctggagagcgccgtgaagttcatcgtgagaaagttccccgccgtggagaccagaaacaacaaccagcagctggcccagctgcagaaggagaagagcgagatcctgaagaacctggccctgtactacttcaccttcgtggacgtgatggagttcaaggaccacgtgtgcgagctgctgaacaccatcgacgtgtgccaggtgttcttcgacatcaccgtgaacttcgacctgaccaagaactacctggacctgatcatcacctacaccaccctgatgatcctgctgagcagaatcgaggagagaaaggccatcatcggcctgtacaactacgcccacgagatgacccacggcgccagcgacagagagtaccccagactgggccagatgatcgtggactacgagaaccccctgaagaagatgatggaggagttcgtgccccacagcaagagcctgagcgacgccctgatcagcctgcagatggtgtaccccagaagaaacctgagcgccgaccagtggagaaacgcccagctgctgagcctgatcagcgcccccagcaccatgctgaaccccgcccagagcgacaccatgccctgcgagtacctgagcctggacgccatggagaagtggatcatcttcggcttcatcctgtgccacggcatcctgaacaccgacgccaccgccctgaacctgtggaagctggccctgcagagcagcagctgcctgagcctgttcagagacgaggtgttccacatccacaaggccgccgaggacctgttcgtgaacatcagaggctacaacaagagaatcaacgacatcagagagtgcaaggaggccgccgtgagccacgccggcagcatgcacagagagagaagaaagttcctgagaagcgccctgaaggagctggccaccgtgctgagcgaccagcccggcctgctgggccccaaggccctgttcgtgttcatggccctgagcttcgccagagacgagatcatctggctgctgagacacgccgacaacatgcccaagaagagcgccgacgacttcatcgacaagcacatcgccgagctgatcttctacatggaggagctgagagcccacgtgagaaagtacggccccgtgatgcagagatactacgtgcagtacctgagcggcttcgacgccgtggtgctgaacgagctggtgcagaacctgagcgtgtgccccgaggacgagagcatcatcatgagcagcttcgtgaacaccatgaccagcctgagcgtgaagcaggtggaggacggcgaggtgttcgacttcagaggcatgagactggactggttcagactgcaggcctacaccagcgtgagcaaggccagcctgggcctggccgaccacagagagctgggcaagatgatgaacaccatcatcttccacaccaagatggtggacagcctggtggagatgctggtggagaccagcgacctgagcatcttctgcttctacagcagagccttcgagaagatgttccagcagtgcctggagctgcccagccagagcagatacagcatcgccttccccctgctgtgcacccacttcatgagctgcacccacgagctgtgccccgaggagagacaccacatcggcgacagaagcctgagcctgtgcaacatgttcctggacgagatggccaagcaggccagaaacctgatcaccgacatctgcaccgagcagtgcaccctgagcgaccagctgctgcccaagcactgcgccaagaccatcagccaggccgtgaacaagaagagcaagaagcagaccggcaagaagggcgagcccgagagagagaagcccggcgtggagagcatgagaaagaacagactggtggtgaccaacctggacaagctgcacaccgccctgagcgagctgtgcttcagcatcaactacgtgcccaacatggtggtgtgggagcacaccttcacccccagagagtacctgaccagccacctggagatcagattcaccaagagcatcgtgggcatgaccatgtacaaccaggccacccaggagatcgccaagcccagcgagctgctgaccagcgtgagagcctacatgaccgtgctgcagagcatcgagaactacgtgcagatcgacatcaccagagtgttcaacaacgtgctgctgcagcagacccagcacctggacagccacggcgagcccaccatcaccagcctgtacaccaactggtacctggagaccctgctgagacaggtgagcaacggccacatcgcctacttccccgccatgaaggccttcgtgaacctgcccaccgagaacgagctgaccttcaacgccgaggagtacagcgacatcagcgagatgagaagcctgagcgagctgctgggcccctacggcatgaagttcctgagcgagagcctgatgtggcacatcagcagccaggtggccgagctgaagaagctggtggtggagaacgtggacgtgctgacccagatgagaaccagcttcgacaagcccgaccagatggccgccctgttcaagagactgagcagcgtggacagcgtgctgaagagaatgaccatcatcggcgtgatcctgagcttcagaagcctggcccaggaggccctgagagacgtgctgagctaccacatccccttcctggtgagcagcatcgaggacttcaaggaccacatccccagagagaccgacatgaaggtggccatgaacgtgtacgagctgagcagcgccgccggcctgccctgcgagatcgaccccgccctggtggtggccctgagcagccagaagagcgagaacatcagccccgaggaggagtacaagatcgcctgcctgctgatggtgttcgtggccgtgagcctgcccaccctggccagcaacgtgatgagccagtacagccccgccatcgagggccactgcaacaacatccactgcctggccaaggccatcaaccagatcgccgccgccctgttcaccatccacaagggcagcatcgaggacagactgaaggagttcctggccctggccagcagcagcctgctgaagatcggccaggagaccgacaagaccaccaccagaaacagagagagcgtgtacctgctgctggacatgatcgtgcaggagagccccttcctgaccatggacctgctggagagctgcttcccctacgtgctgctgagaaacgcctaccacgccgtgtacaagcagagcgtgaccagcagcgcctag

SEQ ID NO: 90514 - DNA, 2649 bp, Artificial Sequence
  Description of Artificial Sequence: Synthetic coding sequence
atgcccgccctggcctgcctgagaagactgtgcagacacgtgagcccccaggccgtgctgttcctgctgttcatcttctgcctgttcagcgtgttcatcagcgcctactacctgtacggctggaagagaggcctggagcccagcgccgacgcccccgagcccgactgcggcgaccccccccccgtggcccccagcagactgctgcccctgaagcccgtgcaggccgccacccccagcagaaccgaccccctggtgctggtgttcgtggagagcctgtacagccagctgggccaggaggtggtggccatcctggagagcagcagattcaagtacagaaccgagatcgcccccggcaagggcgacatgcccaccctgaccgacaagggcagaggcagattcgccctgatcatctacgagaacatcctgaagtacgtgaacctggacgcctggaacagagagctgctggacaagtactgcgtggcctacggcgtgggcatcatcggcttcttcaaggccaacgagaacagcctgctgagcgcccagctgaagggcttccccctgttcctgcacagcaacctgggcctgaaggactgcagcatcaaccccaagagccccctgctgtacgtgaccagacccagcgaggtggagaagggcgtgctgcccggcgaggactggaccgtgttccagagcaaccacagcacctacgagcccgtgctgctggccaagaccagaagcagcgagagcatcccccacctgggcgccgacgccggcctgcacgccgccctgcacgccaccgtggtgcaggacctgggcctgcacgacggcatccagagagtgctgttcggcaacaacctgaacttctggctgcacaagctggtgttcgtggacgccgtggccttcctgaccggcaagagactgagcctgcccctggacagatacatcctggtggacatcgacgacatcttcgtgggcaaggagggcaccagaatgaaggtggaggacgtgaaggccctgttcgacacccagaacgagctgagagcccacatccccaacttcaccttcaacctgggctacagcggcaagttcttccacaccggcaccaacgccgaggacgccggcgacgacctgctgctgagctacgtgaaggagttctggtggttcccccacatgtggagccacatgcagccccacctgttccacaaccagagcgtgctggccgagcagatggccctgaacaagaagttcgccgtggagcacggcatccccaccgacatgggctacgccgtggccccccaccacagcggcgtgtaccccgtgcacgtgcagctgtacgaggcctggaagcaggtgtggagcatcagagtgaccagcaccgaggagtacccccacctgaagcccgccagatacagaagaggcttcatccacaacggcatcatggtgctgcccagacagacctgcggcctgttcacccacaccatcttctacaacgagtaccccggcggcagcagcgagctggacaagatcatcaacggcggcgagctgttcctgaccgtgctgctgaaccccatcagcatcttcatgacccacctgagcaactacggcaacgacagactgggcctgtacaccttcaagcacctggtgagattcctgcacagctggaccaacctgagactgcagaccctgccccccgtgcagctggcccagaagtacttccagatcttcagcgaggagaaggaccccctgtggcaggacccctgcgaggacaagagacacaaggacatctggagcaaggagaagacctgcgacagattccccaagctgctgatcatcggcccccagaagaccggcaccaccgccctgtacctgttcctgggcatgcaccccgacctgagcagcaactaccccagcagcgagaccttcgaggagatccagttcttcaacggccacaactaccacaagggcatcgactggtacatggagttcttccccatccccagcaacaccaccagcgacttctacttcgagaagagcgccaactacttcgacagcgaggtggcccccagaagagccgccgccctgctgcccaaggccaaggtgctgaccatcctgatcaaccccgccgacagagcctacagctggtaccagcaccagagagcccacgacgaccccgtggccctgaagtacaccttccacgaggtgatcaccgccggcagcgacgccagcagcaagctgagagccctgcagaacagatgcctggtgcccggctggtacgccacccacatcgagagatggctgagcgcctaccacgccaaccagatcctggtgctggacggcaagctgctgagaaccgagcccgccaaggtgatggacatggtgcagaagttcctgggcgtgaccaacaccatcgactaccacaagaccctggccttcgaccccaagaagggcttctggtgccagctgctggagggcggcaagaccaagtgcctgggcaagagcaagggcagaaagtaccccgagatggacctggacagcagagccttcctgaaggactactacagagaccacaacatcgagctgagcaagctgctgtacaagatgggccagaccctgcccacctggctgagagaggacctgcagaacaccagatag

SEQ ID NO: 90515 - DNA, 72 bp, Artificial Sequence
  Description of Artificial Sequence: Synthetic coding sequence
atgcccgccctggcctgcctgagaagactgtgcagacacgtgagcccccaggccgtgctgttcctgctgtag

SEQ ID NO: 90516 - DNA, 480 bp, Artificial Sequence
  Description of Artificial Sequence: Synthetic coding sequence
atgcccgccctggcctgcctgagaagactgtgcagacacgtgagcccccaggccgtgctgttcctgctgttcatcttctgcctgttcagcgtgttcatcagcgcctactacctgtacggctggaagagaggcctggagcccagcgccgacgcccccgagcccgactgcggcgaccccccccccgtggcccccagcagactgctgcccctgaagcccgtgcaggccgccacccccagcagaaccgaccccctggtgctggtgttcgtggagagcctgtacagccagctgggccaggaggtggtggccatcctggagagcagcagattcaagtacagaaccgagatcgcccccggcaagggcgacatgcccaccctgaccgacaagggcagaggcagattcgccctgatcatctacgagaacatcctgaagtacgtgaacctggacgcctggaacagagagctgctggacaagtactgctag

SEQ ID NO: 90517 - DNA, 207 bp, Artificial Sequence
  Description of Artificial Sequence: Synthetic coding sequence
atgcccgccctggcctgcctgagaagactgtgcagacacgtgagcccccaggccgtgctgttcctgctgttcatcttctgcctgttcagcgtgttcatcagcgcctactacctgtacggctggaagagaggcctggagcccagcgccgacgcccccgagcccgactgcggcgaccccccccccgtggcccccagcagactgctgtag

SEQ ID NO: 90518 - DNA, 2283 bp, Artificial Sequence
  Description of Artificial Sequence: Synthetic coding sequence
atgcccaccctgaccgacaacacccacggcagatacgtgctggtgatctacgagaacctgctgaagtacgtgaacctggacgcctggagcagagagctgctggacagatactgcgtggagtacggcgtgggcatcatcggcttcttcagagcccacgagcacagcctgctgagcgcccagctgaagggcttccccctgttcctgcacagcaacctgggcctgagagactaccaggtgaaccccagcgcccccctgctgcacctgaccagacccagcagactggagcccggccccctgcccggcgacgactggaccatcttccagagcaaccacagcacctacgagcccgtgctgctggccagcctgagacccgccgagcccgccgtgcccggccccgtgctgagaagagccagactgcccaccgtggtgcaggacctgggcctgcacgacggcatccagagagtgctgttcggccacggcctgagcttctggctgcacaagctgatcttcgtggacgccgtggcctacctgaccggcaagagactgtgcctggacctggacagatacatcctggtggacatcgacgacatcttcgtgggcaaggagggcaccagaatgaaggtggccgacgtggaggccctgctgaccacccagaacaagctgagaaccctggtgcccaacttcaccttcaacctgggcttcagcggcaagttctaccacaccggcaccgaggaggaggacgccggcgacgacatgctgctgaagcacagaaaggagttctggtggttcccccacatgtggagccacatgcagccccacctgttccacaacagaagcgtgctggccgaccagatgagactgaacaagcagttcgccctggagcacggcatccccaccgacctgggctacgccgtggccccccaccacagcggcgtgtaccccatccacacccagctgtacgaggcctggaagagcgtgtggggcatccaggtgaccagcaccgaggagtacccccacctgagacccgccagatacagaagaggcttcatccacaacggcatcatggtgctgcccagacagacctgcggcctgttcacccacaccatcttctacaacgagtaccccggcggcagcagagagctggacagaagcatcagaggcggcgagctgttcctgaccgtgctgctgaaccccatcagcatcttcatgacccacctgagcaactacggcaacgacagactgggcctgtacaccttcgagagcctggtgagattcctgcagtgctggaccagactgagactgcagaccctgccccccgtgcccctggcccagaagtacttcgagctgttcccccaggagagaagccccctgtggcagaacccctgcgacgacaagagacacaaggacatctggagcaaggagaagacctgcgacagactgcccaagttcctgatcgtgggcccccagaagaccggcaccaccgccatccacttcttcctgagcctgcaccccgccgtgaccagcagcttccccagccccagcaccttcgaggagatccagttcttcaacagccccaactaccacaagggcatcgactggtacatggacttcttccccgtgcccagcaacgccagcaccgacttcctgttcgagaagagcgccacctacttcgacagcgaggtggtgcccagaagaggcgccgccctgctgcccagagccaagatcatcaccgtgctgaccaaccccgccgacagagcctacagctggtaccagcaccagagagcccacggcgaccccgtggccctgaactacaccttctaccaggtgatcagcgccagcagccagacccccctggccctgagaagcctgcagaacagatgcctggtgcccggctactacagcacccacctgcagagatggctgacctactaccccagcggccagctgctgatcgtggacggccaggagctgagaaccaaccccgccgccagcatggagagcatccagaagttcctgggcatcacccccttcctgaactacaccagaaccctgagattcgacgacgacaagggcttctggtgccagggcctggagggcggcaagaccagatgcctgggcagaagcaagggcagaagataccccgacatggacaccgagagcagactgttcctgaccgacttcttcagaaaccacaacctggagctgagcaagctgctgagcagactgggccagcccgtgcccagctggctgagagaggagctgcagcacagcagcctgggctag

SEQ ID NO: 90519 - DNA, 2652 bp, Artificial Sequence
  Description of Artificial Sequence: Synthetic coding sequence
atgctgcagctgtggaaggtggtgagacccgccagacagctggagctgcacagactgatcctgctgctgatcgccttcagcctgggcagcatgggcttcctggcctactacgtgagcaccagccccaaggccaaggagcccctgcccctgcccctgggcgactgcagcagcggcggcgccgccggccccggccccgccagaccccccgtgccccccagaccccccagaccccccgagaccgccagaaccgagcccgtggtgctggtgttcgtggagagcgcctacagccagctgggccaggagatcgtggccatcctggagagcagcagattcagatacagcaccgagctggcccccggcagaggcgacatgcccaccctgaccgacaacacccacggcagatacgtgctggtgatctacgagaacctgctgaagtacgtgaacctggacgcctggagcagagagctgctggacagatactgcgtggagtacggcgtgggcatcatcggcttcttcagagcccacgagcacagcctgctgagcgcccagctgaagggcttccccctgttcctgcacagcaacctgggcctgagagactaccaggtgaaccccagcgcccccctgctgcacctgaccagacccagcagactggagcccggccccctgcccggcgacgactggaccatcttccagagcaaccacagcacctacgagcccgtgctgctggccagcctgagacccgccgagcccgccgtgcccggccccgtgctgagaagagccagactgcccaccgtggtgcaggacctgggcctgcacgacggcatccagagagtgctgttcggccacggcctgagcttctggctgcacaagctgatcttcgtggacgccgtggcctacctgaccggcaagagactgtgcctggacctggacagatacatcctggtggacatcgacgacatcttcgtgggcaaggagggcaccagaatgaaggtggccgacgtggaggccctgctgaccacccagaacaagctgagaaccctggtgcccaacttcaccttcaacctgggcttcagcggcaagttctaccacaccggcaccgaggaggaggacgccggcgacgacatgctgctgaagcacagaaaggagttctggtggttcccccacatgtggagccacatgcagccccacctgttccacaacagaagcgtgctggccgaccagatgagactgaacaagcagttcgccctggagcacggcatccccaccgacctgggctacgccgtggccccccaccacagcggcgtgtaccccatccacacccagctgtacgaggcctggaagagcgtgtggggcatccaggtgaccagcaccgaggagtacccccacctgagacccgccagatacagaagaggcttcatccacaacggcatcatggtgctgcccagacagacctgcggcctgttcacccacaccatcttctacaacgagtaccccggcggcagcagagagctggacagaagcatcagaggcggcgagctgttcctgaccgtgctgctgaaccccatcagcatcttcatgacccacctgagcaactacggcaacgacagactgggcctgtacaccttcgagagcctggtgagattcctgcagtgctggaccagactgagactgcagaccctgccccccgtgcccctggcccagaagtacttcgagctgttcccccaggagagaagccccctgtggcagaacccctgcgacgacaagagacacaaggacatctggagcaaggagaagacctgcgacagactgcccaagttcctgatcgtgggcccccagaagaccggcaccaccgccatccacttcttcctgagcctgcaccccgccgtgaccagcagcttccccagccccagcaccttcgaggagatccagttcttcaacagccccaactaccacaagggcatcgactggtacatggacttcttccccgtgcccagcaacgccagcaccgacttcctgttcgagaagagcgccacctacttcgacagcgaggtggtgcccagaagaggcgccgccctgctgcccagagccaagatcatcaccgtgctgaccaaccccgccgacagagcctacagctggtaccagcaccagagagcccacggcgaccccgtggccctgaactacaccttctaccaggtgatcagcgccagcagccagacccccctggccctgagaagcctgcagaacagatgcctggtgcccggctactacagcacccacctgcagagatggctgacctactaccccagcggccagctgctgatcgtggacggccaggagctgagaaccaaccccgccgccagcatggagagcatccagaagttcctgggcatcacccccttcctgaactacaccagaaccctgagattcgacgacgacaagggcttctggtgccagggcctggagggcggcaagaccagatgcctgggcagaagcaagggcagaagataccccgacatggacaccgagagcagactgttcctgaccgacttcttcagaaaccacaacctggagctgagcaagctgctgagcagactgggccagcccgtgcccagctggctgagagaggagctgcagcacagcagcctgggctag

SEQ ID NO: 90520 - DNA, 450 bp, Artificial Sequence
  Description of Artificial Sequence: Synthetic coding sequence
ggcgaccccgtggccctgaactacaccttctaccaggtgatcagcgccagcagccagacccccctggccctgagaagcctgcagaacagatgcctggtgcccggctactacagcacccacctgcagagatggctgacctactaccccagcggccagctgctgatcgtggacggccaggagctgagaaccaaccccgccgccagcatggagagcatccagaagttcctgggcatcacccccttcctgaactacaccagaaccctgagattcgacgacgacaagggcttctggtgccagggcctggagggcggcaagaccagatgcctgggcagaagcaagggcagaagataccccgacatggacaccgaggtgagcaaggccagaggcagaggcatccccctgcacttccaggacctgatcctgtgccccaccagctaccacttctgctag

SEQ ID NO: 90521 - DNA, 696 bp, Artificial Sequence
  Description of Artificial Sequence: Synthetic coding sequence
atgagagtgcccgtgttcgaggacatcaaggacgagaccgaggaggagaagatcggcgaggaggagaacgaggaggaccaggtgttctacaagcccgtgatcgaggacctgagcatggagctggccagaaagtgcaccgagctgatcagcgacatcagatacaaggaggagttcaagaagagcaaggacaagtgcaccttcgtgaccgacagccccatgctgaaccacgtgaagaacatcggcgccttcatcagcgaggccaagtacaagggcaccatcaaggccgacctgagcaacagcctgtacaagagaatgcccgccaccatcgacagcgtgttcgccggcgaggtgacccagctgcagagcgaggtggcctacaagcagaagcacgacgccgccaagggcttcagcgactacgcccacatgaaggagccccccgaggtgaagcacgccatggaggtgaacaagcaccagagcaacatcagctacagaaaggacgtgcaggacacccacacctacagcgccgagctggacagacccgacatcaagatggccacccagatcagcaagatcatcagcaacgccgagtacaagaagggccagggcatcatgaacaaggagcccgccgtgatcggcagacccgacttcgagcacgccgtggaggccagcaagctgagcagccaggtgagactgtag

SEQ ID NO: 90522 - DNA, 3045 bp, Artificial Sequence
  Description of Artificial Sequence: Synthetic coding sequence
atgagagtgcccgtgttcgaggacatcaaggacgagaccgaggaggagaagatcggcgaggaggagaacgaggaggaccaggtgttctacaagcccgtgatcgaggacctgagcatggagctggccagaaagtgcaccgagctgatcagcgacatcagatacaaggaggagttcaagaagagcaaggacaagtgcaccttcgtgaccgacagccccatgctgaaccacgtgaagaacatcggcgccttcatcagcgaggccaagtacaagggcaccatcaaggccgacctgagcaacagcctgtacaagagaatgcccgccaccatcgacagcgtgttcgccggcgaggtgacccagctgcagagcgaggtggcctacaagcagaagcacgacgccgccaagggcttcagcgactacgcccacatgaaggagccccccgaggtgaagcacgccatggaggtgaacaagcaccagagcaacatcagctacagaaaggacgtgcaggacacccacacctacagcgccgagctggacagacccgacatcaagatggccacccagatcagcaagatcatcagcaacgccgagtacaagaagggccagggcatcatgaacaaggagcccgccgtgatcggcagacccgacttcgagcacgccgtggaggccagcaagctgagcagccagatcaagtacaaggagaagttcgacaacgagatgaaggacaagaagcaccactacaaccccctggagagcgccagcttcagacagaaccagctggccgccaccctggccagcaacgtgaagtacaagaaggacatccagaacatgcacgaccccgtgagcgacctgcccaacctgctgttcctggaccacgtgctgaaggccagcaagatgctgagcggcagagagtacaagaagctgttcgaggagaacaagggcatgtaccacttcgacgccgacgccgtggagcacctgcaccacaagggcaacgccgtgctgcagagccaggtgaagtacaaggaggagtacgagaagaacaagggcaagcccatgctggagttcgtggagacccccagctaccaggccagcaaggaggcccagaagatgcagagcgagaaggtgtacaaggaggacttcgagaaggagatcaagggcagaagcagcctggacctggacaagacccccgagttcctgcacgtgaagtacatcaccaacctgctgagagagaaggagtacaagaaggacctggagaacgagatcaagggcaagggcatggagctgaacagcgaggtgctggacatccagagagccaagagagccagcgagatggccagcgagaaggagtacaagaaggacctggagagcatcatcaagggcaagggcatgcaggccggcaccgacaccctggagatgcagcacgccaagaaggccgccgagatcgccagcgagaaggactacaagagagacctggagaccgagatcaagggcaagggcatgcaggtgagcaccgacaccctggacgtgcagagagccaagaaggccagcgagatggccagccagaagcagtacaagaaggacctggagaacgagatcaagggcaagggcatgcaggtgagcatggacatccccgacatcctgagagccaagagaaccagcgagatctacagccagagaaagtacaaggacgaggccgagaagatgctgagcaactacagcaccatcgccgacacccccgagatccagagaatcaagaccacccagcagaacatcagcgccgtgttctacaagaaggaggtgggcgccggcaccgccgtgaaggacagccccgagatcgagagagtgaagaagaaccagcagaacatcagcagcgtgaagtacaaggaggagatcaagcacgccaccgccatcagcgacccccccgagctgaagagagtgaaggagaaccagaagaacatcagcaacctgcagtacaaggagcagaactacaaggccacccccgtgagcatgacccccgagatcgagagagtgagaagaaaccaggagcagctgagcgccgtgaagtacaagggcgagctgcagagaggcaccgccatcagcgacccccccgagctgaagagagccaaggagaaccagaagaacatcagcaacgtgtactacagaggccagctgggcagagccaccaccctgagcgtgacccccgagatggagagagtgaagaagaaccaggagaacatcagcagcgtgaagtacacccaggaccacaagcagatgaagggcagacccagcctgatcctggacacccccgccatgagacacgtgaaggaggcccagaaccacatcagcatggtgaagtaccacgaggacttcgagaagaccaagggcagaggcttcacccccgtggtggacgaccccgtgaccgagagagtgagaaagaacacccaggtggtgagcgacgccgcctacaagggcgtgcacccccacatcgtggagatggacagaagacccggcatcatcgtggacctgaaggtgtggagaaccgaccccggcagcatcttcgacctggaccccctggaggacaacatccagagcagaagcctgcacatgctgagcgagaaggccagccactacagaagacactggagcagaagccacagcagcagcaccttcggcaccggcctgggcgacgacagaagcgagatcagcgagatctaccccagcttcagctgctgcagcgaggtgaccagacccagcgacgagggcgcccccgtgctgcccggcgcctaccagcagagccacagccagggctacggctacatgcaccagaccagcgtgagcagcatgagaagcatgcagcacagccccaacctgagaacctacagagccatgtacgactacagcgcccaggacgaggacgaggtgagcttcagagacggcgactacatcgtgaacgtgcagcccatcgacgacggctggatgtacggcaccgtgcagagaaccggcagaaccggcatgctgcccgccaactacatcgagttcgtgaactag

SEQ ID NO: 90523 - DNA, 711 bp, Artificial Sequence
  Description of Artificial Sequence: Synthetic coding sequence
atgctgcacttctactacgagtggctgcacagcggcagcagaggcgccgtgcccaagcccctgcactaccccaagcagagcttcaccaccgtggccgacacccccgagaacctgagactgaagcagcagagcgagctgcagagccaggtgaagtacaagagagacttcgaggagagcaagggcagaggcttcagcatcgtgaccgacacccccgagctgcagagactgaagagaacccaggagcagatcagcaacgtgaagtaccacgaggacttcgagaagaccaagggcagaggcttcacccccgtggtggacgaccccgtgaccgagagagtgagaaagaacacccaggtggtgagcgacgccgcctacaagggcgtgcacccccacatcgtggagatggacagaagacccggcatcatcgtggcccccgtgctgcccggcgcctaccagcagagccacagccagggctacggctacatgcaccagaccagcgtgagcagcatgagaagcatgcagcacagccccaacctgagaacctacagagccatgtacgactacagcgcccaggacgaggacgaggtgagcttcagagacggcgactacatcgtgaacgtgcagcccatcgacgacggctggatgtacggcaccgtgcagagaaccggcagaaccggcatgctgcccgccaactacatcgagttcgtgaactag

SEQ ID NO: 90524 - DNA, 813 bp, Artificial Sequence
  Description of Artificial Sequence: Synthetic coding sequence
atgaacccccagtgcgccagatgcggcaaggtggtgtaccccaccgagaaggtgaactgcctggacaagtactggcacaagggctgcttccactgcgaggtgtgcaagatggccctgaacatgaacaactacaagggctacgagaagaagccctactgcaacgcccactaccccaagcagagcttcaccaccgtggccgacacccccgagaacctgagactgaagcagcagagcgagctgcagagccaggtgaagtacaagagagacttcgaggagagcaagggcagaggcttcagcatcgtgaccgacacccccgagctgcagagactgaagagaacccaggagcagatcagcaacgtgaagtaccacgaggacttcgagaagaccaagggcagaggcttcacccccgtggtggacgaccccgtgaccgagagagtgagaaagaacacccaggtggtgagcgacgccgcctacaagggcgtgcacccccacatcgtggagatggacagaagacccggcatcatcgtggcccccgtgctgcccggcgcctaccagcagagccacagccagggctacggctacatgcaccagaccagcgtgagcagcatgagaagcatgcagcacagccccaacctgagaacctacagagccatgtacgactacagcgcccaggacgaggacgaggtgagcttcagagacggcgactacatcgtgaacgtgcagcccatcgacgacggctggatgtacggcaccgtgcagagaaccggcagaaccggcatgctgcccgccaactacatcgagttcgtgaactag

SEQ ID NO: 90525 - DNA, 354 bp, Artificial Sequence
  Description of Artificial Sequence: Synthetic coding sequence
atgagaaacaactgcaccgccagcctgatgaaggtgttctacaagcccgtgatcgaggacctgagcatggagctggccagaaagtgcaccgagctgatcagcgacatcagatacaaggaggagttcaagaagagcaaggacaagtgcaccttcgtgaccgacagccccatgctgaaccacgtgaagaacatcggcgccttcatcagcgaggccaagtacaagggcaccatcaaggccgacctgagcaacagcctgtacaagagaatgcccgccaccatcgacagcgtgttcgccggcgaggtgacccagctgcagagcgaggtggcctacaagcagaagcacgacgccgcctag

SEQ ID NO: 90526 - DNA, 20010 bp, Artificial Sequence
  Description of Artificial Sequence: Synthetic coding sequence
atggccgacgacgaggactacgaggaggtggtggagtactacaccgaggaggtggtgtacgaggaggtgcccggcgagaccatcaccaagatctacgagaccaccaccaccagaaccagcgactacgagcagagcgagaccagcaagcccgccctggcccagcccgccctggcccagcccgccagcgccaagcccgtggagagaagaaaggtgatcagaaagaaggtggaccccagcaagttcatgaccccctacatcgcccacagccagaagatgcaggacctgttcagccccaacaagtacaaggagaagttcgagaagaccaagggccagccctacgccagcaccaccgacacccccgagctgagaagaatcaagaaggtgcaggaccagctgagcgaggtgaagtacagaatggacggcgacgtggccaagaccatctgccacgtggacgagaaggccaaggacatcgagcacgccaagaaggtgagccagcaggtgagcaaggtgctgtacaagcagaactgggaggacaccaaggacaagtacctgctgccccccgacgcccccgagctggtgcaggccgtgaagaacaccgccatgttcagcaagaagctgtacaccgaggactgggaggccgacaagagcctgttctacccctacaacgacagccccgagctgagaagagtggcccaggcccagaaggccctgagcgacgtggcctacaagaagggcctggccgagcagcaggcccagttcacccccctggccgacccccccgacatcgagttcgccaagaaggtgaccaaccaggtgagcaagcagaagtacaaggaggactacgagaacaagatcaagggcaagtggagcgagaccccctgcttcgaggtggccaacgccagaatgaacgccgacaacatcagcaccagaaagtaccaggaggacttcgagaacatgaaggaccagatctacttcatgcagaccgagacccccgagtacaagatgaacaagaaggccggcgtggccgccagcaaggtgaagtacaaggaggactacgagaagaacaagggcaaggccgactacaacgtgctgcccgccagcgagaacccccagctgagacagctgaaggccgccggcgacgccctgagcgacaagctgtacaaggagaactacgagaagaccaaggccaagagcatcaactactgcgagacccccaagttcaagctggacaccgtgctgcagaacttcagcagcgacaagaagtacaaggacagctacctgaaggacatcctgggccactacgtgggcagcttcgaggacccctaccacagccactgcatgaaggtgaccgcccagaacagcgacaagaactacaaggccgagtacgaggaggacagaggcaagggcttcttcccccagaccatcacccaggagtacgaggccatcaagaagctggaccagtgcaaggaccacacctacaaggtgcaccccgacaagaccaagttcacccaggtgaccgacagccccgtgctgctgcaggcccaggtgaacagcaagcagctgagcgacctgaactacaaggccaagcacgagagcgagaagttcaagtgccacatcccccccgacacccccgccttcatccagcacaaggtgaacgcctacaacctgagcgacaacctgtacaagcaggactgggagaagagcaaggccaagaagttcgacatcaaggtggacgccatccccctgctggccgccaaggccaacaccaagaacaccagcgacgtgatgtacaagaaggactacgagaagaacaagggcaagatgatcggcgtgctgagcatcaacgacgaccccaagatgctgcacagcctgaaggtggccaagaaccagagcgacagactgtacaaggagaactacgagaagaccaaggccaagagcatgaactactgcgagacccccaagtaccagctggacacccagctgaagaacttcagcgaggccagatacaaggacctgtacgtgaaggacgtgctgggccactacgtgggcagcatggaggacccctaccacacccactgcatgaaggtggccgcccagaacagcgacaagagctacaaggccgagtacgaggaggacaagggcaagtgctacttcccccagaccatcacccaggagtacgaggccatcaagaagctggaccagtgcaaggaccacacctacaaggtgcaccccgacaagaccaagttcaccgccgtgaccgacagccccgtgctgctgcaggcccagctgaacaccaagcagctgagcgacctgaactacaaggccaagcacgagggcgagaagttcaagtgccacatccccgccgacgccccccagttcatccagcacagagtgaacgcctacaacctgagcgacaacgtgtacaagcaggactgggagaagagcaaggccaagaagttcgacatcaaggtggacgccatccccctgctggccgccaaggccaacaccaagaacaccagcgacgtgatgtacaagaaggactacgagaagagcaagggcaagatgatcggcgccctgagcatcaacgacgaccccaagatgctgcacagcctgaagaccgccaagaaccagagcgacagagagtacagaaaggactacgagaagagcaagaccatctacaccgcccccctggacatgctgcaggtgacccaggccaagaagagccaggccatcgccagcgacgtggactacaagcacatcctgcacagctacagctacccccccgacagcatcaacgtggacctggccaagaaggcctacgccctgcagagcgacgtggagtacaaggccgactacaacagctggatgaagggctgcggctgggtgcccttcggcagcctggagatggagaaggccaagagagccagcgacatcctgaacgagaagaagtacagacagcaccccgacaccctgaagttcaccagcatcgaggacgcccccatcaccgtgcagagcaagatcaaccaggcccagagaagcgacatcgcctacaaggccaagggcgaggagatcatccacaagtacaacctgccccccgacctgccccagttcatccaggccaaggtgaacgcctacaacatcagcgagaacatgtacaaggccgacctgaaggacctgagcaagaagggctacgacctgagaaccgacgccatccccatcagagccgccaaggccgccagacaggccgccagcgacgtgcagtacaagaaggactacgagaaggccaagggcaagatggtgggcttccagagcctgcaggacgaccccaagctggtgcactacatgaacgtggccaagatccagagcgacagagagtacaagaaggactacgagaagaccaagagcaagtacaacaccccccacgacatgttcaacgtggtggccgccaagaaggcccaggacgtggtgagcaacgtgaactacaagcacagcctgcaccactacacctacctgcccgacgccatggacctggagctgagcaagaacatgatgcagatccagagcgacaacgtgtacaaggaggactacaacaactggatgaagggcatcggctggatccccatcggcagcctggacgtggagaaggtgaagaaggccggcgacgccctgaacgagaagaagtacagacagcaccccgacaccctgaagttcaccagcatcgtggacagccccgtgatggtgcaggccaagcagaacaccaagcaggtgagcgacatcctgtacaaggccaagggcgaggacgtgaagcacaagtacaccatgagccccgacctgccccagttcctgcaggccaagtgcaacgcctacaacatcagcgacgtgtgctacaagagagactggtacgacctgatcgccaagggcaacaacgtgctgggcgacgccatccccatcaccgccgccaaggccagcagaaacatcgccagcgactacaagtacaaggaggcctacgagaagagcaagggcaagcacgtgggcttcagaagcctgcaggacgaccccaagctggtgcactacatgaacgtggccaagctgcagagcgacagagagtacaagaagaactacgagaacaccaagaccagctaccacacccccggcgacatggtgagcatcaccgccgccaagatggcccaggacgtggccaccaacgtgaactacaagcagcccctgcaccactacacctacctgcccgacgccatgagcctggagcacaccagaaacgtgaaccagatccagagcgacaacgtgtacaaggacgagtacaacagcttcctgaagggcatcggctggatccccatcggcagcctggaggtggagaaggtgaagaaggccggcgacgccctgaacgagagaaagtacagacagcaccccgacaccgtgaagttcaccagcgtgcccgacagcatgggcatggtgctggcccagcacaacaccaagcagctgagcgacctgaactacaaggtggagggcgagaagctgaagcacaagtacaccatcgaccccgagctgccccagttcatccaggccaaggtgaacgccctgaacatgagcgacgcccactacaaggccgactggaagaagaccatcgccaagggctacgacctgagacccgacgccatccccatcgtggccgccaagagcagcagaaacatcgccagcgactgcaagtacaaggaggcctacgagaaggccaagggcaagcaggtgggcttcctgagcctgcaggacgaccccaagctggtgcactacatgaacgtggccaagatccagagcgacagagagtacaagaagggctacgaggccagcaagaccaagtaccacacccccctggacatggtgagcgtgaccgccgccaagaagagccaggaggtggccaccaacgccaactacagacagagctaccaccactacaccctgctgcccgacgccctgaacgtggagcacagcagaaacgccatgcagatccagagcgacaacctgtacaagagcgacttcaccaactggatgaagggcatcggctgggtgcccatcgagagcctggaggtggagaaggccaagaaggccggcgagatcctgagcgagaagaagtacagacagcaccccgagaagctgaagttcacctacgccatggacaccatggagcaggccctgaacaagagcaacaagctgaacatggacaagagactgtacaccgagaagtggaacaaggacaagaccaccatccacgtgatgcccgacacccccgacatcctgctgagcagagtgaaccagatcaccatgagcgacaagctgtacaaggccggctgggaggaggagaagaagaagggctacgacctgagacccgacgccatcgccatcaaggccgccagagccagcagagacatcgccagcgactacaagtacaagaaggcctacgagcaggccaagggcaagcacatcggcttcagaagcctggaggacgaccccaagctggtgcacttcatgcaggtggccaagatgcagagcgacagagagtacaagaagggctacgagaagagcaagaccagcttccacacccccgtggacatgctgagcgtggtggccgccaagaagagccaggaggtggccaccaacgccaactacagaaacgtgatccacacctacaacatgctgcccgacgccatgagcttcgagctggccaagaacatgatgcagatccagagcgacaaccagtacaaggccgactacgccgacttcatgaagggcatcggctggctgcccctgggcagcctggaggccgagaagaacaagaaggccatggagatcatcagcgagaagaagtacagacagcaccccgacaccctgaagtacagcaccctgatggacagcatgaacatggtgctggcccagaacaacgccaagatcatgaacgagcacctgtacaagcaggcctgggaggccgacaagaccaaggtgcacatcatgcccgacatcccccagatcatcctggccaaggccaacgccatcaacatgagcgacaagctgtacaagctgagcctggaggagagcaagaagaagggctacgacctgagacccgacgccatccccatcaaggccgccaaggccagcagagacatcgccagcgactacaagtacaagtacaactacgagaagggcaagggcaagatggtgggcttcagaagcctggaggacgaccccaagctggtgcacagcatgcaggtggccaagatgcagagcgacagagagtacaagaagaactacgagaacaccaagaccagctaccacacccccgccgacatgctgagcgtgaccgccgccaaggacgcccaggccaacatcaccaacaccaactacaagcacctgatccacaagtacatcctgctgcccgacgccatgaacatcgagctgaccagaaacatgaacagaatccagagcgacaacgagtacaagcaggactacaacgagtggtacaagggcctgggctggagccccgccggcagcctggaggtggagaaggccaagaaggccaccgagtacgccagcgaccagaagtacagacagcaccccagcaacttccagttcaagaagctgaccgacagcatggacatggtgctggccaagcagaacgcccacaccatgaacaagcacctgtacaccatcgactggaacaaggacaagaccaagatccacgtgatgcccgacacccccgacatcctgcaggccaagcagaaccagaccctgtacagccagaagctgtacaagctgggctgggaggaggccctgaagaagggctacgacctgcccgtggacgccatcagcgtgcagctggccaaggccagcagagacatcgccagcgactacaagtacaagcagggctacagaaagcagctgggccaccacgtgggcttcagaagcctgcaggacgaccccaagctggtgctgagcatgaacgtggccaagatgcagagcgagagagagtacaagaaggacttcgagaagtggaagaccaagttcagcagccccgtggacatgctgggcgtggtgctggccaagaagtgccaggagctggtgagcgacgtggactacaagaactacctgcaccagtggacctgcctgcccgaccagaacgacgtggtgcaggccaagaaggtgtacgagctgcagagcgagaacctgtacaagagcgacctggagtggctgagaggcatcggctggagccccctgggcagcctggaggccgagaagaacaagagagccagcgagatcatcagcgagaagaagtacagacagccccccgacagaaacaagttcaccagcatccccgacgccatggacatcgtgctggccaagaccaacgccaagaacagaagcgacagactgtacagagaggcctgggacaaggacaagacccagatccacatcatgcccgacacccccgacatcgtgctggccaaggccaacctgatcaacaccagcgacaagctgtacagaatgggctacgaggagctgaagagaaagggctacgacctgcccgtggacgccatccccatcaaggccgccaaggccagcagagagatcgccagcgagtacaagtacaaggagggcttcagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacctgtacaagagcgacctgcagtggctgaagggcatcggctggatgaccagcggcagcctggaggacgagaagaacaagagagccacccagatcctgagcgaccacgtgtacagacagcaccccgaccagttcaagttcagcagcctgatggacagcatccccatggtgctggccaagaacaacgccatcaccatgaaccacagactgtacaccgaggcctgggacaaggacaagaccaccgtgcacatcatgcccgacacccccgaggtgctgctggccaagcagaacaaggtgaactacagcgagaagctgtacaagctgggcctggaggaggccaagagaaagggctacgacatgagagtggacgccatccccatcaaggccgccaaggccagcagagacatcgccagcgagttcaagtacaaggagggctacagaaagcagctgggccaccacatcggcgccagagccatcagagacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacatgtacaagagcgacctgcagtggatgagaggcatcggctgggtgagcatcggcagcctggacgtggagaagtgcaagagagccaccgagatcctgagcgacaagatctacagacagccccccgacagattcaagttcaccagcgtgaccgacagcctggagcaggtgctggccaagaacaacgccatcaccatgaacaagagactgtacaccgaggcctgggacaaggacaagacccagatccacatcatgcccgacacccccgagatcatgctggccagacagaacaagatcaactacagcgagaccctgtacaagctggccaacgaggaggccaagaagaagggctacgacctgagaagcgacgccatccccatcgtggccgccaaggccagcagagacgtgatcagcgactacaagtacaaggacggctacagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagaacgacgtgatccacgccagacaggcctacgacctgcagagcgacaacatctacaagagcgacctgcagtggctgagaggcatcggctgggtgcccatcggcagcatggacgtggtgaagtgcaagagagccgccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccaggtgcacatcatgcccgacacccccgagatcatgctggccagacagaacaagatcaactacagcgagagcctgtacagacaggccatggaggaggccaagaaggagggctacgacctgagaagcgacgccatccccatcgtggccgccaaggccagcagagacatcgccagcgactacaagtacaaggaggcctacagaaagcagctgggccaccacatcggcgccagagccgtgcacgacgaccccaagatcatgtggagcctgcacatcgccaaggtgcagagcgacagagagtacaagaaggacttcgagaagtacaagaccagatacagcagccccgtggacatgctgggcatcgtgctggccaagaagtgccagaccctggtgagcgacgtggactacaagcaccccctgcacgagtggatctgcctgcccgaccagaacgacatcatccacgccagaaaggcctacgacctgcagagcgacaacctgtacaagagcgacctggagtggatgaagggcatcggctgggtgcccatcgacagcctggaggtggtgagagccaagagagccggcgagctgctgagcgacaccatctacagacagagacccgagaccctgaagttcaccagcatcaccgacacccccgagcaggtgctggccaagaacaacgccctgaacatgaacaagagactgtacaccgaggcctgggacaacgacaagaagaccatccacgtgatgcccgacacccccgagatcatgctggccaagctgaacagaatcaactacagcgacaagctgtacaagctggccctggaggagagcaagaaggagggctacgacctgagactggacgccatccccatccaggccgccaaggccagcagagacatcgccagcgactacaagtacaaggagggctacagaaagcagctgggccaccacatcggcgccagaaacatcaaggacgaccccaagatgatgtggagcatccacgtggccaagatccagagcgacagagagtacaagaaggagttcgagaagtggaagaccaagttcagcagccccgtggacatgctgggcgtggtgctggccaagaagtgccagatcctggtgagcgacatcgactacaagcaccccctgcacgagtggacctgcctgcccgaccagaacgacgtgatccaggccagaaaggcctacgacctgcagagcgacgccatctacaagagcgacctggagtggctgagaggcatcggctgggtgcccatcggcagcgtggaggtggagaaggtgaagagagccggcgagatcctgagcgacagaaagtacagacagcccgccgaccagctgaagttcacctgcatcaccgacacccccgagatcgtgctggccaagaacaacgccctgaccatgagcaagcacctgtacaccgaggcctgggacgccgacaagaccagcatccacgtgatgcccgacacccccgacatcctgctggccaagagcaacagcgccaacatcagccagaagctgtacaccaagggctgggacgagagcaagatgaaggactacgacctgagagccgacgccatcagcatcaagagcgccaaggccagcagagacatcgccagcgactacaagtacaaggaggcctacgagaagcagaagggccaccacatcggcgcccagagcatcgaggacgaccccaagatcatgtgcgccatccacgccggcaagatccagagcgagagagagtacaagaaggagttccagaagtggaagaccaagttcagcagccccgtggacatgctgagcatcctgctggccaagaagtgccagaccctggtgaccgacatcgactacagaaactacctgcacgagtggacctgcatgcccgaccagaacgacatcatccaggccaagaaggcctacgacctgcagagcgacgccctgtacaaggccgacctggagtggctgagaggcatcggctggatgccccagggcagccccgaggtgctgagagtgaagaacgcccagaacatcttctgcgacagcgtgtacagaacccccgtggtgaacctgaagtacaccagcatcgtggacacccccgaggtggtgctggccaagagcaacgccgagaacatcagcatccccaagtacagagaggtgtgggacaaggacaagaccagcatccacatcatgcccgacacccccgagatcaacctggccagagccaacgccctgaacgtgagcaacaagctgtacagagagggctgggacgagatgaaggccggctgcgacgtgagactggacgccatccccatccaggccgccaaggccagcagagagatcgccagcgactacaagtacaagctggaccacgagaagcagaagggccactacgtgggcaccctgaccgccagagacgacaacaagatcagatgggccctgatcgccgacaagctgcagaacgagagagagtacagactggactgggccaagtggaaggccaagatccagagccccgtggacatgctgagcatcctgcacagcaagaacagccaggccctggtgagcgacatggactacagaaactacctgcaccagtggacctgcatgcccgaccagaacgacgtgatccaggccaagaaggcctacgagctgcagagcgacaacgtgtacaaggccgacctggagtggctgagaggcatcggctggatgcccaacgacagcgtgagcgtgaaccacgccaagcacgccgccgacatcttcagcgagaagaagtacagaaccaagatcgagaccctgaacttcacccccgtggacgacagagtggactacgtgaccgccaagcagagcggcgagatcctggacgacatcaagtacagaaaggactggaacgccaccaagagcaagtacaccctgaccgagacccccctgctgcacaccgcccaggaggccgccagaatcctggaccagtacctgtacaaggagggctgggagagacagaaggccaccggctacatcctgccccccgacgccgtgcccttcgtgcacgcccaccactgcaacgacgtgcagagcgagctgaagtacaaggccgagcacgtgaagcagaagggccactacgtgggcgtgcccaccatgagagacgaccccaagctggtgtggttcgagcacgccggccagatccagaacgagagactgtacaaggaggactaccacaagaccaaggccaagatcaacatccccgccgacatggtgagcgtgctggccgccaagcagggccagaccctggtgagcgacatcgactacagaaactacctgcaccagtggatgtgccaccccgaccagaacgacgtgatccaggccagaaaggcctacgacctgcagagcgacaacgtgtacagagccgacctggagtggctgagaggcatcggctggatccccctggacagcgtggaccacgtgagagtgaccaagaaccaggagatgatgagccagatcaagtacaagaagaacgccctggagaactaccccaacttcagaagcgtggtggacccccccgagatcgtgctggccaagatcaacagcgtgaaccagagcgacgtgaagtacaaggagaccttcaacaaggccaagggcaagtacaccttcagccccgacaccccccacatcagccacagcaaggacatgggcaagctgtacagcaccatcctgtacaagggcgcctgggagggcaccaaggcctacggctacaccctggacgagagatacatccccatcgtgggcgccaagcacgccgacctggtgaacagcgagctgaagtacaaggagacctacgagaagcagaagggccactacctggccggcaaggtgatcggcgagttccccggcgtggtgcactgcctggacttccagaagatgagaagcgccctgaactacagaaagcactacgaggacaccaaggccaacgtgcacatccccaacgacatgatgaaccacgtgctggccaagagatgccagtacatcctgagcgacctggagtacagacactacttccaccagtggaccagcctgctggaggagcccaacgtgatcagagtgagaaacgcccaggagatcctgagcgacaacgtgtacaaggacgacctgaactggctgaagggcatcggctgctacgtgtgggacaccccccagatcctgcacgccaagaagagctacgacctgcagagccagctgcagtacaccgccgccggcaaggagaacctgcagaactacaacctggtgaccgacacccccctgtacgtgaccgccgtgcagagcggcatcaacgccagcgaggtgaagtacaaggagaactaccaccagatcaaggacaagtacaccaccgtgctggagaccgtggactacgacagaaccagaaacctgaagaacctgtacagcagcaacctgtacaaggaggcctgggacagagtgaaggccaccagctacatcctgcccagcagcaccctgagcctgacccacgccaagaaccagaagcacctggccagccacatcaagtacagagaggagtacgagaagttcaaggccctgtacaccctgcccagaagcgtggacgacgaccccaacaccgccagatgcctgagagtgggcaagctgaacatcgacagactgtacagaagcgtgtacgagaagaacaagatgaagatccacatcgtgcccgacatggtggagatggtgaccgccaaggacagccagaagaaggtgagcgagatcgactacagactgagactgcacgagtggatctgccaccccgacctgcaggtgaacgaccacgtgagaaaggtgaccgaccagatcagcgacatcgtgtacaaggacgacctgaactggctgaagggcatcggctgctacgtgtgggacacccccgagatcctgcacgccaagcacgcctacgacctgagagacgacatcaagtacaaggcccacatgctgaagaccagaaacgactacaagctggtgaccgacacccccgtgtacgtgcaggccgtgaagagcggcaagcagctgagcgacgccgtgtaccactacgactacgtgcacagcgtgagaggcaaggtggcccccaccaccaagaccgtggacctggacagagccctgcacgcctacaagctgcagagcagcaacctgtacaagaccagcctgagaaccctgcccaccggctacagactgcccggcgacaccccccacttcaagcacatcaaggacaccagatacatgagcagctacttcaagtacaaggaggcctacgagcacaccaaggcctacggctacaccctgggccccaaggacgtgcccttcgtgcacgtgagaagagtgaacaacgtgaccagcgagagactgtacagagagctgtaccacaagctgaaggacaagatccacaccacccccgacacccccgagatcagacaggtgaagaagacccaggaggccgtgagcgagctgatctacaagagcgacttcttcaagatgcagggccacatgatcagcctgccctacaccccccaggtgatccactgcagatacgtgggcgacatcaccagcgacatcaagtacaaggaggacctgcaggtgctgaagggcttcggctgcttcctgtacgacacccccgacatggtgagaagcagacacctgagaaagctgtggagcaactacctgtacaccgacaaggccagaaagatgagagacaagtacaaggtggtgctggacacccccgagtacagaaaggtgcaggagctgaagacccacctgagcgagctggtgtacagagccgccggcaagaagcagaagagcatcttcaccagcgtgcccgacacccccgacctgctgagagccaagagaggccagaagctgcagagccagtacctgtacgtggagctggccaccaaggagagaccccaccaccacgccggcaaccagaccaccgccctgaagcacgccaaggacgtgaaggacatggtgagcgagaagaagtacaagatccagtacgagaagatgaaggacaagtacacccccgtgcccgacacccccatcctgatcagagccaagagagcctactggaacgccagcgacctgagatacaaggagaccttccagaagaccaagggcaagtaccacaccgtgaaggacgccctggacatcgtgtaccacagaaaggtgaccgacgacatcagcaagatcaagtacaaggagaactacatgagccagctgggcatctggagaagcatccccgacagacccgagcacttccaccacagagccgtgaccgacaccgtgagcgacgtgaagtacaaggaggacctgacctggctgaagggcatcggctgctacgcctacgacacccccgacttcaccctggccgagaagaacaagaccctgtacagcaagtacaagtacaaggaggtgttcgagagaaccaagagcgacttcaagtacgtggccgacagccccatcaacagacacttcaagtacgccacccagctgatgaacgagaagaagtacagagccgactacgagcagagaaaggacaagtaccacctggtggtggacgagcccagacacctgctggccaagaccgccggcgaccagatcagccagatcaagtacagaaagaactacgagaagagcaaggacaagttcaccagcatcgtggacacccccgagcacctgagaaccaccaaggtgaacaagcagatcagcgacatcctgtacaagctggagtacaacaaggccaagcccagaggctacaccaccatccacgacacccccatgctgctgcacgtgagaaaggtgaaggacgaggtgagcgacctgaagtacaaggaggtgtaccagagaaacaagagcaactgcaccatcgagcccgacgccgtgcacatcaaggccgccaaggacgcctacaaggtgaacaccaacctggactacaagaagcagtacgaggccaacaaggcccactggaagtggacccccgacagacccgacttcctgcaggccgccaagagcagcctgcagcagagcgacttcgagtacaagctggacagagagttcctgaagggctgcaagctgagcgtgaccgacgacaagaacaccgtgctggccctgagaaacaccctgatcgagagcgacctgaagtacaaggagaagcacgtgaaggagagaggcacctgccacgccgtgcccgacaccccccagatcctgctggccaagaccgtgagcaacctggtgagcgagaacaagtacaaggaccacgtgaagaagcacctggcccagggcagctacaccaccctgcccgagaccagagacaccgtgcacgtgaaggaggtgaccaagcacgtgagcgacaccaactacaagaagaagttcgtgaaggagaagggcaagagcaactacagcatcatgctggagccccccgaggtgaagcacgccatggaggtggccaagaagcagagcgacgtggcctacagaaaggacgccaaggagaacctgcactacaccaccgtggccgacagacccgacatcaagaaggccacccaggccgccaagcaggccagcgaggtggagtacagagccaagcacagaaaggagggcagccacggcctgagcatgctgggcagacccgacatcgagatggccaagaaggccgccaagctgagcagccaggtgaagtacagagagaacttcgacaaggagaagggcaagacccccaagtacaaccccaaggacagccagctgtacaaggtgatgaaggacgccaacaacctggccagcgaggtgaagtacaaggccgacctgaagaagctgcacaagcccgtgaccgacatgaaggagagcctgatcatgaaccacgtgctgaacaccagccagctggccagcagctaccagtacaagaagaagtacgagaagagcaagggccactaccacaccatccccgacaacctggagcagctgcacctgaaggaggccaccgagctgcagagcatcgtgaagtacaaggagaagtacgagaaggagagaggcaagcccatgctggacttcgagacccccacctacatcaccgccaaggagagccagcagatgcagagcggcaaggagtacagaaaggactacgaggagagcatcaagggcagaaacctgaccggcctggaggtgacccccgccctgctgcacgtgaagtacgccaccaagatcgccagcgagaaggagtacagaaaggacctggaggagagcatcagaggcaagggcctgaccgagatggaggacacccccgacatgctgagagccaagaacgccacccagatcctgaacgagaaggagtacaagagagacctggagctggaggtgaagggcagaggcctgaacgccatggccaacgagacccccgacttcatgagagccagaaacgccaccgacatcgccagccagatcaagtacaagcagagcgccgagatggagaaggccaacttcaccagcgtggtggacacccccgagatcatccacgcccagcaggtgaagaacctgagcagccagaagaagtacaaggaggacgccgagaagagcatgagctactacgagaccgtgctggacacccccgagatccagagagtgagagagaaccagaagaacttcagcctgctgcagtaccagtgcgacctgaagaacagcaagggcaagatcaccgtggtgcaggacacccccgagatcctgagagtgaaggagaaccagaagaacttcagcagcgtgctgtacaaggaggacgtgagccccggcaccgccatcggcaagacccccgagatgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacctgggcaagggcatccccacccccatcacccccgagatggagagagtgaagagaaaccaggagaacttcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacctgggcaaggccacccccacccccttcacccccgagatggagagagtgaagagaaaccaggagaacttcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90527 - DNA, 1503 bp, Artificial Sequence
  Description of Artificial Sequence: Synthetic coding sequence
atggagagagtgaagagaaaccaggagaacttcagcagcgtgctgtacaaggagaacctgggcaccggcatccccatccccatcacccccgagatgcagagagtgaagcacaaccaggagaacctgagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacctgggcaaggccacccccacccccttcacccccgagatggagagagtgaagagaaaccaggagaacttcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90528 - DNA, 7878 bp, Artificial Sequence
  Description of Artificial Sequence: Synthetic coding sequence
atgcccgacacccccgagatcaacctggccagagccaacgccctgaacgtgagcaacaagctgtacagagagggctgggacgagatgaaggccggctgcgacgtgagactggacgccatccccatccaggccgccaaggccagcagagagatcgccagcgactacaagtacaagctggaccacgagaagcagaagggccactacgtgggcaccctgaccgccagagacgacaacaagatcagatgggccctgatcgccgacaagctgcagaacgagagagagtacagactggactgggccaagtggaaggccaagatccagagccccgtggacatgctgagcatcctgcacagcaagaacagccaggccctggtgagcgacatggactacagaaactacctgcaccagtggacctgcatgcccgaccagaacgacgtgatccaggccaagaaggcctacgagctgcagagcgacaacgtgtacaaggccgacctggagtggctgagaggcatcggctggatgcccaacgacagcgtgagcgtgaaccacgccaagcacgccgccgacatcttcagcgagaagaagtacagaaccaagatcgagaccctgaacttcacccccgtggacgacagagtggactacgtgaccgccaagcagagcggcgagatcctggacgacatcaagtacagaaaggactggaacgccaccaagagcaagtacaccctgaccgagacccccctgctgcacaccgcccaggaggccgccagaatcctggaccagtacctgtacaaggagggctgggagagacagaaggccaccggctacatcctgccccccgacgccgtgcccttcgtgcacgcccaccactgcaacgacgtgcagagcgagctgaagtacaaggccgagcacgtgaagcagaagggccactacgtgggcgtgcccaccatgagagacgaccccaagctggtgtggttcgagcacgccggccagatccagaacgagagactgtacaaggaggactaccacaagaccaaggccaagatcaacatccccgccgacatggtgagcgtgctggccgccaagcagggccagaccctggtgagcgacatcgactacagaaactacctgcaccagtggatgtgccaccccgaccagaacgacgtgatccaggccagaaaggcctacgacctgcagagcgacaacgtgtacagagccgacctggagtggctgagaggcatcggctggatccccctggacagcgtggaccacgtgagagtgaccaagaaccaggagatgatgagccagatcaagtacaagaagaacgccctggagaactaccccaacttcagaagcgtggtggacccccccgagatcgtgctggccaagatcaacagcgtgaaccagagcgacgtgaagtacaaggagaccttcaacaaggccaagggcaagtacaccttcagccccgacaccccccacatcagccacagcaaggacatgggcaagctgtacagcaccatcctgtacaagggcgcctgggagggcaccaaggcctacggctacaccctggacgagagatacatccccatcgtgggcgccaagcacgccgacctggtgaacagcgagctgaagtacaaggagacctacgagaagcagaagggccactacctggccggcaaggtgatcggcgagttccccggcgtggtgcactgcctggacttccagaagatgagaagcgccctgaactacagaaagcactacgaggacaccaaggccaacgtgcacatccccaacgacatgatgaaccacgtgctggccaagagatgccagtacatcctgagcgacctggagtacagacactacttccaccagtggaccagcctgctggaggagcccaacgtgatcagagtgagaaacgcccaggagatcctgagcgacaacgtgtacaaggacgacctgaactggctgaagggcatcggctgctacgtgtgggacaccccccagatcctgcacgccaagaagagctacgacctgcagagccagctgcagtacaccgccgccggcaaggagaacctgcagaactacaacctggtgaccgacacccccctgtacgtgaccgccgtgcagagcggcatcaacgccagcgaggtgaagtacaaggagaactaccaccagatcaaggacaagtacaccaccgtgctggagaccgtggactacgacagaaccagaaacctgaagaacctgtacagcagcaacctgtacaaggaggcctgggacagagtgaaggccaccagctacatcctgcccagcagcaccctgagcctgacccacgccaagaaccagaagcacctggccagccacatcaagtacagagaggagtacgagaagttcaaggccctgtacaccctgcccagaagcgtggacgacgaccccaacaccgccagatgcctgagagtgggcaagctgaacatcgacagactgtacagaagcgtgtacgagaagaacaagatgaagatccacatcgtgcccgacatggtggagatggtgaccgccaaggacagccagaagaaggtgagcgagatcgactacagactgagactgcacgagtggatctgccaccccgacctgcaggtgaacgaccacgtgagaaaggtgaccgaccagatcagcgacatcgtgtacaaggacgacctgaactggctgaagggcatcggctgctacgtgtgggacacccccgagatcctgcacgccaagcacgcctacgacctgagagacgacatcaagtacaaggcccacatgctgaagaccagaaacgactacaagctggtgaccgacacccccgtgtacgtgcaggccgtgaagagcggcaagcagctgagcgacgccgtgtaccactacgactacgtgcacagcgtgagaggcaaggtggcccccaccaccaagaccgtggacctggacagagccctgcacgcctacaagctgcagagcagcaacctgtacaagaccagcctgagaaccctgcccaccggctacagactgcccggcgacaccccccacttcaagcacatcaaggacaccagatacatgagcagctacttcaagtacaaggaggcctacgagcacaccaaggcctacggctacaccctgggccccaaggacgtgcccttcgtgcacgtgagaagagtgaacaacgtgaccagcgagagactgtacagagagctgtaccacaagctgaaggacaagatccacaccacccccgacacccccgagatcagacaggtgaagaagacccaggaggccgtgagcgagctgatctacaagagcgacttcttcaagatgcagggccacatgatcagcctgccctacaccccccaggtgatccactgcagatacgtgggcgacatcaccagcgacatcaagtacaaggaggacctgcaggtgctgaagggcttcggctgcttcctgtacgacacccccgacatggtgagaagcagacacctgagaaagctgtggagcaactacctgtacaccgacaaggccagaaagatgagagacaagtacaaggtggtgctggacacccccgagtacagaaaggtgcaggagctgaagacccacctgagcgagctggtgtacagagccgccggcaagaagcagaagagcatcttcaccagcgtgcccgacacccccgacctgctgagagccaagagaggccagaagctgcagagccagtacctgtacgtggagctggccaccaaggagagaccccaccaccacgccggcaaccagaccaccgccctgaagcacgccaaggacgtgaaggacatggtgagcgagaagaagtacaagatccagtacgagaagatgaaggacaagtacacccccgtgcccgacacccccatcctgatcagagccaagagagcctactggaacgccagcgacctgagatacaaggagaccttccagaagaccaagggcaagtaccacaccgtgaaggacgccctggacatcgtgtaccacagaaaggtgaccgacgacatcagcaagatcaagtacaaggagaactacatgagccagctgggcatctggagaagcatccccgacagacccgagcacttccaccacagagccgtgaccgacaccgtgagcgacgtgaagtacaaggaggacctgacctggctgaagggcatcggctgctacgcctacgacacccccgacttcaccctggccgagaagaacaagaccctgtacagcaagtacaagtacaaggaggtgttcgagagaaccaagagcgacttcaagtacgtggccgacagccccatcaacagacacttcaagtacgccacccagctgatgaacgagaagaagtacagagccgactacgagcagagaaaggacaagtaccacctggtggtggacgagcccagacacctgctggccaagaccgccggcgaccagatcagccagatcaagtacagaaagaactacgagaagagcaaggacaagttcaccagcatcgtggacacccccgagcacctgagaaccaccaaggtgaacaagcagatcagcgacatcctgtacaagctggagtacaacaaggccaagcccagaggctacaccaccatccacgacacccccatgctgctgcacgtgagaaaggtgaaggacgaggtgagcgacctgaagtacaaggaggtgtaccagagaaacaagagcaactgcaccatcgagcccgacgccgtgcacatcaaggccgccaaggacgcctacaaggtgaacaccaacctggactacaagaagcagtacgaggccaacaaggcccactggaagtggacccccgacagacccgacttcctgcaggccgccaagagcagcctgcagcagagcgacttcgagtacaagctggacagagagttcctgaagggctgcaagctgagcgtgaccgacgacaagaacaccgtgctggccctgagaaacaccctgatcgagagcgacctgaagtacaaggagaagcacgtgaaggagagaggcacctgccacgccgtgcccgacaccccccagatcctgctggccaagaccgtgagcaacctggtgagcgagaacaagtacaaggaccacgtgaagaagcacctggcccagggcagctacaccaccctgcccgagaccagagacaccgtgcacgtgaaggaggtgaccaagcacgtgagcgacaccaactacaagaagaagttcgtgaaggagaagggcaagagcaactacagcatcatgctggagccccccgaggtgaagcacgccatggaggtggccaagaagcagagcgacgtggcctacagaaaggacgccaaggagaacctgcactacaccaccgtggccgacagacccgacatcaagaaggccacccaggccgccaagcaggccagcgaggtggagtacagagccaagcacagaaaggagggcagccacggcctgagcatgctgggcagacccgacatcgagatggccaagaaggccgccaagctgagcagccaggtgaagtacagagagaacttcgacaaggagaagggcaagacccccaagtacaaccccaaggacagccagctgtacaaggtgatgaaggacgccaacaacctggccagcgaggtgaagtacaaggccgacctgaagaagctgcacaagcccgtgaccgacatgaaggagagcctgatcatgaaccacgtgctgaacaccagccagctggccagcagctaccagtacaagaagaagtacgagaagagcaagggccactaccacaccatccccgacaacctggagcagctgcacctgaaggaggccaccgagctgcagagcatcgtgaagtacaaggagaagtacgagaaggagagaggcaagcccatgctggacttcgagacccccacctacatcaccgccaaggagagccagcagatgcagagcggcaaggagtacagaaaggactacgaggagagcatcaagggcagaaacctgaccggcctggaggtgacccccgccctgctgcacgtgaagtacgccaccaagatcgccagcgagaaggagtacagaaaggacctggaggagagcatcagaggcaagggcctgaccgagatggaggacacccccgacatgctgagagccaagaacgccacccagatcctgaacgagaaggagtacaagagagacctggagctggaggtgaagggcagaggcctgaacgccatggccaacgagacccccgacttcatgagagccagaaacgccaccgacatcgccagccagatcaagtacaagcagagcgccgagatggagaaggccaacttcaccagcgtggtggacacccccgagatcatccacgcccagcaggtgaagaacctgagcagccagaagaagtacaaggaggacgccgagaagagcatgagctactacgagaccgtgctggacacccccgagatccagagagtgagagagaaccagaagaacttcagcctgctgcagtaccagtgcgacctgaagaacagcaagggcaagatcaccgtggtgcaggacacccccgagatcctgagagtgaaggagaaccagaagaacttcagcagcgtgctgtacaaggaggacgtgagccccggcaccgccatcggcaagacccccgagatgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacatgggcaagggcacccccctgcccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90529 - DNA, 25578 bp, Artificial Sequence
  Description of Artificial Sequence: Synthetic coding sequence
atggccgacgacgaggactacgaggaggtggtggagtactacaccgaggaggtggtgtacgaggaggtgcccggcgagaccatcaccaagatctacgagaccaccaccaccagaaccagcgactacgagcagagcgagaccagcaagcccgccctggcccagcccgccctggcccagcccgccagcgccaagcccgtggagagaagaaaggtgatcagaaagaaggtggaccccagcaagttcatgaccccctacatcgcccacagccagaagatgcaggacctgttcagccccaacaagtacaaggagaagttcgagaagaccaagggccagccctacgccagcaccaccgacacccccgagctgagaagaatcaagaaggtgcaggaccagctgagcgaggtgaagtacagaatggacggcgacgtggccaagaccatctgccacgtggacgagaaggccaaggacatcgagcacgccaagaaggtgagccagcaggtgagcaaggtgctgtacaagcagaactgggaggacaccaaggacaagtacctgctgccccccgacgcccccgagctggtgcaggccgtgaagaacaccgccatgttcagcaagaagctgtacaccgaggactgggaggccgacaagagcctgttctacccctacaacgacagccccgagctgagaagagtggcccaggcccagaaggccctgagcgacgtggcctacaagaagggcctggccgagcagcaggcccagttcacccccctggccgacccccccgacatcgagttcgccaagaaggtgaccaaccaggtgagcaagcagaagtacaaggaggactacgagaacaagatcaagggcaagtggagcgagaccccctgcttcgaggtggccaacgccagaatgaacgccgacaacatcagcaccagaaagtaccaggaggacttcgagaacatgaaggaccagatctacttcatgcagaccgagacccccgagtacaagatgaacaagaaggccggcgtggccgccagcaaggtgaagtacaaggaggactacgagaagaacaagggcaaggccgactacaacgtgctgcccgccagcgagaacccccagctgagacagctgaaggccgccggcgacgccctgagcgacaagctgtacaaggagaactacgagaagaccaaggccaagagcatcaactactgcgagacccccaagttcaagctggacaccgtgctgcagaacttcagcagcgacaagaagtacaaggacagctacctgaaggacatcctgggccactacgtgggcagcttcgaggacccctaccacagccactgcatgaaggtgaccgcccagaacagcgacaagaactacaaggccgagtacgaggaggacagaggcaagggcttcttcccccagaccatcacccaggagtacgaggccatcaagaagctggaccagtgcaaggaccacacctacaaggtgcaccccgacaagaccaagttcacccaggtgaccgacagccccgtgctgctgcaggcccaggtgaacagcaagcagctgagcgacctgaactacaaggccaagcacgagagcgagaagttcaagtgccacatcccccccgacacccccgccttcatccagcacaaggtgaacgcctacaacctgagcgacaacctgtacaagcaggactgggagaagagcaaggccaagaagttcgacatcaaggtggacgccatccccctgctggccgccaaggccaacaccaagaacaccagcgacgtgatgtacaagaaggactacgagaagaacaagggcaagatgatcggcgtgctgagcatcaacgacgaccccaagatgctgcacagcctgaaggtggccaagaaccagagcgacagactgtacaaggagaactacgagaagaccaaggccaagagcatgaactactgcgagacccccaagtaccagctggacacccagctgaagaacttcagcgaggccagatacaaggacctgtacgtgaaggacgtgctgggccactacgtgggcagcatggaggacccctaccacacccactgcatgaaggtggccgcccagaacagcgacaagagctacaaggccgagtacgaggaggacaagggcaagtgctacttcccccagaccatcacccaggagtacgaggccatcaagaagctggaccagtgcaaggaccacacctacaaggtgcaccccgacaagaccaagttcaccgccgtgaccgacagccccgtgctgctgcaggcccagctgaacaccaagcagctgagcgacctgaactacaaggccaagcacgagggcgagaagttcaagtgccacatccccgccgacgccccccagttcatccagcacagagtgaacgcctacaacctgagcgacaacgtgtacaagcaggactgggagaagagcaaggccaagaagttcgacatcaaggtggacgccatccccctgctggccgccaaggccaacaccaagaacaccagcgacgtgatgtacaagaaggactacgagaagagcaagggcaagatgatcggcgccctgagcatcaacgacgaccccaagatgctgcacagcctgaagaccgccaagaaccagagcgacagagagtacagaaaggactacgagaagagcaagaccatctacaccgcccccctggacatgctgcaggtgacccaggccaagaagagccaggccatcgccagcgacgtggactacaagcacatcctgcacagctacagctacccccccgacagcatcaacgtggacctggccaagaaggcctacgccctgcagagcgacgtggagtacaaggccgactacaacagctggatgaagggctgcggctgggtgcccttcggcagcctggagatggagaaggccaagagagccagcgacatcctgaacgagaagaagtacagacagcaccccgacaccctgaagttcaccagcatcgaggacgcccccatcaccgtgcagagcaagatcaaccaggcccagagaagcgacatcgcctacaaggccaagggcgaggagatcatccacaagtacaacctgccccccgacctgccccagttcatccaggccaaggtgaacgcctacaacatcagcgagaacatgtacaaggccgacctgaaggacctgagcaagaagggctacgacctgagaaccgacgccatccccatcagagccgccaaggccgccagacaggccgccagcgacgtgcagtacaagaaggactacgagaaggccaagggcaagatggtgggcttccagagcctgcaggacgaccccaagctggtgcactacatgaacgtggccaagatccagagcgacagagagtacaagaaggactacgagaagaccaagagcaagtacaacaccccccacgacatgttcaacgtggtggccgccaagaaggcccaggacgtggtgagcaacgtgaactacaagcacagcctgcaccactacacctacctgcccgacgccatggacctggagctgagcaagaacatgatgcagatccagagcgacaacgtgtacaaggaggactacaacaactggatgaagggcatcggctggatccccatcggcagcctggacgtggagaaggtgaagaaggccggcgacgccctgaacgagaagaagtacagacagcaccccgacaccctgaagttcaccagcatcgtggacagccccgtgatggtgcaggccaagcagaacaccaagcaggtgagcgacatcctgtacaaggccaagggcgaggacgtgaagcacaagtacaccatgagccccgacctgccccagttcctgcaggccaagtgcaacgcctacaacatcagcgacgtgtgctacaagagagactggtacgacctgatcgccaagggcaacaacgtgctgggcgacgccatccccatcaccgccgccaaggccagcagaaacatcgccagcgactacaagtacaaggaggcctacgagaagagcaagggcaagcacgtgggcttcagaagcctgcaggacgaccccaagctggtgcactacatgaacgtggccaagctgcagagcgacagagagtacaagaagaactacgagaacaccaagaccagctaccacacccccggcgacatggtgagcatcaccgccgccaagatggcccaggacgtggccaccaacgtgaactacaagcagcccctgcaccactacacctacctgcccgacgccatgagcctggagcacaccagaaacgtgaaccagatccagagcgacaacgtgtacaaggacgagtacaacagcttcctgaagggcatcggctggatccccatcggcagcctggaggtggagaaggtgaagaaggccggcgacgccctgaacgagagaaagtacagacagcaccccgacaccgtgaagttcaccagcgtgcccgacagcatgggcatggtgctggcccagcacaacaccaagcagctgagcgacctgaactacaaggtggagggcgagaagctgaagcacaagtacaccatcgaccccgagctgccccagttcatccaggccaaggtgaacgccctgaacatgagcgacgcccactacaaggccgactggaagaagaccatcgccaagggctacgacctgagacccgacgccatccccatcgtggccgccaagagcagcagaaacatcgccagcgactgcaagtacaaggaggcctacgagaaggccaagggcaagcaggtgggcttcctgagcctgcaggacgaccccaagctggtgcactacatgaacgtggccaagatccagagcgacagagagtacaagaagggctacgaggccagcaagaccaagtaccacacccccctggacatggtgagcgtgaccgccgccaagaagagccaggaggtggccaccaacgccaactacagacagagctaccaccactacaccctgctgcccgacgccctgaacgtggagcacagcagaaacgccatgcagatccagagcgacaacctgtacaagagcgacttcaccaactggatgaagggcatcggctgggtgcccatcgagagcctggaggtggagaaggccaagaaggccggcgagatcctgagcgagaagaagtacagacagcaccccgagaagctgaagttcacctacgccatggacaccatggagcaggccctgaacaagagcaacaagctgaacatggacaagagactgtacaccgagaagtggaacaaggacaagaccaccatccacgtgatgcccgacacccccgacatcctgctgagcagagtgaaccagatcaccatgagcgacaagctgtacaaggccggctgggaggaggagaagaagaagggctacgacctgagacccgacgccatcgccatcaaggccgccagagccagcagagacatcgccagcgactacaagtacaagaaggcctacgagcaggccaagggcaagcacatcggcttcagaagcctggaggacgaccccaagctggtgcacttcatgcaggtggccaagatgcagagcgacagagagtacaagaagggctacgagaagagcaagaccagcttccacacccccgtggacatgctgagcgtggtggccgccaagaagagccaggaggtggccaccaacgccaactacagaaacgtgatccacacctacaacatgctgcccgacgccatgagcttcgagctggccaagaacatgatgcagatccagagcgacaaccagtacaaggccgactacgccgacttcatgaagggcatcggctggctgcccctgggcagcctggaggccgagaagaacaagaaggccatggagatcatcagcgagaagaagtacagacagcaccccgacaccctgaagtacagcaccctgatggacagcatgaacatggtgctggcccagaacaacgccaagatcatgaacgagcacctgtacaagcaggcctgggaggccgacaagaccaaggtgcacatcatgcccgacatcccccagatcatcctggccaaggccaacgccatcaacatgagcgacaagctgtacaagctgagcctggaggagagcaagaagaagggctacgacctgagacccgacgccatccccatcaaggccgccaaggccagcagagacatcgccagcgactacaagtacaagtacaactacgagaagggcaagggcaagatggtgggcttcagaagcctggaggacgaccccaagctggtgcacagcatgcaggtggccaagatgcagagcgacagagagtacaagaagaactacgagaacaccaagaccagctaccacacccccgccgacatgctgagcgtgaccgccgccaaggacgcccaggccaacatcaccaacaccaactacaagcacctgatccacaagtacatcctgctgcccgacgccatgaacatcgagctgaccagaaacatgaacagaatccagagcgacaacgagtacaagcaggactacaacgagtggtacaagggcctgggctggagccccgccggcagcctggaggtggagaaggccaagaaggccaccgagtacgccagcgaccagaagtacagacagcaccccagcaacttccagttcaagaagctgaccgacagcatggacatggtgctggccaagcagaacgcccacaccatgaacaagcacctgtacaccatcgactggaacaaggacaagaccaagatccacgtgatgcccgacacccccgacatcctgcaggccaagcagaaccagaccctgtacagccagaagctgtacaagctgggctgggaggaggccctgaagaagggctacgacctgcccgtggacgccatcagcgtgcagctggccaaggccagcagagacatcgccagcgactacaagtacaagcagggctacagaaagcagctgggccaccacgtgggcttcagaagcctgcaggacgaccccaagctggtgctgagcatgaacgtggccaagatgcagagcgagagagagtacaagaaggacttcgagaagtggaagaccaagttcagcagccccgtggacatgctgggcgtggtgctggccaagaagtgccaggagctggtgagcgacgtggactacaagaactacctgcaccagtggacctgcctgcccgaccagaacgacgtggtgcaggccaagaaggtgtacgagctgcagagcgagaacctgtacaagagcgacctggagtggctgagaggcatcggctggagccccctgggcagcctggaggccgagaagaacaagagagccagcgagatcatcagcgagaagaagtacagacagccccccgacagaaacaagttcaccagcatccccgacgccatggacatcgtgctggccaagaccaacgccaagaacagaagcgacagactgtacagagaggcctgggacaaggacaagacccagatccacatcatgcccgacacccccgacatcgtgctggccaaggccaacctgatcaacaccagcgacaagctgtacagaatgggctacgaggagctgaagagaaagggctacgacctgcccgtggacgccatccccatcaaggccgccaaggccagcagagagatcgccagcgagtacaagtacaaggagggcttcagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacctgtacaagagcgacctgcagtggctgaagggcatcggctggatgaccagcggcagcctggaggacgagaagaacaagagagccacccagatcctgagcgaccacgtgtacagacagcaccccgaccagttcaagttcagcagcctgatggacagcatccccatggtgctggccaagaacaacgccatcaccatgaaccacagactgtacaccgaggcctgggacaaggacaagaccaccgtgcacatcatgcccgacacccccgaggtgctgctggccaagcagaacaaggtgaactacagcgagaagctgtacaagctgggcctggaggaggccaagagaaagggctacgacatgagagtggacgccatccccatcaaggccgccaaggccagcagagacatcgccagcgagttcaagtacaaggagggctacagaaagcagctgggccaccacatcggcgccagagccatcagagacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacatgtacaagagcgacctgcagtggatgagaggcatcggctgggtgagcatcggcagcctggacgtggagaagtgcaagagagccaccgagatcctgagcgacaagatctacagacagccccccgacagattcaagttcaccagcgtgaccgacagcctggagcaggtgctggccaagaacaacgccatcaccatgaacaagagactgtacaccgaggcctgggacaaggacaagacccagatccacatcatgcccgacacccccgagatcatgctggccagaatgaacaagatcaactacagcgagagcctgtacaagctggccaacgaggaggccaagaagaagggctacgacctgagaagcgacgccatccccatcgtggccgccaaggccagcagagacatcatcagcgactacaagtacaaggacggctactgcaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagagcgacgtgatccacgccagacaggcctacgacctgcagagcgacaacatctacaagagcgacctgcagtggctgagaggcatcggctgggtgcccatcggcagcatggacgtggtgaagtgcaagagagccaccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccagatccacatcatgcccgacacccccgagatcatgctggccagacagaacaagatcaactacagcgagaccctgtacaagctggccaacgaggaggccaagaagaagggctacgacctgagaagcgacgccatccccatcgtggccgccaaggccagcagagacgtgatcagcgactacaagtacaaggacggctacagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagaacgacgtgatccacgccagacaggcctacgacctgcagagcgacaacatctacaagagcgacctgcagtggctgagaggcatcggctgggtgcccatcggcagcatggacgtggtgaagtgcaagagagccgccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccaggtgcacatcatgcccgacacccccgagatcatgctggccagacagaacaagatcaactacagcgagagcctgtacagacaggccatggaggaggccaagaaggagggctacgacctgagaagcgacgccatccccatcgtggccgccaaggccagcagagacatcgccagcgactacaagtacaaggaggcctacagaaagcagctgggccaccacatcggcgccagagccgtgcacgacgaccccaagatcatgtggagcctgcacatcgccaaggtgcagagcgacagagagtacaagaaggacttcgagaagtacaagaccagatacagcagccccgtggacatgctgggcatcgtgctggccaagaagtgccagaccctggtgagcgacgtggactacaagcaccccctgcacgagtggatctgcctgcccgaccagaacgacatcatccacgccagaaaggcctacgacctgcagagcgacaacctgtacaagagcgacctggagtggatgaagggcatcggctgggtgcccatcgacagcctggaggtggtgagagccaagagagccggcgagctgctgagcgacaccatctacagacagagacccgagaccctgaagttcaccagcatcaccgacacccccgagcaggtgctggccaagaacaacgccctgaacatgaacaagagactgtacaccgaggcctgggacaacgacaagaagaccatccacgtgatgcccgacacccccgagatcatgctggccaagctgaacagaatcaactacagcgacaagctgtacaagctggccctggaggagagcaagaaggagggctacgacctgagactggacgccatccccatccaggccgccaaggccagcagagacatcgccagcgactacaagtacaaggagggctacagaaagcagctgggccaccacatcggcgccagaaacatcaaggacgaccccaagatgatgtggagcatccacgtggccaagatccagagcgacagagagtacaagaaggagttcgagaagtggaagaccaagttcagcagccccgtggacatgctgggcgtggtgctggccaagaagtgccagatcctggtgagcgacatcgactacaagcaccccctgcacgagtggacctgcctgcccgaccagaacgacgtgatccaggccagaaaggcctacgacctgcagagcgacgccatctacaagagcgacctggagtggctgagaggcatcggctgggtgcccatcggcagcgtggaggtggagaaggtgaagagagccggcgagatcctgagcgacagaaagtacagacagcccgccgaccagctgaagttcacctgcatcaccgacacccccgagatcgtgctggccaagaacaacgccctgaccatgagcaagcacctgtacaccgaggcctgggacgccgacaagaccagcatccacgtgatgcccgacacccccgacatcctgctggccaagagcaacagcgccaacatcagccagaagctgtacaccaagggctgggacgagagcaagatgaaggactacgacctgagagccgacgccatcagcatcaagagcgccaaggccagcagagacatcgccagcgactacaagtacaaggaggcctacgagaagcagaagggccaccacatcggcgcccagagcatcgaggacgaccccaagatcatgtgcgccatccacgccggcaagatccagagcgagagagagtacaagaaggagttccagaagtggaagaccaagttcagcagccccgtggacatgctgagcatcctgctggccaagaagtgccagaccctggtgaccgacatcgactacagaaactacctgcacgagtggacctgcatgcccgaccagaacgacatcatccaggccaagaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacgccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagagacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcaccactggagctgcttccccgaccagaacgacgtgatccaggccagaaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacaccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagaaacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcaccactggagctgcttccccgaccagaacgacgtgatccaggccagaaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacaccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagagacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcacagatggagctgcttccccgaccagaacgacgtgatccaggccagaaaggcctacgacctgcagagcgacgccctgtacaaggccgacctggagtggctgagaggcatcggctggatgccccagggcagccccgaggtgctgagagtgaagaacgcccagaacatcttctgcgacagcgtgtacagaacccccgtggtgaacctgaagtacaccagcatcgtggacacccccgaggtggtgctggccaagagcaacgccgagaacatcagcatccccaagtacagagaggtgtgggacaaggacaagaccagcatccacatcatgcccgacacccccgagatcaacctggccagagccaacgccctgaacgtgagcaacaagctgtacagagagggctgggacgagatgaaggccggctgcgacgtgagactggacgccatccccatccaggccgccaaggccagcagagagatcgccagcgactacaagtacaagctggaccacgagaagcagaagggccactacgtgggcaccctgaccgccagagacgacaacaagatcagatgggccctgatcgccgacaagctgcagaacgagagagagtacagactggactgggccaagtggaaggccaagatccagagccccgtggacatgctgagcatcctgcacagcaagaacagccaggccctggtgagcgacatggactacagaaactacctgcaccagtggacctgcatgcccgaccagaacgacgtgatccaggccaagaaggcctacgagctgcagagcgacaacgtgtacaaggccgacctggagtggctgagaggcatcggctggatgcccaacgacagcgtgagcgtgaaccacgccaagcacgccgccgacatcttcagcgagaagaagtacagaaccaagatcgagaccctgaacttcacccccgtggacgacagagtggactacgtgaccgccaagcagagcggcgagatcctggacgacatcaagtacagaaaggactggaacgccaccaagagcaagtacaccctgaccgagacccccctgctgcacaccgcccaggaggccgccagaatcctggaccagtacctgtacaaggagggctgggagagacagaaggccaccggctacatcctgccccccgacgccgtgcccttcgtgcacgcccaccactgcaacgacgtgcagagcgagctgaagtacaaggccgagcacgtgaagcagaagggccactacgtgggcgtgcccaccatgagagacgaccccaagctggtgtggttcgagcacgccggccagatccagaacgagagactgtacaaggaggactaccacaagaccaaggccaagatcaacatccccgccgacatggtgagcgtgctggccgccaagcagggccagaccctggtgagcgacatcgactacagaaactacctgcaccagtggatgtgccaccccgaccagaacgacgtgatccaggccagaaaggcctacgacctgcagagcgacaacgtgtacagagccgacctggagtggctgagaggcatcggctggatccccctggacagcgtggaccacgtgagagtgaccaagaaccaggagatgatgagccagatcaagtacaagaagaacgccctggagaactaccccaacttcagaagcgtggtggacccccccgagatcgtgctggccaagatcaacagcgtgaaccagagcgacgtgaagtacaaggagaccttcaacaaggccaagggcaagtacaccttcagccccgacaccccccacatcagccacagcaaggacatgggcaagctgtacagcaccatcctgtacaagggcgcctgggagggcaccaaggcctacggctacaccctggacgagagatacatccccatcgtgggcgccaagcacgccgacctggtgaacagcgagctgaagtacaaggagacctacgagaagcagaagggccactacctggccggcaaggtgatcggcgagttccccggcgtggtgcactgcctggacttccagaagatgagaagcgccctgaactacagaaagcactacgaggacaccaaggccaacgtgcacatccccaacgacatgatgaaccacgtgctggccaagagatgccagtacatcctgagcgacctggagtacagacactacttccaccagtggaccagcctgctggaggagcccaacgtgatcagagtgagaaacgcccaggagatcctgagcgacaacgtgtacaaggacgacctgaactggctgaagggcatcggctgctacgtgtgggacaccccccagatcctgcacgccaagaagagctacgacctgcagagccagctgcagtacaccgccgccggcaaggagaacctgcagaactacaacctggtgaccgacacccccctgtacgtgaccgccgtgcagagcggcatcaacgccagcgaggtgaagtacaaggagaactaccaccagatcaaggacaagtacaccaccgtgctggagaccgtggactacgacagaaccagaaacctgaagaacctgtacagcagcaacctgtacaaggaggcctgggacagagtgaaggccaccagctacatcctgcccagcagcaccctgagcctgacccacgccaagaaccagaagcacctggccagccacatcaagtacagagaggagtacgagaagttcaaggccctgtacaccctgcccagaagcgtggacgacgaccccaacaccgccagatgcctgagagtgggcaagctgaacatcgacagactgtacagaagcgtgtacgagaagaacaagatgaagatccacatcgtgcccgacatggtggagatggtgaccgccaaggacagccagaagaaggtgagcgagatcgactacagactgagactgcacgagtggatctgccaccccgacctgcaggtgaacgaccacgtgagaaaggtgaccgaccagatcagcgacatcgtgtacaaggacgacctgaactggctgaagggcatcggctgctacgtgtgggacacccccgagatcctgcacgccaagcacgcctacgacctgagagacgacatcaagtacaaggcccacatgctgaagaccagaaacgactacaagctggtgaccgacacccccgtgtacgtgcaggccgtgaagagcggcaagcagctgagcgacgccgtgtaccactacgactacgtgcacagcgtgagaggcaaggtggcccccaccaccaagaccgtggacctggacagagccctgcacgcctacaagctgcagagcagcaacctgtacaagaccagcctgagaaccctgcccaccggctacagactgcccggcgacaccccccacttcaagcacatcaaggacaccagatacatgagcagctacttcaagtacaaggaggcctacgagcacaccaaggcctacggctacaccctgggccccaaggacgtgcccttcgtgcacgtgagaagagtgaacaacgtgaccagcgagagactgtacagagagctgtaccacaagctgaaggacaagatccacaccacccccgacacccccgagatcagacaggtgaagaagacccaggaggccgtgagcgagctgatctacaagagcgacttcttcaagatgcagggccacatgatcagcctgccctacaccccccaggtgatccactgcagatacgtgggcgacatcaccagcgacatcaagtacaaggaggacctgcaggtgctgaagggcttcggctgcttcctgtacgacacccccgacatggtgagaagcagacacctgagaaagctgtggagcaactacctgtacaccgacaaggccagaaagatgagagacaagtacaaggtggtgctggacacccccgagtacagaaaggtgcaggagctgaagacccacctgagcgagctggtgtacagagccgccggcaagaagcagaagagcatcttcaccagcgtgcccgacacccccgacctgctgagagccaagagaggccagaagctgcagagccagtacctgtacgtggagctggccaccaaggagagaccccaccaccacgccggcaaccagaccaccgccctgaagcacgccaaggacgtgaaggacatggtgagcgagaagaagtacaagatccagtacgagaagatgaaggacaagtacacccccgtgcccgacacccccatcctgatcagagccaagagagcctactggaacgccagcgacctgagatacaaggagaccttccagaagaccaagggcaagtaccacaccgtgaaggacgccctggacatcgtgtaccacagaaaggtgaccgacgacatcagcaagatcaagtacaaggagaactacatgagccagctgggcatctggagaagcatccccgacagacccgagcacttccaccacagagccgtgaccgacaccgtgagcgacgtgaagtacaaggaggacctgacctggctgaagggcatcggctgctacgcctacgacacccccgacttcaccctggccgagaagaacaagaccctgtacagcaagtacaagtacaaggaggtgttcgagagaaccaagagcgacttcaagtacgtggccgacagccccatcaacagacacttcaagtacgccacccagctgatgaacgagagaaagtacaagagcagcgccaagatgttcctgcagcacggctgcaacgagatcctgagacccgacatgctgaccgccctgtacaacagccacatgtggagccagatcaagtacagaaagaactacgagaagagcaaggacaagttcaccagcatcgtggacacccccgagcacctgagaaccaccaaggtgaacaagcagatcagcgacatcctgtacaagctggagtacaacaaggccaagcccagaggctacaccaccatccacgacacccccatgctgctgcacgtgagaaaggtgaaggacgaggtgagcgacctgaagtacaaggaggtgtaccagagaaacaagagcaactgcaccatcgagcccgacgccgtgcacatcaaggccgccaaggacgcctacaaggtgaacaccaacctggactacaagaagcagtacgaggccaacaaggcccactggaagtggacccccgacagacccgacttcctgcaggccgccaagagcagcctgcagcagagcgacttcgagtacaagctggacagagagttcctgaagggctgcaagctgagcgtgaccgacgacaagaacaccgtgctggccctgagaaacaccctgatcgagagcgacctgaagtacaaggagaagcacgtgaaggagagaggcacctgccacgccgtgcccgacaccccccagatcctgctggccaagaccgtgagcaacctggtgagcgagaacaagtacaaggaccacgtgaagaagcacctggcccagggcagctacaccaccctgcccgagaccagagacaccgtgcacgtgaaggaggtgaccaagcacgtgagcgacaccaactacaagaagaagttcgtgaaggagaagggcaagagcaactacagcatcatgctggagccccccgaggtgaagcacgccatggaggtggccaagaagcagagcgacgtggcctacagaaaggacgccaaggagaacctgcactacaccaccgtggccgacagacccgacatcaagaaggccacccaggccgccaagcaggccagcgaggtggagtacagagccaagcacagaaaggagggcagccacggcctgagcatgctgggcagacccgacatcgagatggccaagaaggccgccaagctgagcagccaggtgaagtacagagagaacttcgacaaggagaagggcaagacccccaagtacaaccccaaggacagccagctgtacaaggtgatgaaggacgccaacaacctggccagcgaggtgaagtacaaggccgacctgaagaagctgcacaagcccgtgaccgacatgaaggagagcctgatcatgaaccacgtgctgaacaccagccagctggccagcagctaccagtacaagaagaagtacgagaagagcaagggccactaccacaccatccccgacaacctggagcagctgcacctgaaggaggccaccgagctgcagagcatcgtgaagtacaaggagaagtacgagaaggagagaggcaagcccatgctggacttcgagacccccacctacatcaccgccaaggagagccagcagatgcagagcggcaaggagtacagaaaggactacgaggagagcatcaagggcagaaacctgaccggcctggaggtgacccccgccctgctgcacgtgaagtacgccaccaagatcgccagcgagaaggagtacagaaaggacctggaggagagcatcagaggcaagggcctgaccgagatggaggacacccccgacatgctgagagccaagaacgccacccagatcctgaacgagaaggagtacaagagagacctggagctggaggtgaagggcagaggcctgaacgccatggccaacgagacccccgacttcatgagagccagaaacgccaccgacatcgccagccagatcaagtacaagcagagcgccgagatggagaaggccaacttcaccagcgtggtggacacccccgagatcatccacgcccagcaggtgaagaacctgagcagccagaagaagtacaaggaggacgccgagaagagcatgagctactacgagaccgtgctggacacccccgagatccagagagtgagagagaaccagaagaacttcagcctgctgcagtaccagtgcgacctgaagaacagcaagggcaagatcaccgtggtgcaggacacccccgagatcctgagagtgaaggagaaccagaagaacttcagcagcgtgctgtacaaggaggacgtgagccccggcaccgccatcggcaagacccccgagatgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacctgggcaagggcatccccacccccatcacccccgagatggagagagtgaagagaaaccaggagaacttcagcagcatcctgtacaaggagaacctgagcaagggcacccccctgcccgtgacccccgagatggagagagtgaagctgaaccaggagaacttcagcagcgtgctgtacaaggagaacgtgggcaagggcatccccatccccatcacccccgagatggagagagtgaagcacaaccaggagaacttcagcagcgtgctgtacaaggagaacctgggcaccggcatccccatccccatcacccccgagatgcagagagtgaagcacaaccaggagaacctgagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacctgggcaaggccacccccacccccttcacccccgagatggagagagtgaagagaaaccaggagaacttcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90530 - DNA, 20010 bp, Artificial Sequence
  Description of Artificial Sequence: Synthetic coding sequence
atggccgacgacgaggactacgaggaggtggtggagtactacaccgaggaggtggtgtacgaggaggtgcccggcgagaccatcaccaagatctacgagaccaccaccaccagaaccagcgactacgagcagagcgagaccagcaagcccgccctggcccagcccgccctggcccagcccgccagcgccaagcccgtggagagaagaaaggtgatcagaaagaaggtggaccccagcaagttcatgaccccctacatcgcccacagccagaagatgcaggacctgttcagccccaacaagtacaaggagaagttcgagaagaccaagggccagccctacgccagcaccaccgacacccccgagctgagaagaatcaagaaggtgcaggaccagctgagcgaggtgaagtacagaatggacggcgacgtggccaagaccatctgccacgtggacgagaaggccaaggacatcgagcacgccaagaaggtgagccagcaggtgagcaaggtgctgtacaagcagaactgggaggacaccaaggacaagtacctgctgccccccgacgcccccgagctggtgcaggccgtgaagaacaccgccatgttcagcaagaagctgtacaccgaggactgggaggccgacaagagcctgttctacccctacaacgacagccccgagctgagaagagtggcccaggcccagaaggccctgagcgacgtggcctacaagaagggcctggccgagcagcaggcccagttcacccccctggccgacccccccgacatcgagttcgccaagaaggtgaccaaccaggtgagcaagcagaagtacaaggaggactacgagaacaagatcaagggcaagtggagcgagaccccctgcttcgaggtggccaacgccagaatgaacgccgacaacatcagcaccagaaagtaccaggaggacttcgagaacatgaaggaccagatctacttcatgcagaccgagacccccgagtacaagatgaacaagaaggccggcgtggccgccagcaaggtgaagtacaaggaggactacgagaagaacaagggcaaggccgactacaacgtgctgcccgccagcgagaacccccagctgagacagctgaaggccgccggcgacgccctgagcgacaagctgtacaaggagaactacgagaagaccaaggccaagagcatcaactactgcgagacccccaagttcaagctggacaccgtgctgcagaacttcagcagcgacaagaagtacaaggacagctacctgaaggacatcctgggccactacgtgggcagcttcgaggacccctaccacagccactgcatgaaggtgaccgcccagaacagcgacaagaactacaaggccgagtacgaggaggacagaggcaagggcttcttcccccagaccatcacccaggagtacgaggccatcaagaagctggaccagtgcaaggaccacacctacaaggtgcaccccgacaagaccaagttcacccaggtgaccgacagccccgtgctgctgcaggcccaggtgaacagcaagcagctgagcgacctgaactacaaggccaagcacgagagcgagaagttcaagtgccacatcccccccgacacccccgccttcatccagcacaaggtgaacgcctacaacctgagcgacaacctgtacaagcaggactgggagaagagcaaggccaagaagttcgacatcaaggtggacgccatccccctgctggccgccaaggccaacaccaagaacaccagcgacgtgatgtacaagaaggactacgagaagaacaagggcaagatgatcggcgtgctgagcatcaacgacgaccccaagatgctgcacagcctgaaggtggccaagaaccagagcgacagactgtacaaggagaactacgagaagaccaaggccaagagcatgaactactgcgagacccccaagtaccagctggacacccagctgaagaacttcagcgaggccagatacaaggacctgtacgtgaaggacgtgctgggccactacgtgggcagcatggaggacccctaccacacccactgcatgaaggtggccgcccagaacagcgacaagagctacaaggccgagtacgaggaggacaagggcaagtgctacttcccccagaccatcacccaggagtacgaggccatcaagaagctggaccagtgcaaggaccacacctacaaggtgcaccccgacaagaccaagttcaccgccgtgaccgacagccccgtgctgctgcaggcccagctgaacaccaagcagctgagcgacctgaactacaaggccaagcacgagggcgagaagttcaagtgccacatccccgccgacgccccccagttcatccagcacagagtgaacgcctacaacctgagcgacaacgtgtacaagcaggactgggagaagagcaaggccaagaagttcgacatcaaggtggacgccatccccctgctggccgccaaggccaacaccaagaacaccagcgacgtgatgtacaagaaggactacgagaagagcaagggcaagatgatcggcgccctgagcatcaacgacgaccccaagatgctgcacagcctgaagaccgccaagaaccagagcgacagagagtacagaaaggactacgagaagagcaagaccatctacaccgcccccctggacatgctgcaggtgacccaggccaagaagagccaggccatcgccagcgacgtggactacaagcacatcctgcacagctacagctacccccccgacagcatcaacgtggacctggccaagaaggcctacgccctgcagagcgacgtggagtacaaggccgactacaacagctggatgaagggctgcggctgggtgcccttcggcagcctggagatggagaaggccaagagagccagcgacatcctgaacgagaagaagtacagacagcaccccgacaccctgaagttcaccagcatcgaggacgcccccatcaccgtgcagagcaagatcaaccaggcccagagaagcgacatcgcctacaaggccaagggcgaggagatcatccacaagtacaacctgccccccgacctgccccagttcatccaggccaaggtgaacgcctacaacatcagcgagaacatgtacaaggccgacctgaaggacctgagcaagaagggctacgacctgagaaccgacgccatccccatcagagccgccaaggccgccagacaggccgccagcgacgtgcagtacaagaaggactacgagaaggccaagggcaagatggtgggcttccagagcctgcaggacgaccccaagctggtgcactacatgaacgtggccaagatccagagcgacagagagtacaagaaggactacgagaagaccaagagcaagtacaacaccccccacgacatgttcaacgtggtggccgccaagaaggcccaggacgtggtgagcaacgtgaactacaagcacagcctgcaccactacacctacctgcccgacgccatggacctggagctgagcaagaacatgatgcagatccagagcgacaacgtgtacaaggaggactacaacaactggatgaagggcatcggctggatccccatcggcagcctggacgtggagaaggtgaagaaggccggcgacgccctgaacgagaagaagtacagacagcaccccgacaccctgaagttcaccagcatcgtggacagccccgtgatggtgcaggccaagcagaacaccaagcaggtgagcgacatcctgtacaaggccaagggcgaggacgtgaagcacaagtacaccatgagccccgacctgccccagttcctgcaggccaagtgcaacgcctacaacatcagcgacgtgtgctacaagagagactggtacgacctgatcgccaagggcaacaacgtgctgggcgacgccatccccatcaccgccgccaaggccagcagaaacatcgccagcgactacaagtacaaggaggcctacgagaagagcaagggcaagcacgtgggcttcagaagcctgcaggacgaccccaagctggtgcactacatgaacgtggccaagctgcagagcgacagagagtacaagaagaactacgagaacaccaagaccagctaccacacccccggcgacatggtgagcatcaccgccgccaagatggcccaggacgtggccaccaacgtgaactacaagcagcccctgcaccactacacctacctgcccgacgccatgagcctggagcacaccagaaacgtgaaccagatccagagcgacaacgtgtacaaggacgagtacaacagcttcctgaagggcatcggctggatccccatcggcagcctggaggtggagaaggtgaagaaggccggcgacgccctgaacgagagaaagtacagacagcaccccgacaccgtgaagttcaccagcgtgcccgacagcatgggcatggtgctggcccagcacaacaccaagcagctgagcgacctgaactacaaggtggagggcgagaagctgaagcacaagtacaccatcgaccccgagctgccccagttcatccaggccaaggtgaacgccctgaacatgagcgacgcccactacaaggccgactggaagaagaccatcgccaagggctacgacctgagacccgacgccatccccatcgtggccgccaagagcagcagaaacatcgccagcgactgcaagtacaaggaggcctacgagaaggccaagggcaagcaggtgggcttcctgagcctgcaggacgaccccaagctggtgcactacatgaacgtggccaagatccagagcgacagagagtacaagaagggctacgaggccagcaagaccaagtaccacacccccctggacatggtgagcgtgaccgccgccaagaagagccaggaggtggccaccaacgccaactacagacagagctaccaccactacaccctgctgcccgacgccctgaacgtggagcacagcagaaacgccatgcagatccagagcgacaacctgtacaagagcgacttcaccaactggatgaagggcatcggctgggtgcccatcgagagcctggaggtggagaaggccaagaaggccggcgagatcctgagcgagaagaagtacagacagcaccccgagaagctgaagttcacctacgccatggacaccatggagcaggccctgaacaagagcaacaagctgaacatggacaagagactgtacaccgagaagtggaacaaggacaagaccaccatccacgtgatgcccgacacccccgacatcctgctgagcagagtgaaccagatcaccatgagcgacaagctgtacaaggccggctgggaggaggagaagaagaagggctacgacctgagacccgacgccatcgccatcaaggccgccagagccagcagagacatcgccagcgactacaagtacaagaaggcctacgagcaggccaagggcaagcacatcggcttcagaagcctggaggacgaccccaagctggtgcacttcatgcaggtggccaagatgcagagcgacagagagtacaagaagggctacgagaagagcaagaccagcttccacacccccgtggacatgctgagcgtggtggccgccaagaagagccaggaggtggccaccaacgccaactacagaaacgtgatccacacctacaacatgctgcccgacgccatgagcttcgagctggccaagaacatgatgcagatccagagcgacaaccagtacaaggccgactacgccgacttcatgaagggcatcggctggctgcccctgggcagcctggaggccgagaagaacaagaaggccatggagatcatcagcgagaagaagtacagacagcaccccgacaccctgaagtacagcaccctgatggacagcatgaacatggtgctggcccagaacaacgccaagatcatgaacgagcacctgtacaagcaggcctgggaggccgacaagaccaaggtgcacatcatgcccgacatcccccagatcatcctggccaaggccaacgccatcaacatgagcgacaagctgtacaagctgagcctggaggagagcaagaagaagggctacgacctgagacccgacgccatccccatcaaggccgccaaggccagcagagacatcgccagcgactacaagtacaagtacaactacgagaagggcaagggcaagatggtgggcttcagaagcctggaggacgaccccaagctggtgcacagcatgcaggtggccaagatgcagagcgacagagagtacaagaagaactacgagaacaccaagaccagctaccacacccccgccgacatgctgagcgtgaccgccgccaaggacgcccaggccaacatcaccaacaccaactacaagcacctgatccacaagtacatcctgctgcccgacgccatgaacatcgagctgaccagaaacatgaacagaatccagagcgacaacgagtacaagcaggactacaacgagtggtacaagggcctgggctggagccccgccggcagcctggaggtggagaaggccaagaaggccaccgagtacgccagcgaccagaagtacagacagcaccccagcaacttccagttcaagaagctgaccgacagcatggacatggtgctggccaagcagaacgcccacaccatgaacaagcacctgtacaccatcgactggaacaaggacaagaccaagatccacgtgatgcccgacacccccgacatcctgcaggccaagcagaaccagaccctgtacagccagaagctgtacaagctgggctgggaggaggccctgaagaagggctacgacctgcccgtggacgccatcagcgtgcagctggccaaggccagcagagacatcgccagcgactacaagtacaagcagggctacagaaagcagctgggccaccacgtgggcttcagaagcctgcaggacgaccccaagctggtgctgagcatgaacgtggccaagatgcagagcgagagagagtacaagaaggacttcgagaagtggaagaccaagttcagcagccccgtggacatgctgggcgtggtgctggccaagaagtgccaggagctggtgagcgacgtggactacaagaactacctgcaccagtggacctgcctgcccgaccagaacgacgtggtgcaggccaagaaggtgtacgagctgcagagcgagaacctgtacaagagcgacctggagtggctgagaggcatcggctggagccccctgggcagcctggaggccgagaagaacaagagagccagcgagatcatcagcgagaagaagtacagacagccccccgacagaaacaagttcaccagcatccccgacgccatggacatcgtgctggccaagaccaacgccaagaacagaagcgacagactgtacagagaggcctgggacaaggacaagacccagatccacatcatgcccgacacccccgacatcgtgctggccaaggccaacctgatcaacaccagcgacaagctgtacagaatgggctacgaggagctgaagagaaagggctacgacctgcccgtggacgccatccccatcaaggccgccaaggccagcagagagatcgccagcgagtacaagtacaaggagggcttcagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacctgtacaagagcgacctgcagtggctgaagggcatcggctggatgaccagcggcagcctggaggacgagaagaacaagagagccacccagatcctgagcgaccacgtgtacagacagcaccccgaccagttcaagttcagcagcctgatggacagcatccccatggtgctggccaagaacaacgccatcaccatgaaccacagactgtacaccgaggcctgggacaaggacaagaccaccgtgcacatcatgcccgacacccccgaggtgctgctggccaagcagaacaaggtgaactacagcgagaagctgtacaagctgggcctggaggaggccaagagaaagggctacgacatgagagtggacgccatccccatcaaggccgccaaggccagcagagacatcgccagcgagttcaagtacaaggagggctacagaaagcagctgggccaccacatcggcgccagagccatcagagacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacatgtacaagagcgacctgcagtggatgagaggcatcggctgggtgagcatcggcagcctggacgtggagaagtgcaagagagccaccgagatcctgagcgacaagatctacagacagccccccgacagattcaagttcaccagcgtgaccgacagcctggagcaggtgctggccaagaacaacgccctgaacatgaacaagagactgtacaccgaggcctgggacaaggacaagacccagatccacatcatgcccgacacccccgagatcatgctggccagacagaacaagatcaactacagcgagaccctgtacaagctggccaacgaggaggccaagaagaagggctacgacctgagaagcgacgccatccccatcgtggccgccaaggccagcagagacgtgatcagcgactacaagtacaaggacggctacagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagaacgacgtgatccacgccagacaggcctacgacctgcagagcgacaacatctacaagagcgacctgcagtggctgagaggcatcggctgggtgcccatcggcagcatggacgtggtgaagtgcaagagagccgccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccaggtgcacatcatgcccgacacccccgagatcatgctggccagacagaacaagatcaactacagcgagagcctgtacagacaggccatggaggaggccaagaaggagggctacgacctgagaagcgacgccatccccatcgtggccgccaaggccagcagagacatcgccagcgactacaagtacaaggaggcctacagaaagcagctgggccaccacatcggcgccagagccgtgcacgacgaccccaagatcatgtggagcctgcacatcgccaaggtgcagagcgacagagagtacaagaaggacttcgagaagtacaagaccagatacagcagccccgtggacatgctgggcatcgtgctggccaagaagtgccagaccctggtgagcgacgtggactacaagcaccccctgcacgagtggatctgcctgcccgaccagaacgacatcatccacgccagaaaggcctacgacctgcagagcgacaacctgtacaagagcgacctggagtggatgaagggcatcggctgggtgcccatcgacagcctggaggtggtgagagccaagagagccggcgagctgctgagcgacaccatctacagacagagacccgagaccctgaagttcaccagcatcaccgacacccccgagcaggtgctggccaagaacaacgccctgaacatgaacaagagactgtacaccgaggcctgggacaacgacaagaagaccatccacgtgatgcccgacacccccgagatcatgctggccaagctgaacagaatcaactacagcgacaagctgtacaagctggccctggaggagagcaagaaggagggctacgacctgagactggacgccatccccatccaggccgccaaggccagcagagacatcgccagcgactacaagtacaaggagggctacagaaagcagctgggccaccacatcggcgccagaaacatcaaggacgaccccaagatgatgtggagcatccacgtggccaagatccagagcgacagagagtacaagaaggagttcgagaagtggaagaccaagttcagcagccccgtggacatgctgggcgtggtgctggccaagaagtgccagatcctggtgagcgacatcgactacaagcaccccctgcacgagtggacctgcctgcccgaccagaacgacgtgatccaggccagaaaggcctacgacctgcagagcgacgccatctacaagagcgacctggagtggctgagaggcatcggctgggtgcccatcggcagcgtggaggtggagaaggtgaagagagccggcgagatcctgagcgacagaaagtacagacagcccgccgaccagctgaagttcacctgcatcaccgacacccccgagatcgtgctggccaagaacaacgccctgaccatgagcaagcacctgtacaccgaggcctgggacgccgacaagaccagcatccacgtgatgcccgacacccccgacatcctgctggccaagagcaacagcgccaacatcagccagaagctgtacaccaagggctgggacgagagcaagatgaaggactacgacctgagagccgacgccatcagcatcaagagcgccaaggccagcagagacatcgccagcgactacaagtacaaggaggcctacgagaagcagaagggccaccacatcggcgcccagagcatcgaggacgaccccaagatcatgtgcgccatccacgccggcaagatccagagcgagagagagtacaagaaggagttccagaagtggaagaccaagttcagcagccccgtggacatgctgagcatcctgctggccaagaagtgccagaccctggtgaccgacatcgactacagaaactacctgcacgagtggacctgcatgcccgaccagaacgacatcatccaggccaagaaggcctacgacctgcagagcgacgccctgtacaaggccgacctggagtggctgagaggcatcggctggatgccccagggcagccccgaggtgctgagagtgaagaacgcccagaacatcttctgcgacagcgtgtacagaacccccgtggtgaacctgaagtacaccagcatcgtggacacccccgaggtggtgctggccaagagcaacgccgagaacatcagcatccccaagtacagagaggtgtgggacaaggacaagaccagcatccacatcatgcccgacacccccgagatcaacctggccagagccaacgccctgaacgtgagcaacaagctgtacagagagggctgggacgagatgaaggccggctgcgacgtgagactggacgccatccccatccaggccgccaaggccagcagagagatcgccagcgactacaagtacaagctggaccacgagaagcagaagggccactacgtgggcaccctgaccgccagagacgacaacaagatcagatgggccctgatcgccgacaagctgcagaacgagagagagtacagactggactgggccaagtggaaggccaagatccagagccccgtggacatgctgagcatcctgcacagcaagaacagccaggccctggtgagcgacatggactacagaaactacctgcaccagtggacctgcatgcccgaccagaacgacgtgatccaggccaagaaggcctacgagctgcagagcgacaacgtgtacaaggccgacctggagtggctgagaggcatcggctggatgcccaacgacagcgtgagcgtgaaccacgccaagcacgccgccgacatcttcagcgagaagaagtacagaaccaagatcgagaccctgaacttcacccccgtggacgacagagtggactacgtgaccgccaagcagagcggcgagatcctggacgacatcaagtacagaaaggactggaacgccaccaagagcaagtacaccctgaccgagacccccctgctgcacaccgcccaggaggccgccagaatcctggaccagtacctgtacaaggagggctgggagagacagaaggccaccggctacatcctgccccccgacgccgtgcccttcgtgcacgcccaccactgcaacgacgtgcagagcgagctgaagtacaaggccgagcacgtgaagcagaagggccactacgtgggcgtgcccaccatgagagacgaccccaagctggtgtggttcgagcacgccggccagatccagaacgagagactgtacaaggaggactaccacaagaccaaggccaagatcaacatccccgccgacatggtgagcgtgctggccgccaagcagggccagaccctggtgagcgacatcgactacagaaactacctgcaccagtggatgtgccaccccgaccagaacgacgtgatccaggccagaaaggcctacgacctgcagagcgacaacgtgtacagagccgacctggagtggctgagaggcatcggctggatccccctggacagcgtggaccacgtgagagtgaccaagaaccaggagatgatgagccagatcaagtacaagaagaacgccctggagaactaccccaacttcagaagcgtggtggacccccccgagatcgtgctggccaagatcaacagcgtgaaccagagcgacgtgaagtacaaggagaccttcaacaaggccaagggcaagtacaccttcagccccgacaccccccacatcagccacagcaaggacatgggcaagctgtacagcaccatcctgtacaagggcgcctgggagggcaccaaggcctacggctacaccctggacgagagatacatccccatcgtgggcgccaagcacgccgacctggtgaacagcgagctgaagtacaaggagacctacgagaagcagaagggccactacctggccggcaaggtgatcggcgagttccccggcgtggtgcactgcctggacttccagaagatgagaagcgccctgaactacagaaagcactacgaggacaccaaggccaacgtgcacatccccaacgacatgatgaaccacgtgctggccaagagatgccagtacatcctgagcgacctggagtacagacactacttccaccagtggaccagcctgctggaggagcccaacgtgatcagagtgagaaacgcccaggagatcctgagcgacaacgtgtacaaggacgacctgaactggctgaagggcatcggctgctacgtgtgggacaccccccagatcctgcacgccaagaagagctacgacctgcagagccagctgcagtacaccgccgccggcaaggagaacctgcagaactacaacctggtgaccgacacccccctgtacgtgaccgccgtgcagagcggcatcaacgccagcgaggtgaagtacaaggagaactaccaccagatcaaggacaagtacaccaccgtgctggagaccgtggactacgacagaaccagaaacctgaagaacctgtacagcagcaacctgtacaaggaggcctgggacagagtgaaggccaccagctacatcctgcccagcagcaccctgagcctgacccacgccaagaaccagaagcacctggccagccacatcaagtacagagaggagtacgagaagttcaaggccctgtacaccctgcccagaagcgtggacgacgaccccaacaccgccagatgcctgagagtgggcaagctgaacatcgacagactgtacagaagcgtgtacgagaagaacaagatgaagatccacatcgtgcccgacatggtggagatggtgaccgccaaggacagccagaagaaggtgagcgagatcgactacagactgagactgcacgagtggatctgccaccccgacctgcaggtgaacgaccacgtgagaaaggtgaccgaccagatcagcgacatcgtgtacaaggacgacctgaactggctgaagggcatcggctgctacgtgtgggacacccccgagatcctgcacgccaagcacgcctacgacctgagagacgacatcaagtacaaggcccacatgctgaagaccagaaacgactacaagctggtgaccgacacccccgtgtacgtgcaggccgtgaagagcggcaagcagctgagcgacgccgtgtaccactacgactacgtgcacagcgtgagaggcaaggtggcccccaccaccaagaccgtggacctggacagagccctgcacgcctacaagctgcagagcagcaacctgtacaagaccagcctgagaaccctgcccaccggctacagactgcccggcgacaccccccacttcaagcacatcaaggacaccagatacatgagcagctacttcaagtacaaggaggcctacgagcacaccaaggcctacggctacaccctgggccccaaggacgtgcccttcgtgcacgtgagaagagtgaacaacgtgaccagcgagagactgtacagagagctgtaccacaagctgaaggacaagatccacaccacccccgacacccccgagatcagacaggtgaagaagacccaggaggccgtgagcgagctgatctacaagagcgacttcttcaagatgcagggccacatgatcagcctgccctacaccccccaggtgatccactgcagatacgtgggcgacatcaccagcgacatcaagtacaaggaggacctgcaggtgctgaagggcttcggctgcttcctgtacgacacccccgacatggtgagaagcagacacctgagaaagctgtggagcaactacctgtacaccgacaaggccagaaagatgagagacaagtacaaggtggtgctggacacccccgagtacagaaaggtgcaggagctgaagacccacctgagcgagctggtgtacagagccgccggcaagaagcagaagagcatcttcaccagcgtgcccgacacccccgacctgctgagagccaagagaggccagaagctgcagagccagtacctgtacgtggagctggccaccaaggagagaccccaccaccacgccggcaaccagaccaccgccctgaagcacgccaaggacgtgaaggacatggtgagcgagaagaagtacaagatccagtacgagaagatgaaggacaagtacacccccgtgcccgacacccccatcctgatcagagccaagagagcctactggaacgccagcgacctgagatacaaggagaccttccagaagaccaagggcaagtaccacaccgtgaaggacgccctggacatcgtgtaccacagaaaggtgaccgacgacatcagcaagatcaagtacaaggagaactacatgagccagctgggcatctggagaagcatccccgacagacccgagcacttccaccacagagccgtgaccgacaccgtgagcgacgtgaagtacaaggaggacctgacctggctgaagggcatcggctgctacgcctacgacacccccgacttcaccctggccgagaagaacaagaccctgtacagcaagtacaagtacaaggaggtgttcgagagaaccaagagcgacttcaagtacgtggccgacagccccatcaacagacacttcaagtacgccacccagctgatgaacgagaagaagtacagagccgactacgagcagagaaaggacaagtaccacctggtggtggacgagcccagacacctgctggccaagaccgccggcgaccagatcagccagatcaagtacagaaagaactacgagaagagcaaggacaagttcaccagcatcgtggacacccccgagcacctgagaaccaccaaggtgaacaagcagatcagcgacatcctgtacaagctggagtacaacaaggccaagcccagaggctacaccaccatccacgacacccccatgctgctgcacgtgagaaaggtgaaggacgaggtgagcgacctgaagtacaaggaggtgtaccagagaaacaagagcaactgcaccatcgagcccgacgccgtgcacatcaaggccgccaaggacgcctacaaggtgaacaccaacctggactacaagaagcagtacgaggccaacaaggcccactggaagtggacccccgacagacccgacttcctgcaggccgccaagagcagcctgcagcagagcgacttcgagtacaagctggacagagagttcctgaagggctgcaagctgagcgtgaccgacgacaagaacaccgtgctggccctgagaaacaccctgatcgagagcgacctgaagtacaaggagaagcacgtgaaggagagaggcacctgccacgccgtgcccgacaccccccagatcctgctggccaagaccgtgagcaacctggtgagcgagaacaagtacaaggaccacgtgaagaagcacctggcccagggcagctacaccaccctgcccgagaccagagacaccgtgcacgtgaaggaggtgaccaagcacgtgagcgacaccaactacaagaagaagttcgtgaaggagaagggcaagagcaactacagcatcatgctggagccccccgaggtgaagcacgccatggaggtggccaagaagcagagcgacgtggcctacagaaaggacgccaaggagaacctgcactacaccaccgtggccgacagacccgacatcaagaaggccacccaggccgccaagcaggccagcgaggtggagtacagagccaagcacagaaaggagggcagccacggcctgagcatgctgggcagacccgacatcgagatggccaagaaggccgccaagctgagcagccaggtgaagtacagagagaacttcgacaaggagaagggcaagacccccaagtacaaccccaaggacagccagctgtacaaggtgatgaaggacgccaacaacctggccagcgaggtgaagtacaaggccgacctgaagaagctgcacaagcccgtgaccgacatgaaggagagcctgatcatgaaccacgtgctgaacaccagccagctggccagcagctaccagtacaagaagaagtacgagaagagcaagggccactaccacaccatccccgacaacctggagcagctgcacctgaaggaggccaccgagctgcagagcatcgtgaagtacaaggagaagtacgagaaggagagaggcaagcccatgctggacttcgagacccccacctacatcaccgccaaggagagccagcagatgcagagcggcaaggagtacagaaaggactacgaggagagcatcaagggcagaaacctgaccggcctggaggtgacccccgccctgctgcacgtgaagtacgccaccaagatcgccagcgagaaggagtacagaaaggacctggaggagagcatcagaggcaagggcctgaccgagatggaggacacccccgacatgctgagagccaagaacgccacccagatcctgaacgagaaggagtacaagagagacctggagctggaggtgaagggcagaggcctgaacgccatggccaacgagacccccgacttcatgagagccagaaacgccaccgacatcgccagccagatcaagtacaagcagagcgccgagatggagaaggccaacttcaccagcgtggtggacacccccgagatcatccacgcccagcaggtgaagaacctgagcagccagaagaagtacaaggaggacgccgagaagagcatgagctactacgagaccgtgctggacacccccgagatccagagagtgagagagaaccagaagaacttcagcctgctgcagtaccagtgcgacctgaagaacagcaagggcaagatcaccgtggtgcaggacacccccgagatcctgagagtgaaggagaaccagaagaacttcagcagcgtgctgtacaaggaggacgtgagccccggcaccgccatcggcaagacccccgagatgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacctgggcaagggcatccccacccccatcacccccgagatggagagagtgaagagaaaccaggagaacttcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacctgggcaaggccacccccacccccttcacccccgagatggagagagtgaagagaaaccaggagaacttcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90531 - DNA, 25578 bp, Artificial Sequence
  Description of Artificial Sequence: Synthetic coding sequence
atggccgacgacgaggactacgaggaggtggtggagtactacaccgaggaggtggtgtacgaggaggtgcccggcgagaccatcaccaagatctacgagaccaccaccaccagaaccagcgactacgagcagagcgagaccagcaagcccgccctggcccagcccgccctggcccagcccgccagcgccaagcccgtggagagaagaaaggtgatcagaaagaaggtggaccccagcaagttcatgaccccctacatcgcccacagccagaagatgcaggacctgttcagccccaacaagtacaaggagaagttcgagaagaccaagggccagccctacgccagcaccaccgacacccccgagctgagaagaatcaagaaggtgcaggaccagctgagcgaggtgaagtacagaatggacggcgacgtggccaagaccatctgccacgtggacgagaaggccaaggacatcgagcacgccaagaaggtgagccagcaggtgagcaaggtgctgtacaagcagaactgggaggacaccaaggacaagtacctgctgccccccgacgcccccgagctggtgcaggccgtgaagaacaccgccatgttcagcaagaagctgtacaccgaggactgggaggccgacaagagcctgttctacccctacaacgacagccccgagctgagaagagtggcccaggcccagaaggccctgagcgacgtggcctacaagaagggcctggccgagcagcaggcccagttcacccccctggccgacccccccgacatcgagttcgccaagaaggtgaccaaccaggtgagcaagcagaagtacaaggaggactacgagaacaagatcaagggcaagtggagcgagaccccctgcttcgaggtggccaacgccagaatgaacgccgacaacatcagcaccagaaagtaccaggaggacttcgagaacatgaaggaccagatctacttcatgcagaccgagacccccgagtacaagatgaacaagaaggccggcgtggccgccagcaaggtgaagtacaaggaggactacgagaagaacaagggcaaggccgactacaacgtgctgcccgccagcgagaacccccagctgagacagctgaaggccgccggcgacgccctgagcgacaagctgtacaaggagaactacgagaagaccaaggccaagagcatcaactactgcgagacccccaagttcaagctggacaccgtgctgcagaacttcagcagcgacaagaagtacaaggacagctacctgaaggacatcctgggccactacgtgggcagcttcgaggacccctaccacagccactgcatgaaggtgaccgcccagaacagcgacaagaactacaaggccgagtacgaggaggacagaggcaagggcttcttcccccagaccatcacccaggagtacgaggccatcaagaagctggaccagtgcaaggaccacacctacaaggtgcaccccgacaagaccaagttcacccaggtgaccgacagccccgtgctgctgcaggcccaggtgaacagcaagcagctgagcgacctgaactacaaggccaagcacgagagcgagaagttcaagtgccacatcccccccgacacccccgccttcatccagcacaaggtgaacgcctacaacctgagcgacaacctgtacaagcaggactgggagaagagcaaggccaagaagttcgacatcaaggtggacgccatccccctgctggccgccaaggccaacaccaagaacaccagcgacgtgatgtacaagaaggactacgagaagaacaagggcaagatgatcggcgtgctgagcatcaacgacgaccccaagatgctgcacagcctgaaggtggccaagaaccagagcgacagactgtacaaggagaactacgagaagaccaaggccaagagcatgaactactgcgagacccccaagtaccagctggacacccagctgaagaacttcagcgaggccagatacaaggacctgtacgtgaaggacgtgctgggccactacgtgggcagcatggaggacccctaccacacccactgcatgaaggtggccgcccagaacagcgacaagagctacaaggccgagtacgaggaggacaagggcaagtgctacttcccccagaccatcacccaggagtacgaggccatcaagaagctggaccagtgcaaggaccacacctacaaggtgcaccccgacaagaccaagttcaccgccgtgaccgacagccccgtgctgctgcaggcccagctgaacaccaagcagctgagcgacctgaactacaaggccaagcacgagggcgagaagttcaagtgccacatccccgccgacgccccccagttcatccagcacagagtgaacgcctacaacctgagcgacaacgtgtacaagcaggactgggagaagagcaaggccaagaagttcgacatcaaggtggacgccatccccctgctggccgccaaggccaacaccaagaacaccagcgacgtgatgtacaagaaggactacgagaagagcaagggcaagatgatcggcgccctgagcatcaacgacgaccccaagatgctgcacagcctgaagaccgccaagaaccagagcgacagagagtacagaaaggactacgagaagagcaagaccatctacaccgcccccctggacatgctgcaggtgacccaggccaagaagagccaggccatcgccagcgacgtggactacaagcacatcctgcacagctacagctacccccccgacagcatcaacgtggacctggccaagaaggcctacgccctgcagagcgacgtggagtacaaggccgactacaacagctggatgaagggctgcggctgggtgcccttcggcagcctggagatggagaaggccaagagagccagcgacatcctgaacgagaagaagtacagacagcaccccgacaccctgaagttcaccagcatcgaggacgcccccatcaccgtgcagagcaagatcaaccaggcccagagaagcgacatcgcctacaaggccaagggcgaggagatcatccacaagtacaacctgccccccgacctgccccagttcatccaggccaaggtgaacgcctacaacatcagcgagaacatgtacaaggccgacctgaaggacctgagcaagaagggctacgacctgagaaccgacgccatccccatcagagccgccaaggccgccagacaggccgccagcgacgtgcagtacaagaaggactacgagaaggccaagggcaagatggtgggcttccagagcctgcaggacgaccccaagctggtgcactacatgaacgtggccaagatccagagcgacagagagtacaagaaggactacgagaagaccaagagcaagtacaacaccccccacgacatgttcaacgtggtggccgccaagaaggcccaggacgtggtgagcaacgtgaactacaagcacagcctgcaccactacacctacctgcccgacgccatggacctggagctgagcaagaacatgatgcagatccagagcgacaacgtgtacaaggaggactacaacaactggatgaagggcatcggctggatccccatcggcagcctggacgtggagaaggtgaagaaggccggcgacgccctgaacgagaagaagtacagacagcaccccgacaccctgaagttcaccagcatcgtggacagccccgtgatggtgcaggccaagcagaacaccaagcaggtgagcgacatcctgtacaaggccaagggcgaggacgtgaagcacaagtacaccatgagccccgacctgccccagttcctgcaggccaagtgcaacgcctacaacatcagcgacgtgtgctacaagagagactggtacgacctgatcgccaagggcaacaacgtgctgggcgacgccatccccatcaccgccgccaaggccagcagaaacatcgccagcgactacaagtacaaggaggcctacgagaagagcaagggcaagcacgtgggcttcagaagcctgcaggacgaccccaagctggtgcactacatgaacgtggccaagctgcagagcgacagagagtacaagaagaactacgagaacaccaagaccagctaccacacccccggcgacatggtgagcatcaccgccgccaagatggcccaggacgtggccaccaacgtgaactacaagcagcccctgcaccactacacctacctgcccgacgccatgagcctggagcacaccagaaacgtgaaccagatccagagcgacaacgtgtacaaggacgagtacaacagcttcctgaagggcatcggctggatccccatcggcagcctggaggtggagaaggtgaagaaggccggcgacgccctgaacgagagaaagtacagacagcaccccgacaccgtgaagttcaccagcgtgcccgacagcatgggcatggtgctggcccagcacaacaccaagcagctgagcgacctgaactacaaggtggagggcgagaagctgaagcacaagtacaccatcgaccccgagctgccccagttcatccaggccaaggtgaacgccctgaacatgagcgacgcccactacaaggccgactggaagaagaccatcgccaagggctacgacctgagacccgacgccatccccatcgtggccgccaagagcagcagaaacatcgccagcgactgcaagtacaaggaggcctacgagaaggccaagggcaagcaggtgggcttcctgagcctgcaggacgaccccaagctggtgcactacatgaacgtggccaagatccagagcgacagagagtacaagaagggctacgaggccagcaagaccaagtaccacacccccctggacatggtgagcgtgaccgccgccaagaagagccaggaggtggccaccaacgccaactacagacagagctaccaccactacaccctgctgcccgacgccctgaacgtggagcacagcagaaacgccatgcagatccagagcgacaacctgtacaagagcgacttcaccaactggatgaagggcatcggctgggtgcccatcgagagcctggaggtggagaaggccaagaaggccggcgagatcctgagcgagaagaagtacagacagcaccccgagaagctgaagttcacctacgccatggacaccatggagcaggccctgaacaagagcaacaagctgaacatggacaagagactgtacaccgagaagtggaacaaggacaagaccaccatccacgtgatgcccgacacccccgacatcctgctgagcagagtgaaccagatcaccatgagcgacaagctgtacaaggccggctgggaggaggagaagaagaagggctacgacctgagacccgacgccatcgccatcaaggccgccagagccagcagagacatcgccagcgactacaagtacaagaaggcctacgagcaggccaagggcaagcacatcggcttcagaagcctggaggacgaccccaagctggtgcacttcatgcaggtggccaagatgcagagcgacagagagtacaagaagggctacgagaagagcaagaccagcttccacacccccgtggacatgctgagcgtggtggccgccaagaagagccaggaggtggccaccaacgccaactacagaaacgtgatccacacctacaacatgctgcccgacgccatgagcttcgagctggccaagaacatgatgcagatccagagcgacaaccagtacaaggccgactacgccgacttcatgaagggcatcggctggctgcccctgggcagcctggaggccgagaagaacaagaaggccatggagatcatcagcgagaagaagtacagacagcaccccgacaccctgaagtacagcaccctgatggacagcatgaacatggtgctggcccagaacaacgccaagatcatgaacgagcacctgtacaagcaggcctgggaggccgacaagaccaaggtgcacatcatgcccgacatcccccagatcatcctggccaaggccaacgccatcaacatgagcgacaagctgtacaagctgagcctggaggagagcaagaagaagggctacgacctgagacccgacgccatccccatcaaggccgccaaggccagcagagacatcgccagcgactacaagtacaagtacaactacgagaagggcaagggcaagatggtgggcttcagaagcctggaggacgaccccaagctggtgcacagcatgcaggtggccaagatgcagagcgacagagagtacaagaagaactacgagaacaccaagaccagctaccacacccccgccgacatgctgagcgtgaccgccgccaaggacgcccaggccaacatcaccaacaccaactacaagcacctgatccacaagtacatcctgctgcccgacgccatgaacatcgagctgaccagaaacatgaacagaatccagagcgacaacgagtacaagcaggactacaacgagtggtacaagggcctgggctggagccccgccggcagcctggaggtggagaaggccaagaaggccaccgagtacgccagcgaccagaagtacagacagcaccccagcaacttccagttcaagaagctgaccgacagcatggacatggtgctggccaagcagaacgcccacaccatgaacaagcacctgtacaccatcgactggaacaaggacaagaccaagatccacgtgatgcccgacacccccgacatcctgcaggccaagcagaaccagaccctgtacagccagaagctgtacaagctgggctgggaggaggccctgaagaagggctacgacctgcccgtggacgccatcagcgtgcagctggccaaggccagcagagacatcgccagcgactacaagtacaagcagggctacagaaagcagctgggccaccacgtgggcttcagaagcctgcaggacgaccccaagctggtgctgagcatgaacgtggccaagatgcagagcgagagagagtacaagaaggacttcgagaagtggaagaccaagttcagcagccccgtggacatgctgggcgtggtgctggccaagaagtgccaggagctggtgagcgacgtggactacaagaactacctgcaccagtggacctgcctgcccgaccagaacgacgtggtgcaggccaagaaggtgtacgagctgcagagcgagaacctgtacaagagcgacctggagtggctgagaggcatcggctggagccccctgggcagcctggaggccgagaagaacaagagagccagcgagatcatcagcgagaagaagtacagacagccccccgacagaaacaagttcaccagcatccccgacgccatggacatcgtgctggccaagaccaacgccaagaacagaagcgacagactgtacagagaggcctgggacaaggacaagacccagatccacatcatgcccgacacccccgacatcgtgctggccaaggccaacctgatcaacaccagcgacaagctgtacagaatgggctacgaggagctgaagagaaagggctacgacctgcccgtggacgccatccccatcaaggccgccaaggccagcagagagatcgccagcgagtacaagtacaaggagggcttcagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacctgtacaagagcgacctgcagtggctgaagggcatcggctggatgaccagcggcagcctggaggacgagaagaacaagagagccacccagatcctgagcgaccacgtgtacagacagcaccccgaccagttcaagttcagcagcctgatggacagcatccccatggtgctggccaagaacaacgccatcaccatgaaccacagactgtacaccgaggcctgggacaaggacaagaccaccgtgcacatcatgcccgacacccccgaggtgctgctggccaagcagaacaaggtgaactacagcgagaagctgtacaagctgggcctggaggaggccaagagaaagggctacgacatgagagtggacgccatccccatcaaggccgccaaggccagcagagacatcgccagcgagttcaagtacaaggagggctacagaaagcagctgggccaccacatcggcgccagagccatcagagacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcaccagtggacctgcctgcccgaccagagcgacgtgatccacgccagacaggcctacgacctgcagagcgacaacatgtacaagagcgacctgcagtggatgagaggcatcggctgggtgagcatcggcagcctggacgtggagaagtgcaagagagccaccgagatcctgagcgacaagatctacagacagccccccgacagattcaagttcaccagcgtgaccgacagcctggagcaggtgctggccaagaacaacgccatcaccatgaacaagagactgtacaccgaggcctgggacaaggacaagacccagatccacatcatgcccgacacccccgagatcatgctggccagaatgaacaagatcaactacagcgagagcctgtacaagctggccaacgaggaggccaagaagaagggctacgacctgagaagcgacgccatccccatcgtggccgccaaggccagcagagacatcatcagcgactacaagtacaaggacggctactgcaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagagcgacgtgatccacgccagacaggcctacgacctgcagagcgacaacatctacaagagcgacctgcagtggctgagaggcatcggctgggtgcccatcggcagcatggacgtggtgaagtgcaagagagccaccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccagatccacatcatgcccgacacccccgagatcatgctggccagacagaacaagatcaactacagcgagaccctgtacaagctggccaacgaggaggccaagaagaagggctacgacctgagaagcgacgccatccccatcgtggccgccaaggccagcagagacgtgatcagcgactacaagtacaaggacggctacagaaagcagctgggccaccacatcggcgccagaaacatcgaggacgaccccaagatgatgtggagcatgcacgtggccaagatccagagcgacagagagtacaagaaggacttcgagaagtggaagaccaagttcagcagccccgtggacatgctgggcgtggtgctggccaagaagtgccagaccctggtgagcgacgtggactacaagaactacctgcacgagtggacctgcctgcccgaccagaacgacgtgatccacgccagacaggcctacgacctgcagagcgacaacatctacaagagcgacctgcagtggctgagaggcatcggctgggtgcccatcggcagcatggacgtggtgaagtgcaagagagccgccgagatcctgagcgacaacatctacagacagccccccgacaagctgaagttcaccagcgtgaccgacagcctggagcaggtgctggccaagaacaacgccctgaacatgaacaagagactgtacaccgaggcctgggacaaggacaagacccaggtgcacatcatgcccgacacccccgagatcatgctggccagacagaacaagatcaactacagcgagagcctgtacagacaggccatggaggaggccaagaaggagggctacgacctgagaagcgacgccatccccatcgtggccgccaaggccagcagagacatcgccagcgactacaagtacaaggaggcctacagaaagcagctgggccaccacatcggcgccagagccgtgcacgacgaccccaagatcatgtggagcctgcacatcgccaaggtgcagagcgacagagagtacaagaaggacttcgagaagtacaagaccagatacagcagccccgtggacatgctgggcatcgtgctggccaagaagtgccagaccctggtgagcgacgtggactacaagcaccccctgcacgagtggatctgcctgcccgaccagaacgacatcatccacgccagaaaggcctacgacctgcagagcgacaacctgtacaagagcgacctggagtggatgaagggcatcggctgggtgcccatcgacagcctggaggtggtgagagccaagagagccggcgagctgctgagcgacaccatctacagacagagacccgagaccctgaagttcaccagcatcaccgacacccccgagcaggtgctggccaagaacaacgccctgaacatgaacaagagactgtacaccgaggcctgggacaacgacaagaagaccatccacgtgatgcccgacacccccgagatcatgctggccaagctgaacagaatcaactacagcgacaagctgtacaagctggccctggaggagagcaagaaggagggctacgacctgagactggacgccatccccatccaggccgccaaggccagcagagacatcgccagcgactacaagtacaaggagggctacagaaagcagctgggccaccacatcggcgccagaaacatcaaggacgaccccaagatgatgtggagcatccacgtggccaagatccagagcgacagagagtacaagaaggagttcgagaagtggaagaccaagttcagcagccccgtggacatgctgggcgtggtgctggccaagaagtgccagatcctggtgagcgacatcgactacaagcaccccctgcacgagtggacctgcctgcccgaccagaacgacgtgatccaggccagaaaggcctacgacctgcagagcgacgccatctacaagagcgacctggagtggctgagaggcatcggctgggtgcccatcggcagcgtggaggtggagaaggtgaagagagccggcgagatcctgagcgacagaaagtacagacagcccgccgaccagctgaagttcacctgcatcaccgacacccccgagatcgtgctggccaagaacaacgccctgaccatgagcaagcacctgtacaccgaggcctgggacgccgacaagaccagcatccacgtgatgcccgacacccccgacatcctgctggccaagagcaacagcgccaacatcagccagaagctgtacaccaagggctgggacgagagcaagatgaaggactacgacctgagagccgacgccatcagcatcaagagcgccaaggccagcagagacatcgccagcgactacaagtacaaggaggcctacgagaagcagaagggccaccacatcggcgcccagagcatcgaggacgaccccaagatcatgtgcgccatccacgccggcaagatccagagcgagagagagtacaagaaggagttccagaagtggaagaccaagttcagcagccccgtggacatgctgagcatcctgctggccaagaagtgccagaccctggtgaccgacatcgactacagaaactacctgcacgagtggacctgcatgcccgaccagaacgacatcatccaggccaagaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacgccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagagacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcaccactggagctgcttccccgaccagaacgacgtgatccaggccagaaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacaccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagaaacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcaccactggagctgcttccccgaccagaacgacgtgatccaggccagaaaggcctacgacctgcagagcgacagcgtgtacaaggccgacctggagtggctgagaggcatcggctggatgcccgagggcagcgtggagatgaacagagtgaaggtggcccaggacctggtgaacgagagactgtacagaaccagacccgaggccctgagcttcaccagcatcgtggacacccccgaggtggtgctggccaaggccaacagcctgcagatcagcgagaagctgtaccaggaggcctggaacaaggacaagagcaacatcaccatccccagcgacacccccgagatgctgcaggcccacatcaacgccctgcagatcagcaacaagctgtaccagaaggactggaacgacaccaagcagaagggctacgacatcagagccgacgccatcgagatcaagcacgccaaggccagcagagagatcgccagcgagtacaagtacaaggagggctacagaaagcagctgggccaccacatgggcttcagaaccctgcaggacgaccccaagagcgtgtgggccatccacgccgccaagatccagagcgacagagagtacaagaaggcctacgagaagagcaagggcatccacaacacccccctggacatgatgagcatcgtgcaggccaagaagtgccaggtgctggtgagcgacatcgactacagaaactacctgcaccagtggacctgcctgcccgaccagaacgacgtgatccaggccaagaaggcctacgacctgcagagcgacaacctgtacaagagcgacctggagtggctgaagggcatcggctggctgcccgagggcagcgtggaggtgatgagagtgaagaacgcccagaacctgctgaacgagagactgtacagaatcaagcccgaggccctgaagttcaccagcatcgtggacacccccgaggtgatccaggccaagatcaacgccgtgcagatcagcgagcccctgtacagagacgcctgggagaaggagaaggccaacgtgaacgtgcccgccgacacccccctgatgctgcagagcaagatcaacgccctgcagatcagcaacaagagataccagcaggcctgggaggacgtgaagatgaccggctacgacctgagagccgacgccatcggcatccagcacgccaaggccagcagagacatcgccagcgactacctgtacaagaccgcctacgagaagcagaagggccactacatcggctgcagaagcgccaaggaggaccccaagctggtgtgggccgccaacgtgctgaagatgcagaacgacagactgtacaagaaggcctacaacgaccacaaggccaagatcagcatccccgtggacatggtgagcatcagcgccgccaaggagggccaggccctggccagcgacgtggactacagacactacctgcacagatggagctgcttccccgaccagaacgacgtgatccaggccagaaaggcctacgacctgcagagcgacgccctgtacaaggccgacctggagtggctgagaggcatcggctggatgccccagggcagccccgaggtgctgagagtgaagaacgcccagaacatcttctgcgacagcgtgtacagaacccccgtggtgaacctgaagtacaccagcatcgtggacacccccgaggtggtgctggccaagagcaacgccgagaacatcagcatccccaagtacagagaggtgtgggacaaggacaagaccagcatccacatcatgcccgacacccccgagatcaacctggccagagccaacgccctgaacgtgagcaacaagctgtacagagagggctgggacgagatgaaggccggctgcgacgtgagactggacgccatccccatccaggccgccaaggccagcagagagatcgccagcgactacaagtacaagctggaccacgagaagcagaagggccactacgtgggcaccctgaccgccagagacgacaacaagatcagatgggccctgatcgccgacaagctgcagaacgagagagagtacagactggactgggccaagtggaaggccaagatccagagccccgtggacatgctgagcatcctgcacagcaagaacagccaggccctggtgagcgacatggactacagaaactacctgcaccagtggacctgcatgcccgaccagaacgacgtgatccaggccaagaaggcctacgagctgcagagcgacaacgtgtacaaggccgacctggagtggctgagaggcatcggctggatgcccaacgacagcgtgagcgtgaaccacgccaagcacgccgccgacatcttcagcgagaagaagtacagaaccaagatcgagaccctgaacttcacccccgtggacgacagagtggactacgtgaccgccaagcagagcggcgagatcctggacgacatcaagtacagaaaggactggaacgccaccaagagcaagtacaccctgaccgagacccccctgctgcacaccgcccaggaggccgccagaatcctggaccagtacctgtacaaggagggctgggagagacagaaggccaccggctacatcctgccccccgacgccgtgcccttcgtgcacgcccaccactgcaacgacgtgcagagcgagctgaagtacaaggccgagcacgtgaagcagaagggccactacgtgggcgtgcccaccatgagagacgaccccaagctggtgtggttcgagcacgccggccagatccagaacgagagactgtacaaggaggactaccacaagaccaaggccaagatcaacatccccgccgacatggtgagcgtgctggccgccaagcagggccagaccctggtgagcgacatcgactacagaaactacctgcaccagtggatgtgccaccccgaccagaacgacgtgatccaggccagaaaggcctacgacctgcagagcgacaacgtgtacagagccgacctggagtggctgagaggcatcggctggatccccctggacagcgtggaccacgtgagagtgaccaagaaccaggagatgatgagccagatcaagtacaagaagaacgccctggagaactaccccaacttcagaagcgtggtggacccccccgagatcgtgctggccaagatcaacagcgtgaaccagagcgacgtgaagtacaaggagaccttcaacaaggccaagggcaagtacaccttcagccccgacaccccccacatcagccacagcaaggacatgggcaagctgtacagcaccatcctgtacaagggcgcctgggagggcaccaaggcctacggctacaccctggacgagagatacatccccatcgtgggcgccaagcacgccgacctggtgaacagcgagctgaagtacaaggagacctacgagaagcagaagggccactacctggccggcaaggtgatcggcgagttccccggcgtggtgcactgcctggacttccagaagatgagaagcgccctgaactacagaaagcactacgaggacaccaaggccaacgtgcacatccccaacgacatgatgaaccacgtgctggccaagagatgccagtacatcctgagcgacctggagtacagacactacttccaccagtggaccagcctgctggaggagcccaacgtgatcagagtgagaaacgcccaggagatcctgagcgacaacgtgtacaaggacgacctgaactggctgaagggcatcggctgctacgtgtgggacaccccccagatcctgcacgccaagaagagctacgacctgcagagccagctgcagtacaccgccgccggcaaggagaacctgcagaactacaacctggtgaccgacacccccctgtacgtgaccgccgtgcagagcggcatcaacgccagcgaggtgaagtacaaggagaactaccaccagatcaaggacaagtacaccaccgtgctggagaccgtggactacgacagaaccagaaacctgaagaacctgtacagcagcaacctgtacaaggaggcctgggacagagtgaaggccaccagctacatcctgcccagcagcaccctgagcctgacccacgccaagaaccagaagcacctggccagccacatcaagtacagagaggagtacgagaagttcaaggccctgtacaccctgcccagaagcgtggacgacgaccccaacaccgccagatgcctgagagtgggcaagctgaacatcgacagactgtacagaagcgtgtacgagaagaacaagatgaagatccacatcgtgcccgacatggtggagatggtgaccgccaaggacagccagaagaaggtgagcgagatcgactacagactgagactgcacgagtggatctgccaccccgacctgcaggtgaacgaccacgtgagaaaggtgaccgaccagatcagcgacatcgtgtacaaggacgacctgaactggctgaagggcatcggctgctacgtgtgggacacccccgagatcctgcacgccaagcacgcctacgacctgagagacgacatcaagtacaaggcccacatgctgaagaccagaaacgactacaagctggtgaccgacacccccgtgtacgtgcaggccgtgaagagcggcaagcagctgagcgacgccgtgtaccactacgactacgtgcacagcgtgagaggcaaggtggcccccaccaccaagaccgtggacctggacagagccctgcacgcctacaagctgcagagcagcaacctgtacaagaccagcctgagaaccctgcccaccggctacagactgcccggcgacaccccccacttcaagcacatcaaggacaccagatacatgagcagctacttcaagtacaaggaggcctacgagcacaccaaggcctacggctacaccctgggccccaaggacgtgcccttcgtgcacgtgagaagagtgaacaacgtgaccagcgagagactgtacagagagctgtaccacaagctgaaggacaagatccacaccacccccgacacccccgagatcagacaggtgaagaagacccaggaggccgtgagcgagctgatctacaagagcgacttcttcaagatgcagggccacatgatcagcctgccctacaccccccaggtgatccactgcagatacgtgggcgacatcaccagcgacatcaagtacaaggaggacctgcaggtgctgaagggcttcggctgcttcctgtacgacacccccgacatggtgagaagcagacacctgagaaagctgtggagcaactacctgtacaccgacaaggccagaaagatgagagacaagtacaaggtggtgctggacacccccgagtacagaaaggtgcaggagctgaagacccacctgagcgagctggtgtacagagccgccggcaagaagcagaagagcatcttcaccagcgtgcccgacacccccgacctgctgagagccaagagaggccagaagctgcagagccagtacctgtacgtggagctggccaccaaggagagaccccaccaccacgccggcaaccagaccaccgccctgaagcacgccaaggacgtgaaggacatggtgagcgagaagaagtacaagatccagtacgagaagatgaaggacaagtacacccccgtgcccgacacccccatcctgatcagagccaagagagcctactggaacgccagcgacctgagatacaaggagaccttccagaagaccaagggcaagtaccacaccgtgaaggacgccctggacatcgtgtaccacagaaaggtgaccgacgacatcagcaagatcaagtacaaggagaactacatgagccagctgggcatctggagaagcatccccgacagacccgagcacttccaccacagagccgtgaccgacaccgtgagcgacgtgaagtacaaggaggacctgacctggctgaagggcatcggctgctacgcctacgacacccccgacttcaccctggccgagaagaacaagaccctgtacagcaagtacaagtacaaggaggtgttcgagagaaccaagagcgacttcaagtacgtggccgacagccccatcaacagacacttcaagtacgccacccagctgatgaacgagaagaagtacagagccgactacgagcagagaaaggacaagtaccacctggtggtggacgagcccagacacctgctggccaagaccgccggcgaccagatcagccagatcaagtacagaaagaactacgagaagagcaaggacaagttcaccagcatcgtggacacccccgagcacctgagaaccaccaaggtgaacaagcagatcagcgacatcctgtacaagctggagtacaacaaggccaagcccagaggctacaccaccatccacgacacccccatgctgctgcacgtgagaaaggtgaaggacgaggtgagcgacctgaagtacaaggaggtgtaccagagaaacaagagcaactgcaccatcgagcccgacgccgtgcacatcaaggccgccaaggacgcctacaaggtgaacaccaacctggactacaagaagcagtacgaggccaacaaggcccactggaagtggacccccgacagacccgacttcctgcaggccgccaagagcagcctgcagcagagcgacttcgagtacaagctggacagagagttcctgaagggctgcaagctgagcgtgaccgacgacaagaacaccgtgctggccctgagaaacaccctgatcgagagcgacctgaagtacaaggagaagcacgtgaaggagagaggcacctgccacgccgtgcccgacaccccccagatcctgctggccaagaccgtgagcaacctggtgagcgagaacaagtacaaggaccacgtgaagaagcacctggcccagggcagctacaccaccctgcccgagaccagagacaccgtgcacgtgaaggaggtgaccaagcacgtgagcgacaccaactacaagaagaagttcgtgaaggagaagggcaagagcaactacagcatcatgctggagccccccgaggtgaagcacgccatggaggtggccaagaagcagagcgacgtggcctacagaaaggacgccaaggagaacctgcactacaccaccgtggccgacagacccgacatcaagaaggccacccaggccgccaagcaggccagcgaggtggagtacagagccaagcacagaaaggagggcagccacggcctgagcatgctgggcagacccgacatcgagatggccaagaaggccgccaagctgagcagccaggtgaagtacagagagaacttcgacaaggagaagggcaagacccccaagtacaaccccaaggacagccagctgtacaaggtgatgaaggacgccaacaacctggccagcgaggtgaagtacaaggccgacctgaagaagctgcacaagcccgtgaccgacatgaaggagagcctgatcatgaaccacgtgctgaacaccagccagctggccagcagctaccagtacaagaagaagtacgagaagagcaagggccactaccacaccatccccgacaacctggagcagctgcacctgaaggaggccaccgagctgcagagcatcgtgaagtacaaggagaagtacgagaaggagagaggcaagcccatgctggacttcgagacccccacctacatcaccgccaaggagagccagcagatgcagagcggcaaggagtacagaaaggactacgaggagagcatcaagggcagaaacctgaccggcctggaggtgacccccgccctgctgcacgtgaagtacgccaccaagatcgccagcgagaaggagtacagaaaggacctggaggagagcatcagaggcaagggcctgaccgagatggaggacacccccgacatgctgagagccaagaacgccacccagatcctgaacgagaaggagtacaagagagacctggagctggaggtgaagggcagaggcctgaacgccatggccaacgagacccccgacttcatgagagccagaaacgccaccgacatcgccagccagatcaagtacaagcagagcgccgagatggagaaggccaacttcaccagcgtggtggacacccccgagatcatccacgcccagcaggtgaagaacctgagcagccagaagaagtacaaggaggacgccgagaagagcatgagctactacgagaccgtgctggacacccccgagatccagagagtgagagagaaccagaagaacttcagcctgctgcagtaccagtgcgacctgaagaacagcaagggcaagatcaccgtggtgcaggacacccccgagatcctgagagtgaaggagaaccagaagaacttcagcagcgtgctgtacaaggaggacgtgagccccggcaccgccatcggcaagacccccgagatgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacctgggcaagggcatccccacccccatcacccccgagatggagagagtgaagagaaaccaggagaacttcagcagcatcctgtacaaggagaacctgagcaagggcacccccctgcccgtgacccccgagatggagagagtgaagctgaaccaggagaacttcagcagcgtgctgtacaaggagaacgtgggcaagggcatccccatccccatcacccccgagatggagagagtgaagcacaaccaggagaacttcagcagcgtgctgtacaaggagaacctgggcaccggcatccccatccccatcacccccgagatgcagagagtgaagcacaaccaggagaacctgagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctgcccgtgacccccgagatggagagagtgaagcacaaccaggagaacatcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacctgggcaaggccacccccacccccttcacccccgagatggagagagtgaagagaaaccaggagaacttcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90532 - DNA, 864 bp, Artificial Sequence
  Description of Artificial Sequence: Synthetic coding sequence
atggccgacgacgaggactacgaggaggtggtggagtactacaccgaggaggtggtgtacgaggaggtgcccggcgagaccatcaccaagatctacgagaccaccaccaccagaaccagcgactacgagcagagcgagaccagcaagcccgccctggcccagcccgccctggcccagcccgccagcgccaagcccgtggagagaagaaaggtgatcagaaagaaggtggaccccagcaagttcatgaccccctacatcgcccacagccagaagatgcaggacctgttcagccccaacaagtacaaggagaagttcgagaagaccaagggccagccctacgccagcaccaccgacacccccgagctgagaagaatcaagaaggtgcaggaccagctgagcgaggtgaagtacagaatggacggcgacgtggccaagaccatctgccacgtggacgagaaggccaaggacatcgagcacgccaagaaggtgagccagcaggtgagcaaggtgctgtacaagcagaactgggaggacaccaaggacaagtacctgctgccccccgacgcccccgagctggtgcaggccgtgaagaacaccgccatgttcagcaagaagctgtacaccgaggactgggaggccgacaagagcctgttctacccctacaacgacagccccgagctgagaagagtggcccaggcccagaaggccctgagcgacgtggcctacaagaagggcctggccgagcagcaggcccagttcacccccctggccgacccccccgacatcgagttcgccaagaaggtgaccaaccaggtgagcaagcagaaggagaagaagagaaagaagaagagaaagaaggtgtag

SEQ ID NO: 90533 - DNA, 1317 bp, Artificial Sequence
  Description of Artificial Sequence: Synthetic coding sequence
atgatgagagtgaagcagacccaggaccacatcagcagcgtgaagtacaaggaggccatcggccagggcacccccatccccgacctgcccgaggtgaagagagtgaaggagacccagaagcacatcagcagcgtgatgtacaaggagaacctgggcaccggcatccccaccaccgtgacccccgagatcgagagagtgaagagaaaccaggagaacttcagcagcgtgctgtacaaggagaacatgggcaagggcacccccctggccgtgacccccgagatggagagagtgaagcacaaccaggagaacatcagcagcgtgctgtacaaggagaacgtgggcaaggccaccgccacccccgtgacccccgagatgcagagagtgaagagaaaccaggagaacatcagcagcgtgctgtacaaggagaacatgagaaaggccacccccacccccgtgacccccgagatggagagagccaagagaaaccaggagaacatcagcagcgtgctgtacagcgacagcttcagaaagcagatccagggcaaggccgcctacgtgctggacacccccgagatgagaagagtgagagagacccagagacacatcagcaccgtgaagtaccacgaggacttcgagaagcacaagggctgcttcacccccgtggtgaccgaccccatcaccgagagagtgaagaagaacatgcaggacttcagcgacatcaactacagaggcatccagagaaaggtggtggagatggagcagaagagaaacgaccaggaccaggagaccatcaccggcctgagagtgtggagaaccaaccccggcagcgtgttcgactacgaccccgccgaggacaacatccagagcagaagcctgcacatgatcaacgtgcaggcccagagaagaagcagagagcagagcagaagcgccagcgccctgagcatcagcggcggcgaggagaagagcgagcacagcgaggcccccgaccaccacctgagcacctacagcgacggcggcgtgttcgccgtgagcaccgcctacaagcacgccaagaccaccgagctgccccagcagagaagcagcagcgtggccacccagcagaccaccgtgagcagcatccccagccaccccagcaccgccggcaagatcttcagagccatgtacgactacatggccgccgacgccgacgaggtgagcttcaaggacggcgacgccatcatcaacgtgcaggccatcgacgagggctggatgtacggcaccgtgcagagaaccggcagaaccggcatgctgcccgccaactacgtggaggccatctag

SEQ ID NO: 90534 - DNA, 1014 bp, Artificial Sequence
  Description of Artificial Sequence: Synthetic coding sequence
cagaagtacaaggaggactacgagaacaagatcaagggcaagtggagcgagaccccctgcttcgaggtggccaacgccagaatgaacgccgacaacatcagcaccagaaagtaccaggaggacttcgagaacatgaaggaccagatctacttcatgcagaccgagacccccgagtacaagatgaacaagaaggccggcgtggccgccagcaaggtgaagtacaaggaggactacgagaagaacaagggcaaggccgactacaacgtgctgcccgccagcgagaacccccagctgagacagctgaaggccgccggcgacgccctgagcgacaagctgtacaaggagaactacgagaagaccaaggccaagagcatcaactactgcgagacccccaagttcaagctggacaccgtgctgcagaacttcagcagcgacaagaagtacaaggacagctacctgaaggacatcctgggccactacgtgggcagcttcgaggacccctaccacagccactgcatgaaggtgaccgcccagaacagcgacaagaactacaaggccgagtacgaggaggacagaggcaagggcttcttcccccagaccatcacccaggagtacgaggccatcaagaagctggaccagtgcaaggaccacacctacaaggtgcaccccgacaagaccaagttcacccaggtgaccgacagccccgtgctgctgcaggcccaggtgaacagcaagcagctgagcgacctgaactacaaggccaagcacgagagcgagaagttcaagtgccacatcccccccgacacccccgccttcatccagcacaaggtgaacgcctacaacctgagcgacaacctgtacaagcaggactgggagaagagcaaggccaagaagttcgacatcaaggtggacgccatccccctgctggccgccaaggccaacaccaagaacaccagcgacgtgatgtacaagaaggactacgagaagaacaaggtgaaggtgcagcagagatag

SEQ ID NO: 90535 - DNA, 5193 bp, Artificial Sequence
  Description of Artificial Sequence: Synthetic coding sequence
atgaacgtgcagccctgcagcagatgcggctacggcgtgtaccccgccgagaagatcagctgcatcgaccagatctggcacaaggcctgcttccactgcgaggtgtgcaagatgatgctgagcgtgaacaacttcgtgagccaccagaagaagccctactgccacgcccacaaccccaagaacaacaccttcaccagcgtgtaccacacccccctgaacctgaacgtgagaaccttccccgaggccatcagcggcatccacgaccaggaggacggcgagcagtgcaagagcgtgttccactgggacatgaagagcaaggacaaggagggcgcccccaacagacagcccctggccaacgagagagcctactggaccggctacggcgagggcaacgcctggtgccccggcgccctgcccgaccccgagatcgtgagaatggtggaggccagaaagagcctgggcgaggagtacaccgaggactacgagcagcccagaggcaagggcagcttccccgccatgatcacccccgcctaccagagagccaagaaggccaaccagctggccagccaggtggagtacaagagaggccacgacgagagaatcagcagattcagcaccgtggtggacacccccgagctgctgagaagcaaggccggcgcccagctgcagagcgacgtgagatacaccgaggactacgagcagcagagaggcaagggcagcttccccgccatgatcacccccgcctaccagatcgccaagagagccaacgagctggccagcgacgtgagataccaccagcagtaccagaaggagatgagaggcatggccggccccgccatcggcgccgagggcatcctgaccagagagtgcgccgaccagtacggccagggctaccccgaggagtacgaggagcacagaggcaagggcagcttccccgccatgatcacccccgcctaccagaacgccaagaaggcccacgagctggccagcgacatcaagtacagacaggacttcaacaagatgaagggcgccgcccactaccacagcctgcccgcccaggacaacctggtgctgaagcaggcccagagcgtgaacaagctggtgagcgaggtggagtacaagaaggacctggagagcagcagaggccacagcatcaactactgcgagaccccccagttcagaaacgtgagcaagatcagcaagttcaccagcgacaacaagtacaaggagaactaccagaaccacatgagaggcagatacgagggcgtgggcatggacagaagaaccctgcacgccatgaaggtgggcagcctggccagcaacgtggcctacaaggccgactacaagcacgacatcgtggactacaactaccccgccaccctgacccccagctaccagaccgccatgaagctggtgcccctgaaggacgccaactacagacagagcatcgacaagctgaagtacagcagcgtgaccgacaccccccagatcgtgcaggccaagatcaacgcccagcagctgagccacgtgaactacagagccgactacgagaagaacaagctgaactacaccctgccccaggacgtgccccagctggtgaaggccaagaccaacgccaagctgttcagcgaggtgaagtacaaggagggctgggagaagaccaagggcaagggcttcgagatgaagctggacgccatgagcctgctggccgccaaggccagcggcgagctggccagcaacatcaagtacaaggaggagtacgagaagaccaagggcaaggccatgggcaccgccgacagcagactgctgcacagcctgcagatcgccaagatgagcagcgaggtggagtacaagaagggcttcgaggagagcaagaccagattccacctgcccatggacatggtgaacatcagacacgccaagaaggcccagaccctggccagcgacctggactacagaaagaagctgcacgagtacaccgtgctgcccgaggacatgaagacccagtgggccaagaaggcctacggcctgcagagcgagctgcagtacaaggccgacctggcctggatgaagggcgtgggctggctgaccgagggcagcctgaacctggagcaggccaagaaggccggccagctggtgagcgagaagaactacagacagagagtggacgagctgaagttcaccagcgtgaccgacagcagccagatggagcacgccaagaagagccaggagctgcagagcggcgtggcctacaaggccggcaacgagcagagcgtgcaccagtacaccatcagcaaggacgagcccctgttcctgcaggccagagccaacgccgccaacctgagcgagaagctgtacaagagcagctgggagaaccagaaggccaagggcttcgagctgagactggacagcctgaccttcctggccgccaaggccaagagagacctggccagcgaggtgaagtacaaggaggactacgagagaagcagaggcaagctgatcggcgccaaggacgtgcagggcgacagccagatgagccacagcctgcagatgagcaagctgcagagcgagctggagtacaagaagggcttcgaggacaccaagagccagtgccacgtgagcctggacatggtgcacctggtgcacgccagaaaggcccagcacctggccaccgacgtgggctacaagaccgccgagcaccacttcaccgccctgcccaccgacatgaaggtggagtgggccaagaaggcctacggcctgcagagcgacaaccagtacagagccgacgtgaagtggatgaagggcatgggctgggtggccaccggcagcctgaacgtggagcaggccaagaaggccggcgagctgatcagcgagaagaagtacagacagcaccccgacgccctgaagttcaccagcatcaaggacacccccgagatggtgcaggccagaatcagctacacccaggccgtggacagactgtacagagagcagggcgagaacatcaagcaccactacacccccaccgccgacctgcccgaggtgctgctggccaagctgaacgccatgaacatcagcgagaccagatacaaggagagctggagcaagctgagagacggcggctacaagctgagactggacgccctgcccttccaggccgccaaggccagcggcgagatcatcagcgactacaagtacaaggaggccttcgagaagatgaagggccagatgctgggcagcagaagcctggaggacgacatcagcctggcccacagcgtgtacgccaccagcctgcagagcgacgtgaactacaagaagggcttcgagcacagcaaggcccagttccacctgcccctggacatggccgccctggtgcacgccaagaaggcccagaccctggccagcaaccaggactacaagcaccccctgccccagtacaccagcctggccgaggacctgagactgagctgcgccaagaaggcccacaagctgcagagcgagaacctgtacagaagcgacctgaacttcatgagaggcgtggcctgcgtgatccccggcaccctggagatcgagggcagaaagaaggccagcgagctgatcagcgagagcaagtacagacagcacccccacagcttcaagtacaccgccgtgaccgacacccccaacctgctgcacgccaagttcagcaaccagatcaccaacgagagactgtacaaggccgccggcgaggacgccagacacgagtacaccatgaccctgggcctgcccgagttcatcagagccaagaccaacgccgccaacctgagcgacgccagatacaaggagagctggagaaacctgagagcccagggctacaagctgaccatcgaggccctgcccttccaggccgccagagccagcggcgacatcgccagcgacttcctgtacagacacgacttcgtgaaggagagaggcaagctgatcggcccccagagcgtgagagacgaccccagaatccagcactgcagaagaatgggccagctgcagagcgagctgcagtacagaagaggcgccaccagcagccaggcccagttccacctgcccatggacatggtgcacctggtgcacgccaagaacgcccaggccctggccagcgaccacgactacagaacccagtaccacaagttcaccgccctgcccgaggacctgaagatggcctgggccaagaaggcccacgccctgcagagcgagctgagatacaagagcgacctgatcggcatgaagggcatcggctggctggccctgagaagcccccagatggagagcgccaagaaggccggcgagctgatcagcgagaccaagtacagaaagaagcccgacagcatcaagttcaccaccgtggtggacagccccgacctggtgcacgccaagaacagctacatgcactgcaacgagagaatgtacagaagcggcgacgccgagagcctgcacagatacaccctgatccccgaccaccccgacttcaccagagccagactgaacgccctgcacctgagcgacaaggtgtacagaaacagctgggagcagaccagagccggcagctacgacttcagactggacgccatccccttccagaccgccagagccagcagagagatcgccagcgacttcagatacaaggaggccttcctgagagacagaggcctgcagatcggctacagaagcgtggacgacgaccccagaatgaagcacttcctgaacgtgggcagactgcagagcgacaacgagtacaagaaggacttcgccaagagcagaagccagttccacagcagcaccgaccagcccggcctgctgcaggccaagagaagccagcagctggccagcgacgtgcactacagacagcccctgccccagcccacctgcgaccccgagcagctgggcctgagacacgcccagaaggcccaccagctgcagagcgacgtgaagtacaagagcgacctgaacctgaccagaggcgtgggctggaccccccccggcagctacaaggtggagatggccagaagagccgccgagctggccaacgccagaggcctgggcctgcagggcgcctacagaggcgccgaggccgtggaggccggcgaccaccagagcggcgaggtgaaccccgacgccaccgagatcctgcacgtgaagaagaagaaggccctgctgctgtag

SEQ ID NO: 90536 - DNA, 5088 bp, Artificial Sequence
  Description of Artificial Sequence: Synthetic coding sequence
atgaacgtgcagccctgcagcagatgcggctacggcgtgtaccccgccgagaagatcagctgcatcgaccagatctggcacaaggcctgcttccactgcgaggtgtgcaagatgatgctgagcgtgaacaacttcgtgagccaccagaagaagccctactgccacgcccacaaccccaagaacaacaccttcaccagcgtgtaccacacccccctgaacctgaacgtgagaaccttccccgaggccatcagcggcatccacgaccaggaggacggcgagcagtgcaagagcgtgttccactgggacatgaagagcaaggacaaggagggcgcccccaacagacagcccctggccaacgagagagcctactggaccggctacggcgagggcaacgcctggtgccccggcgccctgcccgaccccgagatcgtgagaatggtggaggccagaaagagcctgggcgaggagtacaccgaggactacgagcagcccagaggcaagggcagcttccccgccatgatcacccccgcctaccagagagccaagaaggccaaccagctggccagccaggtggagtacaagagaggccacgacgagagaatcagcagattcagcaccgtggtggacacccccgagctgctgagaagcaaggccggcgcccagctgcagagcgacgtgagatacaccgaggactacgagcagcagagaggcaagggcagcttccccgccatgatcacccccgcctaccagatcgccaagagagccaacgagctggccagcgacgtgagataccaccagcagtaccagaaggagatgagaggcatggccggccccgccatcggcgccgagggcatcctgaccagagagtgcgccgaccagtacggccagggctaccccgaggagtacgaggagcacagaggcaagggcagcttccccgccatgatcacccccgcctaccagaacgccaagaaggcccacgagctggccagcgacatcaagtacagacaggacttcaacaagatgaagggcgccgcccactaccacagcctgcccgcccaggacaacctggtgctgaagcaggcccagagcgtgaacaagctggtgagcgagaacaagtacaaggagaactaccagaaccacatgagaggcagatacgagggcgtgggcatggacagaagaaccctgcacgccatgaaggtgggcagcctggccagcaacgtggcctacaaggccgactacaagcacgacatcgtggactacaactaccccgccaccctgacccccagctaccagaccgccatgaagctggtgcccctgaaggacgccaactacagacagagcatcgacaagctgaagtacagcagcgtgaccgacaccccccagatcgtgcaggccaagatcaacgcccagcagctgagccacgtgaactacagagccgactacgagaagaacaagctgaactacaccctgccccaggacgtgccccagctggtgaaggccaagaccaacgccaagctgttcagcgaggtgaagtacaaggagggctgggagaagaccaagggcaagggcttcgagatgaagctggacgccatgagcctgctggccgccaaggccagcggcgagctggccagcaacatcaagtacaaggaggagtacgagaagaccaagggcaaggccatgggcaccgccgacagcagactgctgcacagcctgcagatcgccaagatgagcagcgaggtggagtacaagaagggcttcgaggagagcaagaccagattccacctgcccatggacatggtgaacatcagacacgccaagaaggcccagaccctggccagcgacctggactacagaaagaagctgcacgagtacaccgtgctgcccgaggacatgaagacccagtgggccaagaaggcctacggcctgcagagcgagctgcagtacaaggccgacctggcctggatgaagggcgtgggctggctgaccgagggcagcctgaacctggagcaggccaagaaggccggccagctggtgagcgagaagaactacagacagagagtggacgagctgaagttcaccagcgtgaccgacagcagccagatggagcacgccaagaagagccaggagctgcagagcggcgtggcctacaaggccggcaacgagcagagcgtgcaccagtacaccatcagcaaggacgagcccctgttcctgcaggccagagccaacgccgccaacctgagcgagaagctgtacaagagcagctgggagaaccagaaggccaagggcttcgagctgagactggacagcctgaccttcctggccgccaaggccaagagagacctggccagcgaggtgaagtacaaggaggactacgagagaagcagaggcaagctgatcggcgccaaggacgtgcagggcgacagccagatgagccacagcctgcagatgagcaagctgcagagcgagctggagtacaagaagggcttcgaggacaccaagagccagtgccacgtgagcctggacatggtgcacctggtgcacgccagaaaggcccagcacctggccaccgacgtgggctacaagaccgccgagcaccacttcaccgccctgcccaccgacatgaaggtggagtgggccaagaaggcctacggcctgcagagcgacaaccagtacagagccgacgtgaagtggatgaagggcatgggctgggtggccaccggcagcctgaacgtggagcaggccaagaaggccggcgagctgatcagcgagaagaagtacagacagcaccccgacgccctgaagttcaccagcatcaaggacacccccgagatggtgcaggccagaatcagctacacccaggccgtggacagactgtacagagagcagggcgagaacatcaagcaccactacacccccaccgccgacctgcccgaggtgctgctggccaagctgaacgccatgaacatcagcgagaccagatacaaggagagctggagcaagctgagagacggcggctacaagctgagactggacgccctgcccttccaggccgccaaggccagcggcgagatcatcagcgactacaagtacaaggaggccttcgagaagatgaagggccagatgctgggcagcagaagcctggaggacgacatcagcctggcccacagcgtgtacgccaccagcctgcagagcgacgtgaactacaagaagggcttcgagcacagcaaggcccagttccacctgcccctggacatggccgccctggtgcacgccaagaaggcccagaccctggccagcaaccaggactacaagcaccccctgccccagtacaccagcctggccgaggacctgagactgagctgcgccaagaaggcccacaagctgcagagcgagaacctgtacagaagcgacctgaacttcatgagaggcgtggcctgcgtgatccccggcaccctggagatcgagggcagaaagaaggccagcgagctgatcagcgagagcaagtacagacagcacccccacagcttcaagtacaccgccgtgaccgacacccccaacctgctgcacgccaagttcagcaaccagatcaccaacgagagactgtacaaggccgccggcgaggacgccagacacgagtacaccatgaccctgggcctgcccgagttcatcagagccaagaccaacgccgccaacctgagcgacgccagatacaaggagagctggagaaacctgagagcccagggctacaagctgaccatcgaggccctgcccttccaggccgccagagccagcggcgacatcgccagcgacttcctgtacagacacgacttcgtgaaggagagaggcaagctgatcggcccccagagcgtgagagacgaccccagaatccagcactgcagaagaatgggccagctgcagagcgagctgcagtacagaagaggcgccaccagcagccaggcccagttccacctgcccatggacatggtgcacctggtgcacgccaagaacgcccaggccctggccagcgaccacgactacagaacccagtaccacaagttcaccgccctgcccgaggacctgaagatggcctgggccaagaaggcccacgccctgcagagcgagctgagatacaagagcgacctgatcggcatgaagggcatcggctggctggccctgagaagcccccagatggagagcgccaagaaggccggcgagctgatcagcgagaccaagtacagaaagaagcccgacagcatcaagttcaccaccgtggtggacagccccgacctggtgcacgccaagaacagctacatgcactgcaacgagagaatgtacagaagcggcgacgccgagagcctgcacagatacaccctgatccccgaccaccccgacttcaccagagccagactgaacgccctgcacctgagcgacaaggtgtacagaaacagctgggagcagaccagagccggcagctacgacttcagactggacgccatccccttccagaccgccagagccagcagagagatcgccagcgacttcagatacaaggaggccttcctgagagacagaggcctgcagatcggctacagaagcgtggacgacgaccccagaatgaagcacttcctgaacgtgggcagactgcagagcgacaacgagtacaagaaggacttcgccaagagcagaagccagttccacagcagcaccgaccagcccggcctgctgcaggccaagagaagccagcagctggccagcgacgtgcactacagacagcccctgccccagcccacctgcgaccccgagcagctgggcctgagacacgcccagaaggcccaccagctgcagagcgacgtgaagtacaagagcgacctgaacctgaccagaggcgtgggctggaccccccccggcagctacaaggtggagatggccagaagagccgccgagctggccaacgccagaggcctgggcctgcagggcgcctacagaggcgccgaggccgtggaggccggcgaccaccagagcggcgaggtgaaccccgacgccaccgagatcctgcacgtgaagaagaagaaggccctgctgctgtag

SEQ ID NO: 90537 - DNA, 2559 bp, Artificial Sequence
  Description of Artificial Sequence: Synthetic coding sequence
atgagaggcatggccggccccgccatcggcgccgagggcatcctgaccagagagtgcgccgaccagtacggccagggctaccccgaggagtacgaggagcacagaggcaagggcagcttccccgccatgatcacccccgcctaccagaacgccaagaaggcccacgagctggccagcgacatcaagtacagacaggacttcaacaagatgaagggcgccgcccactaccacagcctgcccgcccaggacaacctggtgctgaagcaggcccagagcgtgaacaagctggtgagcgaggtggagtacaagaaggacctggagagcagcagaggccacagcatcaactactgcgagaccccccagttcagaaacgtgagcaagatcagcaagttcaccagcgacaacaagtacaaggagaactaccagaaccacatgagaggcagatacgagggcgtgggcatggacagaagaaccctgcacgccatgaaggtgggcagcctggccagcaacgtggcctacaaggccgactacaagcacgacatcgtggactacaactaccccgccaccctgacccccagctaccagaccgccatgaagctggtgcccctgaaggacgccaactacagacagagcatcgacaagctgaagtacagcagcgtgaccgacaccccccagatcgtgcaggccaagatcaacgcccagcagctgagccacgtgaactacagagccgactacgagaagaacaagctgaactacaccctgccccaggacgtgccccagctggtgaaggccaagaccaacgccaagctgttcagcgaggtgaagtacaaggagggctgggagaagaccaagggcaagggcttcgagatgaagctggacgccatgagcctgctggccgccaaggccagcggcgagctggccagcaacgtgcacctgctgctgagcctgaagatcaagtacaaggaggagtacgagaagaccaagggcaaggccatgggcaccgccgacagcagactgctgcacagcctgcagatcgccaagatgagcagcgaggtggagtacaagaagggcttcgaggagagcaagaccagattccacctgcccatggacatgggcgtgggctggctgaccgagggcagcctgaacctggagcaggccaagaaggccggccagctggtgagcgagaagaactacagacagagagtggacgagctgaagttcaccagcgtgaccgacagcagccagatggagcacgccaagaagagccaggagctgcagagcggcgtggcctacaaggccggcaacgagcagagcgtgcaccagtacaccatcagcaaggacgagcccctgttcctgcaggccagagccaacgccgccaacctgagcgagttcctgtacagacacgacttcgtgaaggagagaggcaagctgatcggcccccagagcgtgagagacgaccccagaatccagcactgcagaagaatgggccagctgcagagcgagctgcagtacagaagaggcgccaccagcagccaggcccagttccacctgcccatggacatggtgcacctggtgcacgccaagaacgcccaggccctggccagcgaccacgactacagaacccagtaccacaagttcaccgccctgcccgaggacctgaagatggcctgggccaagaaggcccacgccctgcagagcgagctgagatacaagagcgacctgatcggcatgaagggcatcggctggctggccctgagaagcccccagatggagagcgccaagaaggccggcgagctgatcagcgagaccaagtacagaaagaagcccgacagcatcaagttcaccaccgtggtggacagccccgacctggtgcacgccaagaacagctacatgcactgcaacgagagaatgtacagaagcggcgacgccgagagcctgcacagatacaccctgatccccgaccaccccgacttcaccagagccagactgaacgccctgcacctgagcgacttcagatacaaggaggccttcctgagagacagaggcctgcagatcggctacagaagcgtggacgacgaccccagaatgaagcacttcctgaacgtgggcagactgcagagcgacaacgagtacaagaaggacttcgccaagagcagaagccagttccacagcagcaccgaccagcccggcctgctgcaggccaagagaagccagcagctggccagcgacgtgcactacagacagcccctgccccagcccacctgcgaccccgagcagctgggcctgagacacgcccagaaggcccaccagctgcagagcgacgtgaagtacaagagcgacctgaacctgaccagaggcgtgggctggaccccccccggcagctacaaggtggagatggccagaagagccgccgagctggccaacgccagaggcctgggcctgcagggcgcctacagaggcgccgaggccgtggaggccggcgaccaccagagcggcgaggtgaaccccgacgccaccgagatcctgcacgtgaagaagaagaaggccctgctgctgtag

SEQ ID NO: 90538 - DNA, 5217 bp, Artificial Sequence
  Description of Artificial Sequence: Synthetic coding sequence
atgaacgtgcagccctgcagcagatgcggctacggcgtgtaccccgccgagaagatcagctgcatcgaccagatctggcacaaggcctgcttccactgcgaggtgtgcaagatgatgctgagcgtgaacaacttcgtgagccaccagaagaagccctactgccacgcccacaaccccaagaacaacaccttcaccagcgtgtaccacacccccctgaacctgaacgtgagaaccttccccgaggccatcagcggcatccacgaccaggaggacggcgagcagtgcaagagcgtgttccactgggacatgaagagcaaggacaaggagggcgcccccaacagacagcccctggccaacgagagagcctactggaccggctacggcgagggcaacgcctggtgccccggcgccctgcccgaccccgagatcgtgagaatggtggaggccagaaagagcctgggcgaggagtacaccgaggactacgagcagcccagaggcaagggcagcttccccgccatgatcacccccgcctaccagagagccaagaaggccaaccagctggccagccaggtggagtacaagagaggccacgacgagagaatcagcagattcagcaccgtggtggacacccccgagctgctgagaagcaaggccggcgcccagctgcagagcgacgtgagatacaccgaggactacgagcagcagagaggcaagggcagcttccccgccatgatcacccccgcctaccagatcgccaagagagccaacgagctggccagcgacgtgagataccaccagcagtaccagaaggagatgagaggcatggccggccccgccatcggcgccgagggcatcctgaccagagagtgcgccgaccagtacggccagggctaccccgaggagtacgaggagcacagaggcaagggcagcttccccgccatgatcacccccgcctaccagaacgccaagaaggcccacgagctggccagcgacatcaagtacagacaggacttcaacaagatgaagggcgccgcccactaccacagcctgcccgcccaggacaacctggtgctgaagcaggcccagagcgtgaacaagctggtgagcgaggtggagtacaagaaggacctggagagcagcagaggccacagcatcaactactgcgagaccccccagttcagaaacgtgagcaagatcagcaagttcaccagcgacaacaagtacaaggagaactaccagaaccacatgagaggcagatacgagggcgtgggcatggacagaagaaccctgcacgccatgaaggtgggcagcctggccagcaacgtggcctacaaggccgactacaagcacgacatcgtggactacaactaccccgccaccctgacccccagctaccagaccgccatgaagctggtgcccctgaaggacgccaactacagacagagcatcgacaagctgaagtacagcagcgtgaccgacaccccccagatcgtgcaggccaagatcaacgcccagcagctgagccacgtgaactacagagccgactacgagaagaacaagctgaactacaccctgccccaggacgtgccccagctggtgaaggccaagaccaacgccaagctgttcagcgaggtgaagtacaaggagggctgggagaagaccaagggcaagggcttcgagatgaagctggacgccatgagcctgctggccgccaaggccagcggcgagctggccagcaacgtgcacctgctgctgagcctgaagatcaagtacaaggaggagtacgagaagaccaagggcaaggccatgggcaccgccgacagcagactgctgcacagcctgcagatcgccaagatgagcagcgaggtggagtacaagaagggcttcgaggagagcaagaccagattccacctgcccatggacatggtgaacatcagacacgccaagaaggcccagaccctggccagcgacctggactacagaaagaagctgcacgagtacaccgtgctgcccgaggacatgaagacccagtgggccaagaaggcctacggcctgcagagcgagctgcagtacaaggccgacctggcctggatgaagggcgtgggctggctgaccgagggcagcctgaacctggagcaggccaagaaggccggccagctggtgagcgagaagaactacagacagagagtggacgagctgaagttcaccagcgtgaccgacagcagccagatggagcacgccaagaagagccaggagctgcagagcggcgtggcctacaaggccggcaacgagcagagcgtgcaccagtacaccatcagcaaggacgagcccctgttcctgcaggccagagccaacgccgccaacctgagcgagaagctgtacaagagcagctgggagaaccagaaggccaagggcttcgagctgagactggacagcctgaccttcctggccgccaaggccaagagagacctggccagcgaggtgaagtacaaggaggactacgagagaagcagaggcaagctgatcggcgccaaggacgtgcagggcgacagccagatgagccacagcctgcagatgagcaagctgcagagcgagctggagtacaagaagggcttcgaggacaccaagagccagtgccacgtgagcctggacatggtgcacctggtgcacgccagaaaggcccagcacctggccaccgacgtgggctacaagaccgccgagcaccacttcaccgccctgcccaccgacatgaaggtggagtgggccaagaaggcctacggcctgcagagcgacaaccagtacagagccgacgtgaagtggatgaagggcatgggctgggtggccaccggcagcctgaacgtggagcaggccaagaaggccggcgagctgatcagcgagaagaagtacagacagcaccccgacgccctgaagttcaccagcatcaaggacacccccgagatggtgcaggccagaatcagctacacccaggccgtggacagactgtacagagagcagggcgagaacatcaagcaccactacacccccaccgccgacctgcccgaggtgctgctggccaagctgaacgccatgaacatcagcgagaccagatacaaggagagctggagcaagctgagagacggcggctacaagctgagactggacgccctgcccttccaggccgccaaggccagcggcgagatcatcagcgactacaagtacaaggaggccttcgagaagatgaagggccagatgctgggcagcagaagcctggaggacgacatcagcctggcccacagcgtgtacgccaccagcctgcagagcgacgtgaactacaagaagggcttcgagcacagcaaggcccagttccacctgcccctggacatggccgccctggtgcacgccaagaaggcccagaccctggccagcaaccaggactacaagcaccccctgccccagtacaccagcctggccgaggacctgagactgagctgcgccaagaaggcccacaagctgcagagcgagaacctgtacagaagcgacctgaacttcatgagaggcgtggcctgcgtgatccccggcaccctggagatcgagggcagaaagaaggccagcgagctgatcagcgagagcaagtacagacagcacccccacagcttcaagtacaccgccgtgaccgacacccccaacctgctgcacgccaagttcagcaaccagatcaccaacgagagactgtacaaggccgccggcgaggacgccagacacgagtacaccatgaccctgggcctgcccgagttcatcagagccaagaccaacgccgccaacctgagcgacgccagatacaaggagagctggagaaacctgagagcccagggctacaagctgaccatcgaggccctgcccttccaggccgccagagccagcggcgacatcgccagcgacttcctgtacagacacgacttcgtgaaggagagaggcaagctgatcggcccccagagcgtgagagacgaccccagaatccagcactgcagaagaatgggccagctgcagagcgagctgcagtacagaagaggcgccaccagcagccaggcccagttccacctgcccatggacatggtgcacctggtgcacgccaagaacgcccaggccctggccagcgaccacgactacagaacccagtaccacaagttcaccgccctgcccgaggacctgaagatggcctgggccaagaaggcccacgccctgcagagcgagctgagatacaagagcgacctgatcggcatgaagggcatcggctggctggccctgagaagcccccagatggagagcgccaagaaggccggcgagctgatcagcgagaccaagtacagaaagaagcccgacagcatcaagttcaccaccgtggtggacagccccgacctggtgcacgccaagaacagctacatgcactgcaacgagagaatgtacagaagcggcgacgccgagagcctgcacagatacaccctgatccccgaccaccccgacttcaccagagccagactgaacgccctgcacctgagcgacaaggtgtacagaaacagctgggagcagaccagagccggcagctacgacttcagactggacgccatccccttccagaccgccagagccagcagagagatcgccagcgacttcagatacaaggaggccttcctgagagacagaggcctgcagatcggctacagaagcgtggacgacgaccccagaatgaagcacttcctgaacgtgggcagactgcagagcgacaacgagtacaagaaggacttcgccaagagcagaagccagttccacagcagcaccgaccagcccggcctgctgcaggccaagagaagccagcagctggccagcgacgtgcactacagacagcccctgccccagcccacctgcgaccccgagcagctgggcctgagacacgcccagaaggcccaccagctgcagagcgacgtgaagtacaagagcgacctgaacctgaccagaggcgtgggctggaccccccccggcagctacaaggtggagatggccagaagagccgccgagctggccaacgccagaggcctgggcctgcagggcgcctacagaggcgccgaggccgtggaggccggcgaccaccagagcggcgaggtgaaccccgacgccaccgagatcctgcacgtgaagaagaagaaggccctgctgctgtag

SEQ ID NO: 90539 - DNA, 5112 bp, Artificial Sequence
  Description of Artificial Sequence: Synthetic coding sequence
atgaacgtgcagccctgcagcagatgcggctacggcgtgtaccccgccgagaagatcagctgcatcgaccagatctggcacaaggcctgcttccactgcgaggtgtgcaagatgatgctgagcgtgaacaacttcgtgagccaccagaagaagccctactgccacgcccacaaccccaagaacaacaccttcaccagcgtgtaccacacccccctgaacctgaacgtgagaaccttccccgaggccatcagcggcatccacgaccaggaggacggcgagcagtgcaagagcgtgttccactgggacatgaagagcaaggacaaggagggcgcccccaacagacagcccctggccaacgagagagcctactggaccggctacggcgagggcaacgcctggtgccccggcgccctgcccgaccccgagatcgtgagaatggtggaggccagaaagagcctgggcgaggagtacaccgaggactacgagcagcccagaggcaagggcagcttccccgccatgatcacccccgcctaccagagagccaagaaggccaaccagctggccagccaggtggagtacaagagaggccacgacgagagaatcagcagattcagcaccgtggtggacacccccgagctgctgagaagcaaggccggcgcccagctgcagagcgacgtgagatacaccgaggactacgagcagcagagaggcaagggcagcttccccgccatgatcacccccgcctaccagatcgccaagagagccaacgagctggccagcgacgtgagataccaccagcagtaccagaaggagatgagaggcatggccggccccgccatcggcgccgagggcatcctgaccagagagtgcgccgaccagtacggccagggctaccccgaggagtacgaggagcacagaggcaagggcagcttccccgccatgatcacccccgcctaccagaacgccaagaaggcccacgagctggccagcgacatcaagtacagacaggacttcaacaagatgaagggcgccgcccactaccacagcctgcccgcccaggacaacctggtgctgaagcaggcccagagcgtgaacaagctggtgagcgagaacaagtacaaggagaactaccagaaccacatgagaggcagatacgagggcgtgggcatggacagaagaaccctgcacgccatgaaggtgggcagcctggccagcaacgtggcctacaaggccgactacaagcacgacatcgtggactacaactaccccgccaccctgacccccagctaccagaccgccatgaagctggtgcccctgaaggacgccaactacagacagagcatcgacaagctgaagtacagcagcgtgaccgacaccccccagatcgtgcaggccaagatcaacgcccagcagctgagccacgtgaactacagagccgactacgagaagaacaagctgaactacaccctgccccaggacgtgccccagctggtgaaggccaagaccaacgccaagctgttcagcgaggtgaagtacaaggagggctgggagaagaccaagggcaagggcttcgagatgaagctggacgccatgagcctgctggccgccaaggccagcggcgagctggccagcaacgtgcacctgctgctgagcctgaagatcaagtacaaggaggagtacgagaagaccaagggcaaggccatgggcaccgccgacagcagactgctgcacagcctgcagatcgccaagatgagcagcgaggtggagtacaagaagggcttcgaggagagcaagaccagattccacctgcccatggacatggtgaacatcagacacgccaagaaggcccagaccctggccagcgacctggactacagaaagaagctgcacgagtacaccgtgctgcccgaggacatgaagacccagtgggccaagaaggcctacggcctgcagagcgagctgcagtacaaggccgacctggcctggatgaagggcgtgggctggctgaccgagggcagcctgaacctggagcaggccaagaaggccggccagctggtgagcgagaagaactacagacagagagtggacgagctgaagttcaccagcgtgaccgacagcagccagatggagcacgccaagaagagccaggagctgcagagcggcgtggcctacaaggccggcaacgagcagagcgtgcaccagtacaccatcagcaaggacgagcccctgttcctgcaggccagagccaacgccgccaacctgagcgagaagctgtacaagagcagctgggagaaccagaaggccaagggcttcgagctgagactggacagcctgaccttcctggccgccaaggccaagagagacctggccagcgaggtgaagtacaaggaggactacgagagaagcagaggcaagctgatcggcgccaaggacgtgcagggcgacagccagatgagccacagcctgcagatgagcaagctgcagagcgagctggagtacaagaagggcttcgaggacaccaagagccagtgccacgtgagcctggacatggtgcacctggtgcacgccagaaaggcccagcacctggccaccgacgtgggctacaagaccgccgagcaccacttcaccgccctgcccaccgacatgaaggtggagtgggccaagaaggcctacggcctgcagagcgacaaccagtacagagccgacgtgaagtggatgaagggcatgggctgggtggccaccggcagcctgaacgtggagcaggccaagaaggccggcgagctgatcagcgagaagaagtacagacagcaccccgacgccctgaagttcaccagcatcaaggacacccccgagatggtgcaggccagaatcagctacacccaggccgtggacagactgtacagagagcagggcgagaacatcaagcaccactacacccccaccgccgacctgcccgaggtgctgctggccaagctgaacgccatgaacatcagcgagaccagatacaaggagagctggagcaagctgagagacggcggctacaagctgagactggacgccctgcccttccaggccgccaaggccagcggcgagatcatcagcgactacaagtacaaggaggccttcgagaagatgaagggccagatgctgggcagcagaagcctggaggacgacatcagcctggcccacagcgtgtacgccaccagcctgcagagcgacgtgaactacaagaagggcttcgagcacagcaaggcccagttccacctgcccctggacatggccgccctggtgcacgccaagaaggcccagaccctggccagcaaccaggactacaagcaccccctgccccagtacaccagcctggccgaggacctgagactgagctgcgccaagaaggcccacaagctgcagagcgagaacctgtacagaagcgacctgaacttcatgagaggcgtggcctgcgtgatccccggcaccctggagatcgagggcagaaagaaggccagcgagctgatcagcgagagcaagtacagacagcacccccacagcttcaagtacaccgccgtgaccgacacccccaacctgctgcacgccaagttcagcaaccagatcaccaacgagagactgtacaaggccgccggcgaggacgccagacacgagtacaccatgaccctgggcctgcccgagttcatcagagccaagaccaacgccgccaacctgagcgacgccagatacaaggagagctggagaaacctgagagcccagggctacaagctgaccatcgaggccctgcccttccaggccgccagagccagcggcgacatcgccagcgacttcctgtacagacacgacttcgtgaaggagagaggcaagctgatcggcccccagagcgtgagagacgaccccagaatccagcactgcagaagaatgggccagctgcagagcgagctgcagtacagaagaggcgccaccagcagccaggcccagttccacctgcccatggacatggtgcacctggtgcacgccaagaacgcccaggccctggccagcgaccacgactacagaacccagtaccacaagttcaccgccctgcccgaggacctgaagatggcctgggccaagaaggcccacgccctgcagagcgagctgagatacaagagcgacctgatcggcatgaagggcatcggctggctggccctgagaagcccccagatggagagcgccaagaaggccggcgagctgatcagcgagaccaagtacagaaagaagcccgacagcatcaagttcaccaccgtggtggacagccccgacctggtgcacgccaagaacagctacatgcactgcaacgagagaatgtacagaagcggcgacgccgagagcctgcacagatacaccctgatccccgaccaccccgacttcaccagagccagactgaacgccctgcacctgagcgacaaggtgtacagaaacagctgggagcagaccagagccggcagctacgacttcagactggacgccatccccttccagaccgccagagccagcagagagatcgccagcgacttcagatacaaggaggccttcctgagagacagaggcctgcagatcggctacagaagcgtggacgacgaccccagaatgaagcacttcctgaacgtgggcagactgcagagcgacaacgagtacaagaaggacttcgccaagagcagaagccagttccacagcagcaccgaccagcccggcctgctgcaggccaagagaagccagcagctggccagcgacgtgcactacagacagcccctgccccagcccacctgcgaccccgagcagctgggcctgagacacgcccagaaggcccaccagctgcagagcgacgtgaagtacaagagcgacctgaacctgaccagaggcgtgggctggaccccccccggcagctacaaggtggagatggccagaagagccgccgagctggccaacgccagaggcctgggcctgcagggcgcctacagaggcgccgaggccgtggaggccggcgaccaccagagcggcgaggtgaaccccgacgccaccgagatcctgcacgtgaagaagaagaaggccctgctgctgtag

SEQ ID NO: 90540 - DNA, 828 bp, Artificial Sequence
  Description of Artificial Sequence: Synthetic coding sequence
atggccaccgagctggagtacgagagcgtgctgtgcgtgaagcccgacgtgagcgtgtacagaatcccccccagagccagcaacagaggctacagagccagcgactggaagctggaccagcccgactggaccggcagactgagaatcaccagcaagggcaagaccgcctacatcaagctggaggacaaggtgagcggcgagctgttcgcccaggcccccgtggagcagtaccccggcatcgccgtggagaccgtgaccgacagcagcagatacttcgtgatcagaatccaggacggcaccggcagaagcgccttcatcggcatcggcttcaccgacagaggcgacgccttcgacttcaacgtgagcctgcaggaccacttcaagtgggtgaagcaggagagcgagatcagcaaggagagccaggagatggacgccagacccaagctggacctgggcttcaaggagggccagaccatcaagctgtgcatcggcaacatcaccaacaagaagggcggcgccagcaagcccagaaccgccagaggcggcggcctgagcctgctgccccccccccccggcggcaaggtgaccatccccccccccagcagcagcgtggccatcagcaaccacgtgacccccccccccatccccaagagcaaccacggcggcagcgacgccgacatcctgctggacctggacagccccgcccccgtgaccacccccgcccccacccccgtgagcgtgagcaacgacctgtggggcgacttcagcaccgccagcagcagcgtgcccaaccaggccccccagcccagcaactgggtgcagttctag

SEQ ID NO: 90541 - DNA, 402 bp, Artificial Sequence
  Description of Artificial Sequence: Synthetic coding sequence
atggacgccagacccaagctggacctgggcttcaaggagggccagaccatcaagctgtgcatcggcaacatcaccaacaagaagggcggcgccagcaagcccagaaccgccagaggcggcggcctgagcctgctgccccccccccccggcggcaaggtgaccatccccccccccagcagcagcgtggccatcagcaaccacgtgacccccccccccatccccaagagcaaccacggcggcagcgacgccgacatcctgctggacctggacagccccgcccccgtgaccacccccgcccccacccccgtgagcgtgagcaacgacctgtggggcgacttcagcaccgccagcagcagcgtgcccaaccaggccccccagcccagcaactgggtgcagttctag

SEQ ID NO: 90542 - DNA, 828 bp, Artificial Sequence; identical to SEQ ID NO: 90540
  Description of Artificial Sequence: Synthetic coding sequence

SEQ ID NO: 90543 - DNA, 558 bp, Artificial Sequence
  Description of Artificial Sequence: Synthetic coding sequence
atggaggagagcggctacgagagcgtgctgtgcgtgaagcccgacgtgcacgtgtacagaatcccccccagagccaccaacagaggctacagagccgccgagtggcagctggaccagcccagctggagcggcagactgagaatcaccgccaagggccagatggcctacatcaagctggaggacagaaccagcggcgagctgttcgcccaggcccccgtggaccagttccccggcaccgccgtggagagcgtgaccgacagcagcagatacttcgtgatcagaatcgaggacggcaacggcagaagagccttcatcggcatcggcttcggcgacagaggcgacgccttcgacttcaacgtggccctgcaggaccacttcaagtgggtgaagcagcagtgcgagttcgccaagcaggcccagaaccccgaccagggccccaagctggacctgggcttcaaggagggccagaccatcaagctgaacatcgccgtgggcctgggcaacatcaacagaagatgcagctgcaccctggccaccgcccagagctgccactgctag

SEQ ID NO: 90544 - DNA, 792 bp, Artificial Sequence
  Description of Artificial Sequence: Synthetic coding sequence
atggaggagagcggctacgagagcgtgctgtgcgtgaagcccgacgtgcacgtgtacagaatcccccccagagccaccaacagaggctacagagccgccgagtggcagctggaccagcccagctggagcggcagactgagaatcaccgccaagggccagatggcctacatcaagctggaggacagaaccagcggcgagctgttcgcccaggcccccgtggaccagttccccggcaccgccgtggagagcgtgaccgacagcagcagatacttcgtgatcagaatcgaggacggcaacggcagaagagccttcatcggcatcggcttcggcgacagaggcgacgccttcgacttcaacgtggccctgcaggaccacttcaagtgggtgaagcagcagtgcgagttcgccaagcaggcccagaaccccgaccagggccccaagctggacctgggcttcaaggagggccagaccatcaagctgaacatcgccaacatgaagaagaaggagggcgccgccggcaaccccagagtgagacccgccagcaccggcggcctgagcctgctgccccccccccccggcggcaagaccagcaccctgatccccccccccggcgagcagctggccgtgggcggcagcctggtgcagcccgccgtggcccccagcagcggcggcgcccccgtgccctggccccagcccaaccccgccaccgccgacatctggggcgacttcaccaagagcaccggcagcaccagcagccagacccagcccggcaccggctgggtgcagttctag

SEQ ID NO: 90545 - DNA, 792 bp, Artificial Sequence; identical to SEQ ID NO: 90544
  Description of Artificial Sequence: Synthetic coding sequence

SEQ ID NO: 90546 - DNA, 822 bp, Artificial Sequence
  Description of Artificial Sequence: Synthetic coding sequence
atggaggagagcggctacgagagcgtgctgtgcgtgaagcccgacgtgcacgtgtacagaatcccccccagagccaccaacagaggctacagagccgccgagtggcagctggaccagcccagctggagcggcagactgagaatcaccgccaagggccagatggcctacatcaagctggaggacagaaccagcggcgagctgttcgcccaggcccccgtggaccagttccccggcaccgccgtggagagcgtgaccgacagcagcagatacttcgtgatcagaatcgaggacggcaacggcagaagagccttcatcggcatcggcttcggcgacagaggcgacgccttcgacttcaacgtggccctgcaggaccacttcaagtgggtgaagcagcagtgcgagttcgccaagcaggcccagaaccccgaccagggccccaagctggacctgggcttcaaggagggccagaccatcaagctgaacatcgccaacatgaagaagaaggagggcgccgccggcaaccccagagtgagacccgccagcaccggcggcctgagcctgctgccccccccccccggcggcaagaccagcaccctgatccccccccccggcgagcagctggccgtgggcggcagcctggtgcagcccgccgtggcccccagcagcgaccagctgcccgccagacccagccaggcccaggccggcagcagcagcgacctgagcaccgtgttcccccacgtgaccagcggcaaggccctgccccacctgggccagagaaaggaggacgaggccctgctgagctggcccgtgttcggcgcctag

SEQ ID NO: 90547 - DNA, 714 bp, Artificial Sequence
  Description of Artificial Sequence: Synthetic coding sequence
atggaggagagcggcgccgccgagtggcagctggaccagcccagctggagcggcagactgagaatcaccgccaagggccagatggcctacatcaagctggaggacagaaccagcggcgagctgttcgcccaggcccccgtggaccagttccccggcaccgccgtggagagcgtgaccgacagcagcagatacttcgtgatcagaatcgaggacggcaacggcagaagagccttcatcggcatcggcttcggcgacagaggcgacgccttcgacttcaacgtggccctgcaggaccacttcaagtgggtgaagcagcagtgcgagttcgccaagcaggcccagaaccccgaccagggccccaagctggacctgggcttcaaggagggccagaccatcaagctgaacatcgccaacatgaagaagaaggagggcgccgccggcaaccccagagtgagacccgccagcaccggcggcctgagcctgctgccccccccccccggcggcaagaccagcaccctgatccccccccccggcgagcagctggccgtgggcggcagcctggtgcagcccgccgtggcccccagcagcggcggcgcccccgtgccctggccccagcccaaccccgccaccgccgacatctggggcgacttcaccaagagcaccggcagcaccagcagccagacccagcccggcaccggctgggtgcagttctag

SEQ ID NO: 90548 - DNA, 792 bp, Artificial Sequence; identical to SEQ ID NO: 90544
  Description of Artificial Sequence: Synthetic coding sequence

SEQ ID NO: 90549 - DNA, 966 bp, Artificial Sequence
  Description of Artificial Sequence: Synthetic coding sequence
atgagcgagcagagcaaggacctgagcgaccccaacttcgccgccgaggcccccaacagcgaggtgcacagcagccccggcgtgagcgagggcgtgccccccagcgccaccctggccgagccccagagcccccccctgggccccaccgccgccccccaggccgccccccccccccaggcccccaacgacgagggcgaccccaaggccctgcagcaggccgccgaggagggcagagcccaccaggcccccagcgccgcccagcccggccccgccccccccgcccccgcccagctggtgcagaaggcccacgagctgatgtggtacgtgctggtgaaggaccagaagaagatgatcatctggttccccgacatggtgaaggacgtgatcggcagctacaagaagtggtgcagaagcatcctgagaagaaccagcctgatcctggccagagtgttcggcctgcacctgagactgaccagcctgcacaccatggagttcgccctggtgaaggccctggagcccgaggagctggacagagtggccctgagcaacagaatgcccatgaccggcctgctgctgatgatcctgagcctgatctacgtgaagggcagaggcgccagagagagcgccgtgtggaacgtgctgagaatcctgggcctgagaccctggaagaagcacagcaccttcggcgacgtgagaaagctgatcaccgaggagttcgtgcagatgaactacctgaagtaccagagagtgccctacgtggagccccccgagtacgagttcttctggggcagcagagccagcagagagatcaccaagatgcagatcatggagttcctggccagagtgttcaagaaggacccccaggcctggcccagcagatacagagaggccctggaggaggccagagccctgagagaggccaaccccaccgcccactaccccagaagcagcgtgagcgaggactag

SEQ ID NO: 90550 - DNA, 915 bp, Artificial Sequence
  Description of Artificial Sequence: Synthetic coding sequence
atgctgcagaagcccagaaacagaggcagaagcggcggccaggccgagagagacagagactggagccacagcggcaaccccggcgccagcagagccggcgaggacgccagagtgctgagagacggcttcgccgaggaggcccccagcaccagcagaggccccggcggcagccagggcagccagggccccagcccccagggcgccagaagagcccaggccgcccccgccgtgggccccagaagccagaagcagctggagctgaaggtgagcgagctggtgcagttcctgctgatcaaggaccagaagaagatccccatcaagagagccgacatcctgaagcacgtgatcggcgactacaaggacatcttccccgacctgttcaagagagccgccgagagactgcagtacgtgttcggctacaagctggtggagctggagcccaagagcaacacctacatcctgatcaacaccctggagcccgtggaggaggacgccgagatgagaggcgaccagggcacccccaccaccggcctgctgatgatcgtgctgggcctgatcttcatgaagggcaacaccatcaaggagaccgaggcctgggacttcctgagaagactgggcgtgtaccccaccaagaagcacctgatcttcggcgaccccaagaagctgatcaccgaggacttcgtgagacagagatacctggagtacagaagaatcccccacaccgaccccgtggactacgagttccagtggggccccagaaccaacctggagaccagcaagatgaaggtgctgaagttcgtggccaaggtgcacaaccaggaccccaaggactggcccgcccagtactgcgaggccctggccgacgaggagaacagagccagaccccagcccagcggccccgcccccagcagctag

SEQ ID NO: 90551 - DNA, 666 bp, Artificial Sequence
  Description of Artificial Sequence: Synthetic coding sequence
atggccctggccctggccgccctggccgccgtggagcccgcctgcggcagcagataccagcagctgcagaacgaggaggagagcggcgagcccgagcaggccgccggcgacgccccccccccctacagcagcatcagcgccgagagcgccgcctacttcgactacaaggacgagagcggcttccccaagccccccagctacaacgtggccaccaccctgcccagctacgacgaggccgagagaaccaaggccgaggccaccatccccctggtgcccggcagagacgaggacttcgtgggcagagacgacttcgacgacgccgaccagctgagaatcggcaacgacggcatcttcatgctgaccttcttcatggccttcctgttcaactggatcggcttcttcctgagcttctgcctgaccaccagcgccgccggcagatacggcgccatcagcggcttcggcctgagcctgatcaagtggatcctgatcgtgagattcagcacctacttccccggctacttcgacggccagtactggctgtggtgggtgttcctggtgctgggcttcctgctgttcctgagaggcttcatcaactacgccaaggtgagaaagatgcccgagaccttcagcaacctgcccagaaccagagtgctgttcatctactag

SEQ ID NO: 90552 - DNA, 462 bp, Artificial Sequence
  Description of Artificial Sequence: Synthetic coding sequence
atggccctggccctggccgccctggccgccgtggagcccgcctgcggcagcagataccagcagctgcagaacgaggaggagagcggcgagcccgagcaggccgccggcgacgccccccccccctacagcagcatcagcgccgagagcgccgcctacttcgactacaaggacgagagcggcttccccaagccccccagctacaacgtggccaccaccctgcccagctgcttctacgacatcagccacctgatcttcttcatcttctacctgagaaacatgaagaagaagtacaccaagatggtgaagctgctgcacaagagcgcccccgcccagagcgacagctgcaagtgccccttcatctgctgcgtgtgcatcagcagaatcagcatcggcagcagaagcggctaccagtacatcatgcacagaagcgtgggctgcctgaaggccaagcaggagaactag

SEQ ID NO: 90553 - DNA, 3138 bp, Artificial Sequence
  Description of Artificial Sequence: Synthetic coding sequence
atgcaccagaagacccccgagatctacagcgtggagctgagcggcaccaaggacatcgtgaagaccgacaagggcgacggcaaggagaagtacagaggcctgaagaacaactgcctggagctgaagaagaagaaccacaaggaggagttccagaaggagctgcacctggacgaccacaagctgagcaacagagagctggaggagaagtacggcaccgacatcatcatgggcctgagcagcaccagagccgccgagctgctggccagagacggccccaacagcctgaccccccccaagcagacccccgagatcgtgaagttcctgaagcagatggtgggcggcttcagcatcctgctgtgggtgggcgccttcctgtgctggatcgcctacggcatccagtacagcagcgacaagagcgccagcctgaacaacgtgtacctgggctgcgtgctgggcctggtggtgatcctgaccggcatcttcgcctactaccaggaggccaagagcaccaacatcatgagcagcttcaacaagatgatcccccagcaggccctggtgatcagagacagcgagaagaagaccatccccagcgagcagctggtggtgggcgacatcgtggaggtgaagggcggcgaccagatccccgccgacatcagagtgctgagcagccagggctgcagagtggacaacagcagcctgaccggcgagagcgagccccagcccagaagcagcgagttcacccacgagaaccccctggagaccaagaacatctgcttctacagcaccacctgcctggaggccagcaccagccccgtgggcaccgtgaccggcatggtgatcaacaccggcgacagaaccatcatcggccacatcgccagcctggccagcggcgtgggcaacgagaagacccccatcgccatcgagatcgagcacttcgtgcacatcgtggccggcgtggccgtgagcatcggcatcctgttcttcatcatcgccgtgagcctgaagtaccaggtgctggacagcatcatcttcctgatcggcatcatcgtggccaacgtgcccgagggcctgctggccaccgtgaccgtgaccctgagcctgaccgccaagagaatggccaagaagaactgcctggtgaagaacctggaggccgtggagaccctgggcagcaccagcatcatctgcagcgacaagaccggcaccctgacccagaacagaatgaccgtggcccacctgtggttcgacaaccagatcttcgtggccgacaccagcgaggaccacagcaaccaggtgttcgaccagagcagcagaacctgggccagcctgagcaagatcatcaccctgtgcaacagagccgagttcaagcccggccaggagaacgtgcccatcatgaagaaggccgtgatcggcgacgccagcgagaccgccctgctgaagttcagcgaggtgatcctgggcgacgtgatggagatcagaaagagaaacagaaaggtggccgagatccccttcaacagcaccaacaagttccagctgagcatccacgagatggacgacccccacggcaagagattcctgatggtgatgaagggcgcccccgagagaatcctggagaagtgcagcaccatcatgatcaacggcgaggagcaccccctggacaagagcaccgccaagaccttccacaccgcctacatggagctgggcggcctgggcgagagagtgctgggcttctgccacctgtacctgcccgccgacgagttccccgagacctacagcttcgacatcgacgccatgaacttccccaccagcaacctgtgcttcgtgggcctgctgagcatgatcgacccccccagaagcaccgtgcccgacgccgtgaccaagtgcagaagcgccggcatcaaggtgatcatggtgaccggcgaccaccccatcaccgccaaggccatcgccaagagcgtgggcatcatcagcgccaacagcgagaccgtggaggacatcgcccacagactgaacatcgccgtggagcaggtgaacaagagagacgccaaggccgccgtggtgaccggcatggagctgaaggacatgagcagcgagcagctggacgagatcctggccaactaccaggagatcgtgttcgccagaaccagcccccagcagaagctgatcatcgtggagggctgccagagacaggacgccgtggtggccgtgaccggcgacggcgtgaacgacagccccgccctgaagaaggccgacatcggcatcgccatgggcatcgccggcagcgacgccgccaagaacgccgccgacatggtgctgctggacgacaacttcgccagcatcgtgaccggcgtggaggagggcagactgatcttcgacaacctgaagaagaccatcgcctacagcctgaccaagaacatcgccgagctgtgccccttcctgatctacatcatcgtgggcctgcccctgcccatcggcaccatcaccatcctgttcatcgacctgggcaccgacatcatccccagcatcgccctggcctacgagaaggccgagagcgacatcatgaacagaaagcccagacacaagaacaaggacagactggtgaaccagcccctggccgtgtacagctacctgcacatcggcctgatgcaggccctgggcgccttcctggtgtacttcaccgtgtacgcccaggagggcttcctgcccagaaccctgatcaacctgagagtggagtgggagaaggactacgtgaacgacctgaaggacagctacggccaggagtggaccagataccagagagagtacctggagtggaccggctacaccgccttcttcgtgggcatcctggtgcagcagatcgccgacctgatcatcagaaagaccagaagaaacagcatcttccagcagggcctgttcagaaacaaggtgatctgggtgggcatcaccagccagatcatcatcggcctgatcctgagctacggcctgggcagcgtgaccgccctgagcttcaccatgctgagagcccagtactggttcgtggccgtgccccacgccatcctgatctgggtgtacgacgaggtgagaaagctgttcatcagactgtaccccggcagctggtgggacaagaacatgtactactag

SEQ ID NO: 90554 - DNA, 1605 bp, Artificial Sequence
  Description of Artificial Sequence: Synthetic coding sequence
atggcccagctgggcaagctgctgaaggagcagaagtacgacagacagctgagactgtggggcgaccacggccaggaggccctggagagcgcccacgtgtgcctgatcaacgccaccgccaccggcaccgagatcctgaagaacctggtgctgcccggcatcggcagcttcaccatcatcgacggcaaccaggtgagcggcgaggacgccggcaacaacttcttcctgcagagaagcagcatcggcaagaacagagccgaggccgccatggagttcctgcaggagctgaacagcgacgtgagcggcagcttcgtggaggagagccccgagaacctgctggacaacgaccccagcttcttctgcagattcaccgtggtggtggccacccagctgcccgagagcaccagcctgagactggccgacgtgctgtggaacagccagatccccctgctgatctgcagaacctacggcctggtgggctacatgagaatcatcatcaaggagcaccccgtgatcgagagccaccccgacaacgccctggaggacctgagactggacaagcccttccccgagctgagagagcacttccagagctacgacctggaccacatggagaagaaggaccacagccacaccccctggatcgtgatcatcgccaagtacctggcccagtggtacagcgagaccaacggcagaatccccaagacctacaaggagaaggaggacttcagagacctgatcagacagggcatcctgaagaacgagaacggcgcccccgaggacgaggagaacttcgaggaggccatcaagaacgtgaacaccgccctgaacaccacccagatccccagcagcatcgaggacatcttcaacgacgacagatgcatcaacatcaccaagcagacccccagcttctggatcctggccagagccctgaaggagttcgtggccaaggagggccagggcaacctgcccgtgagaggcaccatccccgacatgatcgccgacagcggcaagtacatcaagctgcagaacgtgtacagagagaaggccaagaaggacgccgccgccgtgggcaaccacgtggccaagctgctgcagagcatcggccaggcccccgagagcatcagcgagaaggagctgaagctgctgtgcagcaacagcgccttcctgagagtggtgagatgcagaagcctggccgaggagtacggcctggacaccatcaacaaggacgagatcatcagcagcatggacaaccccgacaacgagatcgtgctgtacctgatgctgagagccgtggacagattccacaagcagcagggcagataccccggcgtgagcaactaccaggtggaggaggacatcggcaagctgaagagctgcctgaccggcttcctgcaggagtacggcctgagcgtgatggtgaaggacgactacgtgcacgagttctgcagatacggcgccgccgagccccacaccatcgccgccttcctgggcggcgccgccgcccaggaggtgatcaagatcatcaccaagcagttcgtgatcttcaacaacacctacatctacagcggcatgagccagaccagcgccaccttccagctgtag

SEQ ID NO: 90555 - DNA, 1587 bp, Artificial Sequence
  Description of Artificial Sequence: Synthetic coding sequence
atggacgcccagcagaccaagaccaacgaggccagactgtggggcgaccacggccaggaggccctggagagcgcccacgtgtgcctgatcaacgccaccgccaccggcaccgagatcctgaagaacctggtgctgcccggcatcggcagcttcaccatcatcgacggcaaccaggtgagcggcgaggacgccggcaacaacttcttcctgcagagaagcagcatcggcaagaacagagccgaggccgccatggagttcctgcaggagctgaacagcgacgtgagcggcagcttcgtggaggagagccccgagaacctgctggacaacgaccccagcttcttctgcagattcaccgtggtggtggccacccagctgcccgagagcaccagcctgagactggccgacgtgctgtggaacagccagatccccctgctgatctgcagaacctacggcctggtgggctacatgagaatcatcatcaaggagcaccccgtgatcgagagccaccccgacaacgccctggaggacctgagactggacaagcccttccccgagctgagagagcacttccagagctacgacctggaccacatggagaagaaggaccacagccacaccccctggatcgtgatcatcgccaagtacctggcccagtggtacagcgagaccaacggcagaatccccaagacctacaaggagaaggaggacttcagagacctgatcagacagggcatcctgaagaacgagaacggcgcccccgaggacgaggagaacttcgaggaggccatcaagaacgtgaacaccgccctgaacaccacccagatccccagcagcatcgaggacatcttcaacgacgacagatgcatcaacatcaccaagcagacccccagcttctggatcctggccagagccctgaaggagttcgtggccaaggagggccagggcaacctgcccgtgagaggcaccatccccgacatgatcgccgacagcggcaagtacatcaagctgcagaacgtgtacagagagaaggccaagaaggacgccgccgccgtgggcaaccacgtggccaagctgctgcagagcatcggccaggcccccgagagcatcagcgagaaggagctgaagctgctgtgcagcaacagcgccttcctgagagtggtgagatgcagaagcctggccgaggagtacggcctggacaccatcaacaaggacgagatcatcagcagcatggacaaccccgacaacgagatcgtgctgtacctgatgctgagagccgtggacagattccacaagcagcagggcagataccccggcgtgagcaactaccaggtggaggaggacatcggcaagctgaagagctgcctgaccggcttcctgcaggagtacggcctgagcgtgatggtgaaggacgactacgtgcacgagttctgcagatacggcgccgccgagccccacaccatcgccgccttcctgggcggcgccgccgcccaggaggtgatcaagatcatcaccaagcagttcgtgatcttcaacaacacctacatctacagcggcatgagccagaccagcgccaccttccagctgtag

SEQ ID NO: 90556 - DNA, 1338 bp, Artificial Sequence
  Description of Artificial Sequence: Synthetic coding sequence
atggagttcctgcaggagctgaacagcgacgtgagcggcagcttcgtggaggagagccccgagaacctgctggacaacgaccccagcttcttctgcagattcaccgtggtggtggccacccagctgcccgagagcaccagcctgagactggccgacgtgctgtggaacagccagatccccctgctgatctgcagaacctacggcctggtgggctacatgagaatcatcatcaaggagcaccccgtgatcgagagccaccccgacaacgccctggaggacctgagactggacaagcccttccccgagctgagagagcacttccagagctacgacctggaccacatggagaagaaggaccacagccacaccccctggatcgtgatcatcgccaagtacctggcccagtggtacagcgagaccaacggcagaatccccaagacctacaaggagaaggaggacttcagagacctgatcagacagggcatcctgaagaacgagaacggcgcccccgaggacgaggagaacttcgaggaggccatcaagaacgtgaacaccgccctgaacaccacccagatccccagcagcatcgaggacatcttcaacgacgacagatgcatcaacatcaccaagcagacccccagcttctggatcctggccagagccctgaaggagttcgtggccaaggagggccagggcaacctgcccgtgagaggcaccatccccgacatgatcgccgacagcggcaagtacatcaagctgcagaacgtgtacagagagaaggccaagaaggacgccgccgccgtgggcaaccacgtggccaagctgctgcagagcatcggccaggcccccgagagcatcagcgagaaggagctgaagctgctgtgcagcaacagcgccttcctgagagtggtgagatgcagaagcctggccgaggagtacggcctggacaccatcaacaaggacgagatcatcagcagcatggacaaccccgacaacgagatcgtgctgtacctgatgctgagagccgtggacagattccacaagcagcagggcagataccccggcgtgagcaactaccaggtggaggaggacatcggcaagctgaagagctgcctgaccggcttcctgcaggagtacggcctgagcgtgatggtgaaggacgactacgtgcacgagttctgcagatacggcgccgccgagccccacaccatcgccgccttcctgggcggcgccgccgcccaggaggtgatcaagatcatcaccaagcagttcgtgatcttcaacaacacctacatctacagcggcatgagccagaccagcgccaccttccagctgtag

SEQ ID NO: 90557 - DNA, 2901 bp, Artificial Sequence
  Description of Artificial Sequence: Synthetic coding sequence
atggagccccaggtgaccctgaacgtgaccttcaagaacgagatccagagcttcctggtgagcgaccccgagaacaccacctgggccgacatcgaggccatggtgaaggtgagcttcgacctgaacaccatccagatcaagtacctggacgaggagaacgaggaggtgagcatcaacagccagggcgagtacgaggaggccctgaagatggccgtgaagcagggcaaccagctgcagatgcaggtgcacgagggccaccacgtggtggacgaggcccccccccccgtggtgggcgccaagagactggccgccagagccggcaagaagcccctggcccactacagcagcctggtgagagtgctgggcagcgacatgaagacccccgaggaccccgccgtgcagagcttccccctggtgccctgcgacaccgaccagccccaggacaagccccccgactggttcaccagctacctggagaccttcagagagcaggtggtgaacgagaccgtggagaagctggagcagaagctgcacgagaagctggtgctgcagaaccccagcctgggcagctgccccagcgaggtgagcatgcccaccagcgaggagaccctgttcctgcccgagaaccagttcagctggcacatcgcctgcaacaactgccagagaagaatcgtgggcgtgagataccagtgcagcctgtgccccagctacaacatctgcgaggactgcgaggccggcccctacggccacgacaccaaccacgtgctgctgaagctgagaagacccgtggtgggcagcagcgagcccttctgccacagcaagtacagcacccccagactgcccgccgccctggagcaggtgagactgcagaagcaggtggacaagaacttcctgaaggccgagaagcagagactgagagccgagaagaagcagagaaaggccgaggtgaaggagctgaagaagcagctgaagctgcacagaaagatccacctgtggaacagcatccacggcctgcagagccccaagagccccctgggcagacccgagagcctgctgcagagcaacaccctgatgctgcccctgcagccctgcaccagcgtgatgcccatgctgagcgccgccttcgtggacgagaacctgcccgacggcacccacctgcagcccggcaccaagttcatcaagcactggagaatgaagaacaccggcaacgtgaagtggagcgccgacaccaagctgaagttcatgtggggcaacctgaccctggccagcaccgagaagaaggacgtgctggtgccctgcctgaaggccggccacgtgggcgtggtgagcgtggagttcatcgcccccgccctggagggcacctacaccagccactggagactgagccacaagggccagcagttcggccccagagtgtggtgcagcatcatcgtggaccccttccccagcgaggagagccccgacaacatcgagaagggcatgatcagcagcagcaagaccgacgacctgacctgccagcaggaggagaccttcctgctggccaaggaggagagacagctgggcgaggtgaccgagcagaccgagggcaccgccgcctgcatcccccagaaggccaagaacgtggccagcgagagagagctgtacatccccagcgtggacctgctgaccgcccaggacctgctgagcttcgagctgctggacatcaacatcgtgcaggagctggagagagtgccccacaacacccccgtggacgtgaccccctgcatgagccccctgccccacgacagccccctgatcgagaagcccggcctgggccagatcgaggaggagaacgagggcgccggcttcaaggccctgcccgacagcatggtgagcgtgaagagaaaggccgagaacatcgccagcgtggaggaggccgaggaggacctgagcggcacccagttcgtgtgcgagaccgtgatcagaagcctgaccctggacgccgcccccgaccacaaccccccctgcagacagaagagcctgcagatgaccttcgccctgcccgagggccccctgggcaacgagaaggaggagatcatccacatcgccgaggaggaggccgtgatggaggaggaggaggacgaggaggacgaggaggaggaggacgagctgaaggacgaggtgcagagccagagcagcgccagcagcgaggactacatcatcatcctgcccgagtgcttcgacaccagcagacccctgggcgacagcatgtacagcagcgccctgagccagcccggcctggagagaggcgccgagggcaagcccggcgtggaggccggccaggagcccgccgaggccggcgagagactgcccggcggcgagaaccagccccaggagcacagcatcagcgacatcctgaccaccagccagaccctggagaccgtgcccctgatccccgaggtggtggagctgccccccagcctgcccagaagcagcccctgcgtgcaccaccacggcagccccggcgtggacctgcccgtgaccatccccgaggtgagcagcgtgcccgaccagatcagaggcgagcccagaggcagcagcggcctggtgaacagcagacagaagagctacgaccacagcagacaccaccacggcagcagcatcgccggcggcctggtgaagggcgccctgagcgtggccgccagcgcctacaaggccctgttcgccggcccccccgtgaccgcccagcccatcatcagcgaggaccagaccgccgccctgatggcccacctgttcgagatgggcttctgcgacagacagctgaacctgagactgctgaagaagcacaactacaacatcctgcaggtggtgaccgagctgctgcagctgaacaacaacgactggtacagccagagatactag

SEQ ID NO: 90558 - DNA, 2814 bp, Artificial Sequence
  Description of Artificial Sequence: Synthetic coding sequence
atggagccccaggtgaccctgaacgtgaccttcaagaacgagatccagagcttcctggtgagcgaccccgagaacaccacctgggccgacatcgaggccatggtgaaggtgagcttcgacctgaacaccatccagatcaagtacctggacgaggagaacgaggaggtgaagatcgtgctgctgggcgagtacgaggaggccctgaagatggccgtgaagcagggcaaccagctgcagatgcaggtgcacgagggccaccacgtggtggacgaggcccccccccccgtggtgggcgccaagagactggccgccagagccggcaagaagcccctggcccactacagcagcctggtgagagtgctgggcagcgacatgaagacccccgaggaccccgccgtgcagagcttccccctggtgccctgcgacaccgaccagccccaggacaagccccccgactggttcaccagctacctggagaccttcagagagcaggtggtgaacgagaccgtggagaagctggagcagaagctgcacgagaagctggtgctgcagaaccccagcctgggcagctgccccagcgaggtgagcatgcccaccagcgaggagaccctgttcctgcccgagaaccagttcagctggcacatcgcctgcaacaactgccagagaagaatcgtgggcgtgagataccagtgcagcctgtgccccagctacaacatctgcgaggactgcgaggccggcccctacggccacgacaccaaccacgtgctgctgaagctgagaagacccgtggtgggcagcagcgagcccttctgccacagcaagtacagcacccccagactgcccgccgccctggagcaggtgagactgcagaagcaggtggacaagaacttcctgaaggccgagaagcagagactgagagccgagaagaagcagagaaaggccgaggtgaaggagctgaagaagcagctgaagctgcacagaaagatccacctgtggaacagcatccacggcctgcagagccccaagagccccctgggcagacccgagagcctgctgcagagcaacaccctgatgctgcccctgcagccctgcaccagcgtgatgcccatgctgagcgccgccttcgtggacgagaacctgcccgacggcacccacctgcagcccggcaccaagttcatcaagcactggagaatgaagaacaccggcaacgtgaagtggagcgccgacaccaagctgaagttcatgtggggcaacctgaccctggccagcaccgagaagaaggacgtgctggtgccctgcctgaaggccggccacgtgggcgtggtgagcgtggagttcatcgcccccgccctggagggcacctacaccagccactggagactgagccacaagggccagcagttcggccccagagtgtggtgcagcatcatcgtggaccccttccccagcgaggagagccccgacaacatcgagaagggcatgatcagcagcagcaagaccgacgacctgacctgccagcaggaggagaccttcctgctggccaaggaggagagacagctgggcgaggtgaccgagcagaccgagggcaccgccgcctgcatcccccagaaggccaagaacgtggccagcgagagagagctgtacatccccagcgtggacctgctgaccgcccaggacctgctgagcttcgagctgctggacatcaacatcgtgcaggagctggagagagtgccccacaacacccccgtggacgtgaccccctgcatgagccccctgccccacgacagccccctgatcgagaagcccggcctgggccagatcgaggaggagaacgagggcgccggcttcaaggccctgcccgacagcatggtgagcgtgaagagaaaggccgagaacatcgccagcgtggaggaggccgaggaggacctgagcggcacccagttcgtgtgcgagaccgtgatcagaagcctgaccctggacgccgcccccgaccacaaccccccctgcagacagaagagcctgcagatgaccttcgccctgcccgagggccccctgggcaacgagaaggaggagatcatccacatcgccgaggaggaggccgtgatggaggaggaggaggacgaggaggacgaggaggaggaggacgagctgaaggacgaggtgcagagccagagcagcgccagcagcgaggactacatcatcatcctgcccgagtgcttcgacaccagcagacccctgggcgacagcatgtacagcagcgccctgagccagcccggcctggagagaggcgccgagggcaagcccggcgtggaggccggccaggagcccgccgaggccggcgagagactgcccggcggcgagaaccagccccaggagcacagcatcagcgacatcctgaccaccagccagaccctggagaccgtgcccctgatccccgaggtggtggagctgccccccagcctgcccagaagcagcccctgcgtgcaccaccacggcagccccggcgtggacctgcccgtgaccatccccgaggtgagcagcgtgcccgaccagatcagaggcgagcccagaggcagcagcggcctggtgaacagcagacagaagagctacgaccacagcagacaccaccacggcagcagcatcgccggcggcctggtgaagggcgccctgagcgtggccgccagcgcctacaaggccctgttcgccggcccccccgtgaccgcccagggcctgtggggcctgctgagcttcctgcacctggccaagaagtgcttcttcctgaaggcccccagcgaggccttcagctggttctag

SEQ ID NO: 90559 - DNA, 2901 bp, Artificial Sequence
  Description of Artificial Sequence: Synthetic coding sequence
atggagccccaggtgaccctgaacgtgaccttcaagaacgagatccagagcttcctggtgagcgaccccgagaacaccacctgggccgacatcgaggccatggtgaaggtgagcttcgacctgaacaccatccagatcaagtacctggacgaggagaacgaggaggtgaagatcgtgctgctgggcgagtacgaggaggccctgaagatggccgtgaagcagggcaaccagctgcagatgcaggtgcacgagggccaccacgtggtggacgaggcccccccccccgtggtgggcgccaagagactggccgccagagccggcaagaagcccctggcccactacagcagcctggtgagagtgctgggcagcgacatgaagacccccgaggaccccgccgtgcagagcttccccctggtgccctgcgacaccgaccagccccaggacaagccccccgactggttcaccagctacctggagaccttcagagagcaggtggtgaacgagaccgtggagaagctggagcagaagctgcacgagaagctggtgctgcagaaccccagcctgggcagctgccccagcgaggtgagcatgcccaccagcgaggagaccctgttcctgcccgagaaccagttcagctggcacatcgcctgcaacaactgccagagaagaatcgtgggcgtgagataccagtgcagcctgtgccccagctacaacatctgcgaggactgcgaggccggcccctacggccacgacaccaaccacgtgctgctgaagctgagaagacccgtggtgggcagcagcgagcccttctgccacagcaagtacagcacccccagactgcccgccgccctggagcaggtgagactgcagaagcaggtggacaagaacttcctgaaggccgagaagcagagactgagagccgagaagaagcagagaaaggccgaggtgaaggagctgaagaagcagctgaagctgcacagaaagatccacctgtggaacagcatccacggcctgcagagccccaagagccccctgggcagacccgagagcctgctgcagagcaacaccctgatgctgcccctgcagccctgcaccagcgtgatgcccatgctgagcgccgccttcgtggacgagaacctgcccgacggcacccacctgcagcccggcaccaagttcatcaagcactggagaatgaagaacaccggcaacgtgaagtggagcgccgacaccaagctgaagttcatgtggggcaacctgaccctggccagcaccgagaagaaggacgtgctggtgccctgcctgaaggccggccacgtgggcgtggtgagcgtggagttcatcgcccccgccctggagggcacctacaccagccactggagactgagccacaagggccagcagttcggccccagagtgtggtgcagcatcatcgtggaccccttccccagcgaggagagccccgacaacatcgagaagggcatgatcagcagcagcaagaccgacgacctgacctgccagcaggaggagaccttcctgctggccaaggaggagagacagctgggcgaggtgaccgagcagaccgagggcaccgccgcctgcatcccccagaaggccaagaacgtggccagcgagagagagctgtacatccccagcgtggacctgctgaccgcccaggacctgctgagcttcgagctgctggacatcaacatcgtgcaggagctggagagagtgccccacaacacccccgtggacgtgaccccctgcatgagccccctgccccacgacagccccctgatcgagaagcccggcctgggccagatcgaggaggagaacgagggcgccggcttcaaggccctgcccgacagcatggtgagcgtgaagagaaaggccgagaacatcgccagcgtggaggaggccgaggaggacctgagcggcacccagttcgtgtgcgagaccgtgatcagaagcctgaccctggacgccgcccccgaccacaaccccccctgcagacagaagagcctgcagatgaccttcgccctgcccgagggccccctgggcaacgagaaggaggagatcatccacatcgccgaggaggaggccgtgatggaggaggaggaggacgaggaggacgaggaggaggaggacgagctgaaggacgaggtgcagagccagagcagcgccagcagcgaggactacatcatcatcctgcccgagtgcttcgacaccagcagacccctgggcgacagcatgtacagcagcgccctgagccagcccggcctggagagaggcgccgagggcaagcccggcgtggaggccggccaggagcccgccgaggccggcgagagactgcccggcggcgagaaccagccccaggagcacagcatcagcgacatcctgaccaccagccagaccctggagaccgtgcccctgatccccgaggtggtggagctgccccccagcctgcccagaagcagcccctgcgtgcaccaccacggcagccccggcgtggacctgcccgtgaccatccccgaggtgagcagcgtgcccgaccagatcagaggcgagcccagaggcagcagcggcctggtgaacagcagacagaagagctacgaccacagcagacaccaccacggcagcagcatcgccggcggcctggtgaagggcgccctgagcgtggccgccagcgcctacaaggccctgttcgccggcccccccgtgaccgcccagcccatcatcagcgaggaccagaccgccgccctgatggcccacctgttcgagatgggcttctgcgacagacagctgaacctgagactgctgaagaagcacaactacaacatcctgcaggtggtgaccgagctgctgcagctgaacaacaacgactggtacagccagagatactag

SEQ ID NO: 90560 - DNA, 2901 bp, Artificial Sequence; identical to SEQ ID NO: 90557
  Description of Artificial Sequence: Synthetic coding sequence

SEQ ID NO: 90561 - DNA, 654 bp, Artificial Sequence
  Description of Artificial Sequence: Synthetic coding sequence
atgtacagcagcgccctgagccagcccggcctggagagaggcgccgagggcaagcccggcgtggaggccggccaggagcccgccgaggccggcgagagactgcccggcggcgagaaccagccccaggagcacagcatcagcgacatcctgaccaccagccagaccctggagaccgtgcccctgatccccgaggtggtggagctgccccccagcctgcccagaagcagcccctgcgtgcaccaccacggcagccccggcgtggacctgcccgtgaccatccccgaggtgagcagcgtgcccgaccagatcagaggcgagcccagaggcagcagcggcctggtgaacagcagacagaagagctacgaccacagcagacaccaccacggcagcagcatcgccggcggcctggtgaagggcgccctgagcgtggccgccagcgcctacaaggccctgttcgccggcccccccgtgaccgcccagcccatcatcagcgaggaccagaccgccgccctgatggcccacctgttcgagatgggcttctgcgacagacagctgaacctgagactgctgaagaagcacaactacaacatcctgcaggtggtgaccgagctgctgcagctgaacaacaacgactggtacagccagagatactag

SEQ ID NO: 90562 - DNA, 2514 bp, Artificial Sequence
  Description of Artificial Sequence: Synthetic coding sequence
atggagccccaggtgaccctgaacgtgaccttcaagaacgagatccagagcttcctggtgagcgaccccgagaacaccacctgggccgacatcgaggccatggtgagcatcaacagccagggcgagtacgaggaggccctgaagatggccgtgaagcagggcaaccagctgcagatgcaggtgcacgagggccaccacgtggtggacgaggcccccccccccgtggtgggcgccaagagactggccgccagagccggcaagaagcccctggcccactacagcagcctggtgagagtgctgggcagcgacatgaagacccccgaggaccccgccgtgcagagcttccccctggtgccctgcgacaccgaccagccccaggacaagccccccgactggttcaccagctacctggagaccttcagagagcaggtggtgaacgagaccgtggagaagctggagcagaagctgcacgagaagctggtgctgcagaaccccagcctgggcagctgccccagcgaggtgagcatgcccaccagcgaggagaccctgttcctgcccgagaaccagttcagctggcacatcgcctgcaacaactgccagagaagaatcgtgggcgtgagataccagtgcagcctgtgccccagctacaacatctgcgaggactgcgaggccggcccctacggccacgacaccaaccacgtgctgctgaagctgagaagacccgtggtgggcagcagcgagcccttctgccacagcaagtacagcacccccagactgcccgccgccctggagcaggtgagactgcagaagcaggtggacaagaacttcctgaaggccgagaagcagagactgagagccgagaagaagcagagaaaggccgaggtgaaggagctgaagaagcagctgaagctgcacagaaagatccacctgtggaacagcatccacggcctgcagagccccaagagccccctgggcagacccgagagcctgctgcagagcaacaccctgatgctgcccctgcagccctgcaccagcgtgatgcccatgctgagcgccgccttcgtggacgagaacctgcccgacggcacccacctgcagcccggcaccaagttcatcaagcactggagaatgaagaacaccggcaacgtgaagtggagcgccgacaccaagctgaagttcatgtggggcaacctgaccctggccagcaccgagaagaaggacgtgctggtgccctgcctgaaggccggccacgtgggcgtggtgagcgtggagttcatcgcccccgccctggagggcacctacaccagccactggagactgagccacaagggccagcagttcggccccagagtgtggtgcagcatcatcgtggaccccttccccagcgaggagagccccgacaacatcgagaagggcatgatcagcagcagcaagaccgacgacctgacctgccagcaggaggagaccttcctgctggccaaggaggagagacagctgggcgaggtgaccgagcagaccgagggcaccgccgcctgcatcccccagaaggccaagaacgtggccagcgagagagagctgtacatccccagcgtggacctgctgaccgcccaggacctgctgagcttcgagctgctggacatcaacatcgtgcaggagctggagagagtgccccacaacacccccgtggacgtgaccccctgcatgagccccctgccccacgacagccccctgatcgagaagcccggcctgggccagatcgaggaggagaacgagggcgccggcttcaaggccctgcccgacagcatggtgagcgtgaagagaaaggccgagaacatcgccagcgtggaggaggccgaggaggacctgagcggcacccagttcgtgtgcgagaccgtgatcagaagcctgaccctggacgccgcccccgaccacaaccccccctgcagacagaagagcctgcagatgaccttcgccctgcccgagggccccctgggcaacgagaaggaggagatcatccacatcgccgaggaggaggccgtgatggaggaggaggaggacgaggaggacgaggaggaggaggacgagctgaaggacgaggtgcagagccagagcagcgccagcagcgaggactacatcatcatcctgcccgagtgcttcgacaccagcagacccctgggcgacagcatgtacagcagcgccctgagccagcccggcctggagagaggcgccgagggcaagcccggcgtggaggccggccaggagcccgccgaggccggcgagagactgcccggcggcgagaaccagccccaggagcacagcatcagcgacatcctgaccaccagccagaccctggagaccgtgcccctgatccccgaggtggtggagctgccccccagcctgcccagaagcagcccctgcgtgcaccaccacggcagccccggcgtggacctgcccgtgaccatccccgaggtgagcagcgtgcccgaccagatcagaggcgccaacaacttctag

SEQ ID NO: 90563 - DNA, 2262 bp, Artificial Sequence
  Description of Artificial Sequence: Synthetic coding sequence
atgcccatggacctgatcctggtggtgtggttctgcgtgtgcaccgccagaaccgtggtgggcttcggcatggaccccgacctgcagatggacatcgtgaccgagctggacctggtgaacaccaccctgggcgtggcccaggtgagcggcatgcacaacgccagcaaggccttcctgttccaggacatcgagagagagatccacgccgccccccacgtgagcgagaagctgatccagctgttcagaaacaagagcgagttcaccatcctggccaccgtgcagcagaagcccagcaccagcggcgtgatcctgagcatcagagagctggagcacagaatctacgagagagtgatcgacccccccgacaccaacctgccccccggcatcaacctgtggctgggccagagaaaccagaagcacggcctgttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgaccgccaagctgaactacgccgagaccagactgagccagctggagaactgccactgcgagaagacctgccaggtgagcggcctgctgtacagagaccaggacagctgggtggacggcgaccactgcagaaactgcacctgcaagagcggcgccgtggagtgcagaagaatgagctgcccccccctgaactgcagccccgacagcctgcccgtgcacatcgccggccagtgctgcaaggtgtgcagacccaagtgcatctacggcggcaaggtgctggccgagggccagagaatcctgaccaagagctgcagagagtgcagaggcggcgtgctggtgaagatcaccgagatgtgcccccccctgaactgcagcgagaaggaccacatcctgcccgagaaccagtgctgcagagtgtgcagaggccacaacttctgcgccgagggccccaagtgcggcgagaacagcgagtgcaagaactggaacaccaaggccacctgcgagtgcaagagcggctacatcagcgtgcagggcgacagcgcctactgcgaggacatcgacgagtgcgccgccaagatgcactactgccacgccaacaccgtgtgcgtgaacctgcccggcctgtacagatgcgactgcgtgcccggctacatcagagtggacgacttcagctgcaccgagcacgacgagtgcggcagcggccagcacaactgcgacgagaacgccatctgcaccaacaccgtgcagggccacagctgcacctgcaagcccggctacgtgggcaacggcaccatctgcagagccttctgcgaggagggctgcagatacggcggcacctgcgtggcccccaacaagtgcgtgtgccccagcggcttcaccggcagccactgcgagaaggacatcgacgagtgcagcgagggcatcatcgagtgccacaaccacagcagatgcgtgaacctgcccggctggtaccactgcgagtgcagaagcggcttccacgacgacggcacctacagcctgagcggcgagagctgcatcgacatcgacgagtgcgccctgagaacccacacctgctggaacgacagcgcctgcatcaacctggccggcggcttcgactgcctgtgccccagcggccccagctgcagcggcgactgcccccacgagggcggcctgaagcacaacggccaggtgtggaccctgaaggaggacagatgcagcgtgtgcagctgcaaggacggcaagatcttctgcagaagaaccgcctgcgactgccagaaccccagcgccgacctgttctgctgccccgagtgcgacaccagagtgaccagccagtgcctggaccagaacggccacaagctgtacagaagcggcgacaactggacccacagctgccagcagtgcagatgcctggagggcgaggtggactgctggcccctgacctgccccaacctgagctgcgagtacaccgccatcctggagggcgagtgctgccccagatgcgtgagcgacccctgcctggccgacaacatcacctacgacatcagaaagacctgcctggacagctacggcgtgagcagactgagcggcagcgtgtggaccatggccggcagcccctgcaccacctgcaagtgcaagaacggcagagtgtgctgcagcgtggacttcgagtgcctgcagaacaactag

SEQ ID NO: 90564 - DNA, 2433 bp, Artificial Sequence
  Description of Artificial Sequence: Synthetic coding sequence
atgcccatggacctgatcctggtggtgtggttctgcgtgtgcaccgccagaaccgtggtgggcttcggcatggaccccgacctgcagatggacatcgtgaccgagctggacctggtgaacaccaccctgggcgtggcccaggtgagcggcatgcacaacgccagcaaggccttcctgttccaggacatcgagagagagatccacgccgccccccacgtgagcgagaagctgatccagctgttcagaaacaagagcgagttcaccatcctggccaccgtgcagcagaagcccagcaccagcggcgtgatcctgagcatcagagagctggagcacagctacttcgagctggagagcagcggcctgagagacgagatcagataccactacatccacaacggcaagcccagaaccgaggccctgccctacagaatggccgacggccagtggcacaaggtggccctgagcgtgagcgccagccacctgctgctgcacgtggactgcaacagaatctacgagagagtgatcgacccccccgacaccaacctgccccccggcatcaacctgtggctgggccagagaaaccagaagcacggcctgttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgaccgccaagctgaactacgccgagaccagactgagccagctggagaactgccactgcgagaagacctgccaggtgagcggcctgctgtacagagaccaggacagctgggtggacggcgaccactgcagaaactgcacctgcaagagcggcgccgtggagtgcagaagaatgagctgcccccccctgaactgcagccccgacagcctgcccgtgcacatcgccggccagtgctgcaaggtgtgcagacccaagtgcatctacggcggcaaggtgctggccgagggccagagaatcctgaccaagagctgcagagagtgcagaggcggcgtgctggtgaagatcaccgagatgtgcccccccctgaactgcagcgagaaggaccacatcctgcccgagaaccagtgctgcagagtgtgcagaggccacaacttctgcgccgagggccccaagtgcggcgagaacagcgagtgcaagaactggaacaccaaggccacctgcgagtgcaagagcggctacatcagcgtgcagggcgacagcgcctactgcgaggacatcgacgagtgcgccgccaagatgcactactgccacgccaacaccgtgtgcgtgaacctgcccggcctgtacagatgcgactgcgtgcccggctacatcagagtggacgacttcagctgcaccgagcacgacgagtgcggcagcggccagcacaactgcgacgagaacgccatctgcaccaacaccgtgcagggccacagctgcacctgcaagcccggctacgtgggcaacggcaccatctgcagagccttctgcgaggagggctgcagatacggcggcacctgcgtggcccccaacaagtgcgtgtgccccagcggcttcaccggcagccactgcgagaaggacatcgacgagtgcagcgagggcatcatcgagtgccacaaccacagcagatgcgtgaacctgcccggctggtaccactgcgagtgcagaagcggcttccacgacgacggcacctacagcctgagcggcgagagctgcatcgacatcgacgagtgcgccctgagaacccacacctgctggaacgacagcgcctgcatcaacctggccggcggcttcgactgcctgtgccccagcggccccagctgcagcggcgactgcccccacgagggcggcctgaagcacaacggccaggtgtggaccctgaaggaggacagatgcagcgtgtgcagctgcaaggacggcaagatcttctgcagaagaaccgcctgcgactgccagaaccccagcgccgacctgttctgctgccccgagtgcgacaccagagtgaccagccagtgcctggaccagaacggccacaagctgtacagaagcggcgacaactggacccacagctgccagcagtgcagatgcctggagggcgaggtggactgctggcccctgacctgccccaacctgagctgcgagtacaccgccatcctggagggcgagtgctgccccagatgcgtgagcgacccctgcctggccgacaacatcacctacgacatcagaaagacctgcctggacagctacggcgtgagcagactgagcggcagcgtgtggaccatggccggcagcccctgcaccacctgcaagtgcaagaacggcagagtgtgctgcagcgtggacttcgagtgcctgcagaacaactag

SEQ ID NO: 90565 - DNA, 2292 bp, Artificial Sequence
  Description of Artificial Sequence: Synthetic coding sequence
atgcccatggacctgatcctggtggtgtggttctgcgtgtgcaccgccagaaccgtggtgggcttcggcatggaccccgacctgcagatggacatcgtgaccgagctggacctggtgaacaccaccctgggcgtggcccaggtgagcggcatgcacaacgccagcaaggccttcctgttccaggacatcgagagagagatccacgccgccccccacgtgagcgagaagctgatccagctgttcagaaacaagagcgagttcaccatcctggccaccgtgcagcagaagcccagcaccagcggcgtgatcctgagcatcagagagctggagcacagctacttcgagctggagagcagcggcctgagagacgagatcagataccactacatccacaacggcaagcccagaaccgaggccctgccctacagaatggccgacggccagtggcacaaggtggccctgagcgtgagcgccagccacctgctgctgcacgtggactgcaacagaatctacgagagagtgatcgacccccccgacaccaacctgccccccggcatcaacctgtggctgggccagagaaaccagaagcacggcctgttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgaccgccaagctgaactacgccgagaccagactgagccagctggagaactgccactgcgagaagacctgccaggtgagcggcctgctgtacagagaccaggacagctgggtggacggcgaccactgcagaaactgcacctgcaagagcggcgccgtggagtgcagaagaatgagctgcccccccctgaactgcagccccgacagcctgcccgtgcacatcgccggccagtgctgcaaggtgtgcagacccaagtgcatctacggcggcaaggtgctggccgagggccagagaatcctgaccaagagctgcagagagtgcagaggcggcgtgctggtgaagatcaccgagatgtgcccccccctgaactgcagcgagaaggaccacatcctgcccgagaaccagtgctgcagagtgtgcagaggccacaacttctgcgccgagggccccaagtgcggcgagaacagcgagtgcaagaactggaacaccaaggccacctgcgagtgcaagagcggctacatcagcgtgcagggcgacagcgcctactgcgaggacatcgacgagtgcgccgccaagatgcactactgccacgccaacaccgtgtgcgtgaacctgcccggcctgtacagatgcgactgcgtgcccggctacatcagagtggacgacttcagctgcaccgagcacgacgagtgcggcagcggccagcacaactgcgacgagaacgccatctgcaccaacaccgtgcagggccacagctgcacctgcaagcccggctacgtgggcaacggcaccatctgcagagccttctgcgaggagggctgcagatacggcggcacctgcgtggcccccaacaagtgcgtgtgccccagcggcttcaccggcagccactgcgagaaggacatcgacgagtgcgccctgagaacccacacctgctggaacgacagcgcctgcatcaacctggccggcggcttcgactgcctgtgccccagcggccccagctgcagcggcgactgcccccacgagggcggcctgaagcacaacggccaggtgtggaccctgaaggaggacagatgcagcgtgtgcagctgcaaggacggcaagatcttctgcagaagaaccgcctgcgactgccagaaccccagcgccgacctgttctgctgccccgagtgcgacaccagagtgaccagccagtgcctggaccagaacggccacaagctgtacagaagcggcgacaactggacccacagctgccagcagtgcagatgcctggagggcgaggtggactgctggcccctgacctgccccaacctgagctgcgagtacaccgccatcctggagggcgagtgctgccccagatgcgtgagcgacccctgcctggccgacaacatcacctacgacatcagaaagacctgcctggacagctacggcgtgagcagactgagcggcagcgtgtggaccatggccggcagcccctgcaccacctgcaagtgcaagaacggcagagtgtgctgcagcgtggacttcgagtgcctgcagaacaactag

SEQ ID NO: 90566 - DNA, 2520 bp, Artificial Sequence
  Description of Artificial Sequence: Synthetic coding sequence
atgagcatcagaagactgctgatcctgatcctgaagatcggcagaagatggaccgagctgatcagaaccatggagagcagagtgctgctgagaaccttctgcctgatcttcggcctgggcgccgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctacgtggacggcaagtgctgcaaggagtgcaagagcatctgccagttccagggcagaacctacttcgagggcgagagaaacaccgtgtacagcagcagcggcgtgtgcgtgctgtacgagtgcaaggaccagaccatgaagctggtggagagcagcggctgccccgccctggactgccccgagagccaccagatcaccctgagccacagctgctgcaaggtgtgcaagggctacgacttctgcagcgagagacacaactgcatggagaacagcatctgcagaaacctgaacgacagagccgtgtgcagctgcagagacggcttcagagccctgagagaggacaacgcctactgcgaggacatcgacgagtgcgccgagggcagacactactgcagagagaacaccatgtgcgtgaacacccccggcagcttcatgtgcatctgcaagaccggctacatcagaatcgacgactacagctgcaccgagcacgacgagtgcatcaccaaccagcacaactgcgacgagaacgccctgtgcttcaacaccgtgggcggccacaactgcgtgtgcaagcccggctacaccggcaacggcaccacctgcaaggccttctgcaaggacggctgcagaaacggcggcgcctgcatcgccgccaacgtgtgcgcctgcccccagggcttcaccggccccagctgcgagaccgacatcgacgagtgcagcgacggcttcgtgcagtgcgacagcagagccaactgcatcaacctgcccggctggtaccactgcgagtgcagagacggctaccacgacaacggcatgttcagccccagcggcgagagctgcgaggacatcgacgagtgcggcaccggcagacacagctgcgccaacgacaccatctgcttcaacctggacggcggctacgactgcagatgcccccacggcaagaactgcaccggcgactgcatccacgacggcaaggtgaagcacaacggccagatctgggtgctggagaacgacagatgcagcgtgtgcagctgccagaacggcttcgtgatgtgcagaagaatggtgtgcgactgcgagaaccccaccgtggacctgttctgctgccccgagtgcgaccccagactgagcagccagtgcctgcaccagaacggcgagaccctgtacaacagcggcgacacctgggtgcagaactgccagcagtgcagatgcctgcagggcgaggtggactgctggcccctgccctgccccgacgtggagtgcgagttcagcatcctgcccgagaacgagtgctgccccagatgcgtgaccgacccctgccaggccgacaccatcagaaacgacatcaccaagacctgcctggacgagatgaacgtggtgagattcaccggcagcagctggatcaagcacggcaccgagtgcaccctgtgccagtgcaagaacggccacatctgctgcagcgtggacccccagtgcctgcaggagctgtag

SEQ ID NO: 90567 - DNA, 2448 bp, Artificial Sequence
  Description of Artificial Sequence: Synthetic coding sequence
atggagaccggcctgggcgcccccctgttcaaggcctggctgctgatcagcgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctacgtggacggcaagtgctgcaaggagtgcaagagcatctgccagttccagggcagaacctacttcgagggcgagagaaacaccgtgtacagcagcagcggcgtgtgcgtgctgtacgagtgcaaggaccagaccatgaagctggtggagagcagcggctgccccgccctggactgccccgagagccaccagatcaccctgagccacagctgctgcaaggtgtgcaagggctacgacttctgcagcgagagacacaactgcatggagaacagcatctgcagaaacctgaacgacagagccgtgtgcagctgcagagacggcttcagagccctgagagaggacaacgcctactgcgaggacatcgacgagtgcgccgagggcagacactactgcagagagaacaccatgtgcgtgaacacccccggcagcttcatgtgcatctgcaagaccggctacatcagaatcgacgactacagctgcaccgagcacgacgagtgcatcaccaaccagcacaactgcgacgagaacgccctgtgcttcaacaccgtgggcggccacaactgcgtgtgcaagcccggctacaccggcaacggcaccacctgcaaggccttctgcaaggacggctgcagaaacggcggcgcctgcatcgccgccaacgtgtgcgcctgcccccagggcttcaccggccccagctgcgagaccgacatcgacgagtgcagcgacggcttcgtgcagtgcgacagcagagccaactgcatcaacctgcccggctggtaccactgcgagtgcagagacggctaccacgacaacggcatgttcagccccagcggcgagagctgcgaggacatcgacgagtgcggcaccggcagacacagctgcgccaacgacaccatctgcttcaacctggacggcggctacgactgcagatgcccccacggcaagaactgcaccggcgactgcatccacgacggcaaggtgaagcacaacggccagatctgggtgctggagaacgacagatgcagcgtgtgcagctgccagaacggcttcgtgatgtgcagaagaatggtgtgcgactgcgagaaccccaccgtggacctgttctgctgccccgagtgcgaccccagactgagcagccagtgcctgcaccagaacggcgagaccctgtacaacagcggcgacacctgggtgcagaactgccagcagtgcagatgcctgcagggcgaggtggactgctggcccctgccctgccccgacgtggagtgcgagttcagcatcctgcccgagaacgagtgctgccccagatgcgtgaccgacccctgccaggccgacaccatcagaaacgacatcaccaagacctgcctggacgagatgaacgtggtgagattcaccggcagcagctggatcaagcacggcaccgagtgcaccctgtgccagtgcaagaacggccacatctgctgcagcgtggacccccagtgcctgcaggagctgtag

SEQ ID NO: 90568 - DNA, 2451 bp, Artificial Sequence
  Description of Artificial Sequence: Synthetic coding sequence
atggagagcagagtgctgctgagaaccttctgcctgatcttcggcctgggcgccgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctacgtggacggcaagtgctgcaaggagtgcaagagcatctgccagttccagggcagaacctacttcgagggcgagagaaacaccgtgtacagcagcagcggcgtgtgcgtgctgtacgagtgcaaggaccagaccatgaagctggtggagagcagcggctgccccgccctggactgccccgagagccaccagatcaccctgagccacagctgctgcaaggtgtgcaagggctacgacttctgcagcgagagacacaactgcatggagaacagcatctgcagaaacctgaacgacagagccgtgtgcagctgcagagacggcttcagagccctgagagaggacaacgcctactgcgaggacatcgacgagtgcgccgagggcagacactactgcagagagaacaccatgtgcgtgaacacccccggcagcttcatgtgcatctgcaagaccggctacatcagaatcgacgactacagctgcaccgagcacgacgagtgcatcaccaaccagcacaactgcgacgagaacgccctgtgcttcaacaccgtgggcggccacaactgcgtgtgcaagcccggctacaccggcaacggcaccacctgcaaggccttctgcaaggacggctgcagaaacggcggcgcctgcatcgccgccaacgtgtgcgcctgcccccagggcttcaccggccccagctgcgagaccgacatcgacgagtgcagcgacggcttcgtgcagtgcgacagcagagccaactgcatcaacctgcccggctggtaccactgcgagtgcagagacggctaccacgacaacggcatgttcagccccagcggcgagagctgcgaggacatcgacgagtgcggcaccggcagacacagctgcgccaacgacaccatctgcttcaacctggacggcggctacgactgcagatgcccccacggcaagaactgcaccggcgactgcatccacgacggcaaggtgaagcacaacggccagatctgggtgctggagaacgacagatgcagcgtgtgcagctgccagaacggcttcgtgatgtgcagaagaatggtgtgcgactgcgagaaccccaccgtggacctgttctgctgccccgagtgcgaccccagactgagcagccagtgcctgcaccagaacggcgagaccctgtacaacagcggcgacacctgggtgcagaactgccagcagtgcagatgcctgcagggcgaggtggactgctggcccctgccctgccccgacgtggagtgcgagttcagcatcctgcccgagaacgagtgctgccccagatgcgtgaccgacccctgccaggccgacaccatcagaaacgacatcaccaagacctgcctggacgagatgaacgtggtgagattcaccggcagcagctggatcaagcacggcaccgagtgcaccctgtgccagtgcaagaacggccacatctgctgcagcgtggacccccagtgcctgcaggagctgtag

SEQ ID NO: 90569 - DNA, 2601 bp, Artificial Sequence
  Description of Artificial Sequence: Synthetic coding sequence
atgggcttcccccccctgctgaagggccaggccagcgccaccagaagcagcctggccagctgcagctgggtggtgttcttcctgagctgcctgagcagacacgcccccgagatcgagggcggcagaagatggaccgagctgatcagaaccatggagagcagagtgctgctgagaaccttctgcctgatcttcggcctgggcgccgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctacgtggacggcaagtgctgcaaggagtgcaagagcatctgccagttccagggcagaacctacttcgagggcgagagaaacaccgtgtacagcagcagcggcgtgtgcgtgctgtacgagtgcaaggaccagaccatgaagctggtggagagcagcggctgccccgccctggactgccccgagagccaccagatcaccctgagccacagctgctgcaaggtgtgcaagggctacgacttctgcagcgagagacacaactgcatggagaacagcatctgcagaaacctgaacgacagagccgtgtgcagctgcagagacggcttcagagccctgagagaggacaacgcctactgcgaggacatcgacgagtgcgccgagggcagacactactgcagagagaacaccatgtgcgtgaacacccccggcagcttcatgtgcatctgcaagaccggctacatcagaatcgacgactacagctgcaccgagcacgacgagtgcatcaccaaccagcacaactgcgacgagaacgccctgtgcttcaacaccgtgggcggccacaactgcgtgtgcaagcccggctacaccggcaacggcaccacctgcaaggccttctgcaaggacggctgcagaaacggcggcgcctgcatcgccgccaacgtgtgcgcctgcccccagggcttcaccggccccagctgcgagaccgacatcgacgagtgcagcgacggcttcgtgcagtgcgacagcagagccaactgcatcaacctgcccggctggtaccactgcgagtgcagagacggctaccacgacaacggcatgttcagccccagcggcgagagctgcgaggacatcgacgagtgcggcaccggcagacacagctgcgccaacgacaccatctgcttcaacctggacggcggctacgactgcagatgcccccacggcaagaactgcaccggcgactgcatccacgacggcaaggtgaagcacaacggccagatctgggtgctggagaacgacagatgcagcgtgtgcagctgccagaacggcttcgtgatgtgcagaagaatggtgtgcgactgcgagaaccccaccgtggacctgttctgctgccccgagtgcgaccccagactgagcagccagtgcctgcaccagaacggcgagaccctgtacaacagcggcgacacctgggtgcagaactgccagcagtgcagatgcctgcagggcgaggtggactgctggcccctgccctgccccgacgtggagtgcgagttcagcatcctgcccgagaacgagtgctgccccagatgcgtgaccgacccctgccaggccgacaccatcagaaacgacatcaccaagacctgcctggacgagatgaacgtggtgagattcaccggcagcagctggatcaagcacggcaccgagtgcaccctgtgccagtgcaagaacggccacatctgctgcagcgtggacccccagtgcctgcaggagctgtag

SEQ ID NO: 90570 - DNA, 2451 bp, Artificial Sequence; identical to SEQ ID NO: 90568
  Description of Artificial Sequence: Synthetic coding sequence

SEQ ID NO: 90571 - DNA, 1734 bp, Artificial Sequence
  Description of Artificial Sequence: Synthetic coding sequence
atggagaccggcctgggcgcccccctgttcaaggcctggctgctgatcagcgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctacgtggacggcaagtgctgcaaggagtgcaagagcatctgccagttccagggcagaacctacttcgagggcgagagaaacaccgtgtacagcagcagcggcgtgtgcgtgctgtacgagtgcaaggaccagaccatgaagctggtggagagcagcggctgccccgccctggactgccccgagagccaccagatcaccctgagccacagctgctgcaaggtgtgcaagggctacgacttctgcagcgagagacacaactgcatggagaacagcatctgcagaaacctgaacgacagagccgtgtgcagctgcagagacggcttcagagccctgagagaggacaacgcctactgcgaggacatcgacgagtgcgccgagggcagacactactgcagagagaacaccatgtgcgtgaacacccccggcagcttcatgtgcatctgcaagaccggctacatcagaatcgacgactacagctgcaccgagcacgacgagtgcatcaccaaccagcacaactgcgacgagaacgccctgtgcttcaacaccgtgggcggccacaactgcgtgtgcaagcccggctacaccggcaacggcaccacctgcaaggccttctgcaaggacggctgcagaaacggcggcgcctgcatcgccgccaacgtgtgcgcctgcccccagggcttcaccggccccagctgcgagaccgacatcgacgagtgcagcgacggcttcgtgcagtgcgacagcagagccaactgcatctgcctggtgcccctgtag

SEQ ID NO: 90572 - DNA, 333 bp, Artificial Sequence
  Description of Artificial Sequence: Synthetic coding sequence
atggagaccggcctgggcgcccccctgttcaaggcctggctgctgatcagcgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccactag

SEQ ID NO: 90573 - DNA, 2448 bp, Artificial Sequence; identical to SEQ ID NO: 90567
  Description of Artificial Sequence: Synthetic coding sequence

SEQ ID NO: 90574 - DNA, 69 bp, Artificial Sequence
  Description of Artificial Sequence: Synthetic coding sequence
atggagagcagagtgctgctgagaaccttctgcctgatcttcggcctgggcgccgtgtggggcctgtag

SEQ ID NO: 90575 - DNA, 966 bp, Artificial Sequence
  Description of Artificial Sequence: Synthetic coding sequence
atggagagcagagtgctgctgagaaccttctgcctgatcttcggcctgggcgccgtgtggggcctgggcgtggaccccagcctgcagatcgacgtgctgaccgagctggagctgggcgagagcaccaccggcgtgagacaggtgcccggcctgcacaacggcaccaaggccttcctgttccaggacacccccagaagcatcaaggccagcaccgccaccgccgagcagttcttccagaagctgagaaacaagcacgagttcaccatcctggtgaccctgaagcagacccacctgaacagcggcgtgatcctgagcatccaccacctggaccacagatacctggagctggagagcagcggccacagaaacgaggtgagactgcactacagaagcggcagccacagaccccacaccgaggtgttcccctacatcctggccgacgacaagtggcacaagctgagcctggccatcagcgccagccacctgatcctgcacatcgactgcaacaagatctacgagagagtggtggagaagcccagcaccgacctgcccctgggcaccaccttctggctgggccagagaaacaacgcccacggctacttcaagggcatcatgcaggacgtgcagctgctggtgatgccccagggcttcatcgcccagtgccccgacctgaacagaacctgccccacctgcaacgacttccacggcctggtgcagaagatcatggagctgcaggacatcctggccaagaccagcgccaagctgagcagagccgagcagagaatgaacagactggaccagtgctactgcgagagaacctgcaccatgaagggcaccacctacagagagttcgagagctggatcgacggctgcaagaactgcacctgcctgaacggcaccatccagtgcgagaccctgatctgccccaaccccgactgccccctgaagagcgccctggcctactag

SEQ ID NO: 90576 - DNA, 4386 bp, Artificial Sequence
  Description of Artificial Sequence: Synthetic coding sequence
atggccgccgagagaggcgccagaagactgctgagcacccccagcttctggctgtactgcctgctgctgctgggcagaagagcccccggcgccgccgccgccagaagcggcagcgccccccagagccccggcgccagcatcagaaccttcacccccttctacttcctggtggagcccgtggacaccctgagcgtgagaggcagcagcgtgatcctgaactgcagcgcctacagcgagcccagccccaagatcgagtggaagaaggacggcaccttcctgaacctggtgagcgacgacagaagacagctgctgcccgacggcagcctgttcatcagcaacgtggtgcacagcaagcacaacaagcccgacgagggctactaccagtgcgtggccaccgtggagagcctgggcaccatcatcagcagaaccgccaagctgatcgtggccggcctgcccagattcaccagccagcccgagcccagcagcgtgtacgccggcaacaacgccatcctgaactgcgaggtgaacgccgacctggtgcccttcgtgagatgggagcagaacagacagcccctgctgctggacgacagagtgatcaagctgcccagcggcatgctggtgatcagcaacgccaccgagggcgacggcggcctgtacagatgcgtggtggagagcggcggcccccccaagtacagcgacgaggtggagctgaaggtgctgcccgaccccgaggtgatcagcgacctggtgttcctgaagcagcccagccccctggtgagagtgatcggccaggacgtggtgctgccctgcgtggccagcggcctgcccacccccaccatcaagtggatgaagaacgaggaggccctggacaccgagagcagcgagagactggtgctgctggccggcggcagcctggagatcagcgacgtgaccgaggacgacgccggcacctacttctgcatcgccgacaacggcaacgagaccatcgaggcccaggccgagctgaccgtgcaggcccagcccgagttcctgaagcagcccaccaacatctacgcccacgagagcatggacatcgtgttcgagtgcgaggtgaccggcaagcccacccccaccgtgaagtgggtgaagaacggcgacatggtgatccccagcgactacttcaagatcgtgaaggagcacaacctgcaggtgctgggcctggtgaagagcgacgagggcttctaccagtgcatcgccgagaacgacgtgggcaacgcccaggccggcgcccagctgatcatcctggagcacgcccccgccaccaccggccccctgcccagcgcccccagagacgtggtggccagcctggtgagcaccagattcatcaagctgacctggagaacccccgccagcgacccccacggcgacaacctgacctacagcgtgttctacaccaaggagggcatcgccagagagagagtggagaacaccagccaccccggcgagatgcaggtgaccatccagaacctgatgcccgccaccgtgtacatcttcagagtgatggcccagaacaagcacggcagcggcgagagcagcgcccccctgagagtggagacccagcccgaggtgcagctgcccggccccgcccccaacctgagagcctacgccgccagccccaccagcatcaccgtgacctgggagacccccgtgagcggcaacggcgagatccagaactacaagctgtactacatggagaagggcaccgacaaggagcaggacgtggacgtgagcagccacagctacaccatcaacggcctgaagaagtacaccgagtacagcttcagagtggtggcctacaacaagcacggccccggcgtgagcacccccgacgtggccgtgagaaccctgagcgacgtgcccagcgccgccccccagaacctgagcctggaggtgagaaacagcaagagcatcatgatccactggcagccccccgcccccgccacccagaacggccagatcaccggctacaagatcagatacagaaaggccagcagaaagagcgacgtgaccgagaccctggtgagcggcacccagctgagccagctgatcgagggcctggacagaggcaccgagtacaacttcagagtggccgccctgaccatcaacggcaccggccccgccaccgactggctgagcgccgagaccttcgagagcgacctggacgagaccagagtgcccgaggtgcccagcagcctgcacgtgagacccctggtgaccagcatcgtggtgagctggaccccccccgagaaccagaacatcgtggtgagaggctacgccatcggctacggcatcggcagcccccacgcccagaccatcaaggtggactacaagcagagatactacaccatcgagaacctggaccccagcagccactacgtgatcaccctgaaggccttcaacaacgtgggcgagggcatccccctgtacgagagcgccgtgaccagaccccacaccgacaccagcgaggtggacctgttcgtgatcaacgccccctacacccccgtgcccgaccccacccccatgatgccccccgtgggcgtgcaggccagcatcctgagccacgacaccatcagaatcacctgggccgacaacagcctgcccaagcaccagaagatcaccgacagcagatactacaccgtgagatggaagaccaacatccccgccaacaccaagtacaagaacgccaacgccaccaccctgagctacctggtgaccggcctgaagcccaacaccctgtacgagttcagcgtgatggtgaccaagggcagaagaagcagcacctggagcatgaccgcccacggcaccaccttcgagctggtgcccaccagcccccccaaggacgtgaccgtggtgagcaaggagggcaagcccaagaccatcatcgtgaactggcagccccccagcgaggccaacggcaagatcaccggctacatcatctactacagcaccgacgtgaacgccgagatccacgactgggtgatcgagcccgtggtgggcaacagactgacccaccagatccaggagctgaccctggacaccccctactacttcaagatccaggccagaaacagcaagggcatgggccccatgagcgaggccgtgcagttcagaacccccaaggccgacagcagcgacaagatgcccaacgaccaggccagcggcagcggcggcaagggcagcagactgcccgacctgggcagcgactacaagccccccatgagcggcagcaacagcccccacggcagccccaccagccccctggacagcaacatgctgctggtgatcatcgtgagcgtgggcgtgatcaccatcgtggtggtggtgatcatcgccgtgttctgcaccagaagaaccaccagccaccagaagaagaagagagccgcctgcaagagcgtgaacggcagccacaagtacaagggcaacagcaaggacgtgaagccccccgacctgtggatccaccacgagagactggagctgaagcccatcgacaagagccccgaccccaaccccatcatgaccgacacccccatccccagaaacagccaggacatcacccccgtggacaacagcatggacagcaacatccaccagagaagaaacagctacagaggccacgagagcgaggacagcatgagcaccctggccggcagaagaggcatgagacccaagatgatgatgcccttcgacagccagcccccccagcccgtgatcagcgcccaccccatccacagcctggacaacccccaccaccacttccacagcagcagcctggccagccccgccagaagccacctgtaccaccccggcagcccctggcccatcggcaccagcatgagcctgagcgacagagccaacagcaccgagagcgtgagaaacacccccagcaccgacaccatgcccgccagcagcagccagacctgctgcaccgaccaccaggaccccgagggcgccaccagcagcagctacctggccagcagccaggaggaggacagcggccagagcctgcccaccgcccacgtgagacccagccaccccctgaagagcttcgccgtgcccgccatccccccccccggcccccccacctacgaccccgccctgcccagcacccccctgctgagccagcaggccctgaaccaccacatccacagcgtgaagaccgccagcatcggcaccctgggcagaagcagaccccccatgcccgtggtggtgcccagcgcccccgaggtgcaggagaccaccagaatgctggaggacagcgagagcagctacgagcccgacgagctgaccaaggagatggcccacctggagggcctgatgaaggacctgaacgccatcaccaccgcctag

SEQ ID NO: 90577 - DNA, 4386 bp, Artificial Sequence; identical to SEQ ID NO: 90576
  Description of Artificial Sequence: Synthetic coding sequence

SEQ ID NO: 90578 - DNA, 3519 bp, Artificial Sequence
  Description of Artificial Sequence: Synthetic coding sequence
atgaagaacgaggaggccctggacaccgagagcagcgagagactggtgctgctggccggcggcagcctggagatcagcgacgtgaccgaggacgacgccggcacctacttctgcatcgccgacaacggcaacgagaccatcgaggcccaggccgagctgaccgtgcaggcccagcccgagttcctgaagcagcccaccaacatctacgcccacgagagcatggacatcgtgttcgagtgcgaggtgaccggcaagcccacccccaccgtgaagtgggtgaagaacggcgacatggtgatccccagcgactacttcaagatcgtgaaggagcacaacctgcaggtgctgggcctggtgaagagcgacgagggcttctaccagtgcatcgccgagaacgacgtgggcaacgcccaggccggcgcccagctgatcatcctggagcacgacgtggccatccccaccctgccccccaccagcctgaccagcgccaccaccgaccacctggcccccgccaccaccggccccctgcccagcgcccccagagacgtggtggccagcctggtgagcaccagattcatcaagctgacctggagaacccccgccagcgacccccacggcgacaacctgacctacagcgtgttctacaccaaggagggcatcgccagagagagagtggagaacaccagccaccccggcgagatgcaggtgaccatccagaacctgatgcccgccaccgtgtacatcttcagagtgatggcccagaacaagcacggcagcggcgagagcagcgcccccctgagagtggagacccagcccgaggtgcagctgcccggccccgcccccaacctgagagcctacgccgccagccccaccagcatcaccgtgacctgggagacccccgtgagcggcaacggcgagatccagaactacaagctgtactacatggagaagggcaccgacaaggagcaggacgtggacgtgagcagccacagctacaccatcaacggcctgaagaagtacaccgagtacagcttcagagtggtggcctacaacaagcacggccccggcgtgagcacccccgacgtggccgtgagaaccctgagcgacgtgcccagcgccgccccccagaacctgagcctggaggtgagaaacagcaagagcatcatgatccactggcagccccccgcccccgccacccagaacggccagatcaccggctacaagatcagatacagaaaggccagcagaaagagcgacgtgaccgagaccctggtgagcggcacccagctgagccagctgatcgagggcctggacagaggcaccgagtacaacttcagagtggccgccctgaccatcaacggcaccggccccgccaccgactggctgagcgccgagaccttcgagagcgacctggacgagaccagagtgcccgaggtgcccagcagcctgcacgtgagacccctggtgaccagcatcgtggtgagctggaccccccccgagaaccagaacatcgtggtgagaggctacgccatcggctacggcatcggcagcccccacgcccagaccatcaaggtggactacaagcagagatactacaccatcgagaacctggaccccagcagccactacgtgatcaccctgaaggccttcaacaacgtgggcgagggcatccccctgtacgagagcgccgtgaccagaccccacaccgtgcccgaccccacccccatgatgccccccgtgggcgtgcaggccagcatcctgagccacgacaccatcagaatcacctgggccgacaacagcctgcccaagcaccagaagatcaccgacagcagatactacaccgtgagatggaagaccaacatccccgccaacaccaagtacaagaacgccaacgccaccaccctgagctacctggtgaccggcctgaagcccaacaccctgtacgagttcagcgtgatggtgaccaagggcagaagaagcagcacctggagcatgaccgcccacggcaccaccttcgagctggtgcccaccagcccccccaaggacgtgaccgtggtgagcaaggagggcaagcccaagaccatcatcgtgaactggcagccccccagcgaggccaacggcaagatcaccggctacatcatctactacagcaccgacgtgaacgccgagatccacgactgggtgatcgagcccgtggtgggcaacagactgacccaccagatccaggagctgaccctggacaccccctactacttcaagatccaggccagaaacagcaagggcatgggccccatgagcgaggccgtgcagttcagaacccccaaggccagcggcagcggcggcaagggcagcagactgcccgacctgggcagcgactacaagccccccatgagcggcagcaacagcccccacggcagccccaccagccccctggacagcaacatgctgctggtgatcatcgtgagcgtgggcgtgatcaccatcgtggtggtggtgatcatcgccgtgttctgcaccagaagaaccaccagccaccagaagaagaagagagccgcctgcaagagcgtgaacggcagccacaagtacaagggcaacagcaaggacgtgaagccccccgacctgtggatccaccacgagagactggagctgaagcccatcgacaagagccccgaccccaaccccatcatgaccgacacccccatccccagaaacagccaggacatcacccccgtggacaacagcatggacagcaacatccaccagagaagaaacagctacagaggccacgagagcgaggacagcatgagcaccctggccggcagaagaggcatgagacccaagatgatgatgcccttcgacagccagcccccccagcccgtgatcagcgcccaccccatccacagcctggacaacccccaccaccacttccacagcagcagcctggccagccccgccagaagccacctgtaccaccccggcagcccctggcccatcggcaccagcatgagcctgagcgacagagccaacagcaccgagagcgtgagaaacacccccagcaccgacaccatgcccgccagcagcagccagacctgctgcaccgaccaccaggaccccgagggcgccaccagcagcagctacctggccagcagccaggaggaggacagcggccagagcctgcccaccgcccacgtgagacccagccaccccctgaagagcttcgccgtgcccgccatccccccccccggcccccccacctacgaccccgccctgcccagcacccccctgctgagccagcaggccctgaaccaccacatccacagcgtgaagaccgccagcatcggcaccctgggcagaagcagaccccccatgcccgtggtggtgcccagcgcccccgaggtgcaggagaccaccagaatgctggaggacagcgagagcagctacgagcccgacgagctgaccaaggagatggcccacctggagggcctgatgaaggacctgaacgccatcaccaccgcctag

SEQ ID NO: 90579 - DNA, 4353 bp, Artificial Sequence
  Description of Artificial Sequence: Synthetic coding sequence
atggccgccgagagaggcgccagaagactgctgagcacccccagcttctggctgtactgcctgctgctgctgggcagaagagcccccggcgccgccgccgccagaagcggcagcgccccccagagccccggcgccagcatcagaaccttcacccccttctacttcctggtggagcccgtggacaccctgagcgtgagaggcagcagcgtgatcctgaactgcagcgcctacagcgagcccagccccaagatcgagtggaagaaggacggcaccttcctgaacctggtgagcgacgacagaagacagctgctgcccgacggcagcctgttcatcagcaacgtggtgcacagcaagcacaacaagcccgacgagggctactaccagtgcgtggccaccgtggagagcctgggcaccatcatcagcagaaccgccaagctgatcgtggccggcctgcccagattcaccagccagcccgagcccagcagcgtgtacgccggcaacaacgccatcctgaactgcgaggtgaacgccgacctggtgcccttcgtgagatgggagcagaacagacagcccctgctgctggacgacagagtgatcaagctgcccagcggcatgctggtgatcagcaacgccaccgagggcgacggcggcctgtacagatgcgtggtggagagcggcggcccccccaagtacagcgacgaggtggagctgaaggtgctgcccgaccccgaggtgatcagcgacctggtgttcctgaagcagcccagccccctggtgagagtgatcggccaggacgtggtgctgccctgcgtggccagcggcctgcccacccccaccatcaagtggatgaagaacgaggaggccctggacaccgagagcagcgagagactggtgctgctggccggcggcagcctggagatcagcgacgtgaccgaggacgacgccggcacctacttctgcatcgccgacaacggcaacgagaccatcgaggcccaggccgagctgaccgtgcaggcccagcccgagttcctgaagcagcccaccaacatctacgcccacgagagcatggacatcgtgttcgagtgcgaggtgaccggcaagcccacccccaccgtgaagtgggtgaagaacggcgacatggtgatccccagcgactacttcaagatcgtgaaggagcacaacctgcaggtgctgggcctggtgaagagcgacgagggcttctaccagtgcatcgccgagaacgacgtgggcaacgcccaggccggcgcccagctgatcatcctggagcacgcccccgccaccaccggccccctgcccagcgcccccagagacgtggtggccagcctggtgagcaccagattcatcaagctgacctggagaacccccgccagcgacccccacggcgacaacctgacctacagcgtgttctacaccaaggagggcatcgccagagagagagtggagaacaccagccaccccggcgagatgcaggtgaccatccagaacctgatgcccgccaccgtgtacatcttcagagtgatggcccagaacaagcacggcagcggcgagagcagcgcccccctgagagtggagacccagcccgaggtgcagctgcccggccccgcccccaacctgagagcctacgccgccagccccaccagcatcaccgtgacctgggagacccccgtgagcggcaacggcgagatccagaactacaagctgtactacatggagaagggcaccgacaaggagcaggacgtggacgtgagcagccacagctacaccatcaacggcctgaagaagtacaccgagtacagcttcagagtggtggcctacaacaagcacggccccggcgtgagcacccccgacgtggccgtgagaaccctgagcgacgtgcccagcgccgccccccagaacctgagcctggaggtgagaaacagcaagagcatcatgatccactggcagccccccgcccccgccacccagaacggccagatcaccggctacaagatcagatacagaaaggccagcagaaagagcgacgtgaccgagaccctggtgagcggcacccagctgagccagctgatcgagggcctggacagaggcaccgagtacaacttcagagtggccgccctgaccatcaacggcaccggccccgccaccgactggctgagcgccgagaccttcgagagcgacctggacgagaccagagtgcccgaggtgcccagcagcctgcacgtgagacccctggtgaccagcatcgtggtgagctggaccccccccgagaaccagaacatcgtggtgagaggctacgccatcggctacggcatcggcagcccccacgcccagaccatcaaggtggactacaagcagagatactacaccatcgagaacctggaccccagcagccactacgtgatcaccctgaaggccttcaacaacgtgggcgagggcatccccctgtacgagagcgccgtgaccagaccccacaccgacaccagcgaggtggacctgttcgtgatcaacgccccctacacccccgtgcccgaccccacccccatgatgccccccgtgggcgtgcaggccagcatcctgagccacgacaccatcagaatcacctgggccgacaacagcctgcccaagcaccagaagatcaccgacagcagatactacaccgtgagatggaagaccaacatccccgccaacaccaagtacaagaacgccaacgccaccaccctgagctacctggtgaccggcctgaagcccaacaccctgtacgagttcagcgtgatggtgaccaagggcagaagaagcagcacctggagcatgaccgcccacggcaccaccttcgagctggtgcccaccagcccccccaaggacgtgaccgtggtgagcaaggagggcaagcccaagaccatcatcgtgaactggcagccccccagcgaggccaacggcaagatcaccggctacatcatctactacagcaccgacgtgaacgccgagatccacgactgggtgatcgagcccgtggtgggcaacagactgacccaccagatccaggagctgaccctggacaccccctactacttcaagatccaggccagaaacagcaagggcatgggccccatgagcgaggccgtgcagttcagaacccccaaggccagcggcagcggcggcaagggcagcagactgcccgacctgggcagcgactacaagccccccatgagcggcagcaacagcccccacggcagccccaccagccccctggacagcaacatgctgctggtgatcatcgtgagcgtgggcgtgatcaccatcgtggtggtggtgatcatcgccgtgttctgcaccagaagaaccaccagccaccagaagaagaagagagccgcctgcaagagcgtgaacggcagccacaagtacaagggcaacagcaaggacgtgaagccccccgacctgtggatccaccacgagagactggagctgaagcccatcgacaagagccccgaccccaaccccatcatgaccgacacccccatccccagaaacagccaggacatcacccccgtggacaacagcatggacagcaacatccaccagagaagaaacagctacagaggccacgagagcgaggacagcatgagcaccctggccggcagaagaggcatgagacccaagatgatgatgcccttcgacagccagcccccccagcccgtgatcagcgcccaccccatccacagcctggacaacccccaccaccacttccacagcagcagcctggccagccccgccagaagccacctgtaccaccccggcagcccctggcccatcggcaccagcatgagcctgagcgacagagccaacagcaccgagagcgtgagaaacacccccagcaccgacaccatgcccgccagcagcagccagacctgctgcaccgaccaccaggaccccgagggcgccaccagcagcagctacctggccagcagccaggaggaggacagcggccagagcctgcccaccgcccacgtgagacccagccaccccctgaagagcttcgccgtgcccgccatccccccccccggcccccccacctacgaccccgccctgcccagcacccccctgctgagccagcaggccctgaaccaccacatccacagcgtgaagaccgccagcatcggcaccctgggcagaagcagaccccccatgcccgtggtggtgcccagcgcccccgaggtgcaggagaccaccagaatgctggaggacagcgagagcagctacgagcccgacgagctgaccaaggagatggcccacctggagggcctgatgaaggacctgaacgccatcaccaccgcctag

SEQ ID NO: 90580 - DNA, 4227 bp, Artificial Sequence
  Description of Artificial Sequence: Synthetic coding sequence
atggccgccgagagaggcgccagaagactgctgagcacccccagcttctggctgtactgcctgctgctgctgggcagaagagcccccggcgccgccgccgccagaagcggcagcgccccccagagccccggcgccagcatcagaaccttcacccccttctacttcctggtggagcccgtggacaccctgagcgtgagaggcagcagcgtgatcctgaactgcagcgcctacagcgagcccagccccaagatcgagtggaagaaggacggcaccttcctgaacctggtgagcgacgacagaagacagctgctgcccgacggcagcctgttcatcagcaacgtggtgcacagcaagcacaacaagcccgacgagggctactaccagtgcgtggccaccgtggagagcctgggcaccatcatcagcagaaccgccaagctgatcgtggccggcctgcccagattcaccagccagcccgagcccagcagcgtgtacgccggcaacaacgccatcctgaactgcgaggtgaacgccgacctggtgcccttcgtgagatgggagcagaacagacagcccctgctgctggacgacagagtgatcaagctgcccagcggcatgctggtgatcagcaacgccaccgagggcgacggcggcctgtacagatgcgtggtggagagcggcggcccccccaagtacagcgacgaggtggagctgaaggtgctgcccgaccccgaggtgatcagcgacctggtgttcctgaagcagcccagccccctggtgagagtgatcggccaggacgtggtgctgccctgcgtggccagcggcctgcccacccccaccatcaagtggatgaagaacgaggaggccctggacaccgagagcagcgagagactggtgctgctggccggcggcagcctggagatcagcgacgtgaccgaggacgacgccggcacctacttctgcatcgccgacaacggcaacgagaccatcgaggcccaggccgagctgaccgtgcaggcccagcccgagttcctgaagcagcccaccaacatctacgcccacgagagcatggacatcgtgttcgagtgcgaggtgaccggcaagcccacccccaccgtgaagtgggtgaagaacggcgacatggtgatccccagcgactacttcaagatcgtgaaggagcacaacctgcaggtgctgggcctggtgaagagcgacgagggcttctaccagtgcatcgccgagaacgacgtgggcaacgcccaggccggcgcccagctgatcatcctggagcacgcccccgccaccaccggccccctgcccagcgcccccagagacgtggtggccagcctggtgagcaccagattcatcaagctgacctggagaacccccgccagcgacccccacggcgacaacctgacctacagcgtgttctacaccaaggagggcatcgccagagagagagtggagaacaccagccaccccggcgagatgcaggtgaccatccagaacctgatgcccgccaccgtgtacatcttcagagtgatggcccagaacaagcacggcagcggcgagagcagcgcccccctgagagtggagacccagcccgaggtgcagctgcccggccccgcccccaacctgagagcctacgccgccagccccaccagcatcaccgtgacctgggagacccccgtgagcggcaacggcgagatccagaactacaagctgtactacatggagaagggcaccgacaaggagcaggacgtggacgtgagcagccacagctacaccatcaacggcctgaagaagtacaccgagtacagcttcagagtggtggcctacaacaagcacggccccggcgtgagcacccccgacgtggccgtgagaaccctgagcgacgtgcccagcgccgccccccagaacctgagcctggaggtgagaaacagcaagagcatcatgatccactggcagccccccgcccccgccacccagaacggccagatcaccggctacaagatcagatacagaaaggccagcagaaagagcgacgtgaccgagaccctggtgagcggcacccagctgagccagctgatcgagggcctggacagaggcaccgagtacaacttcagagtggccgccctgaccatcaacggcaccggccccgccaccgactggctgagcgccgagaccttcgagagcgacctggacgagaccagagtgcccgaggtgcccagcagcctgcacgtgagacccctggtgaccagcatcgtggtgagctggaccccccccgagaaccagaacatcgtggtgagaggctacgccatcggctacggcatcggcagcccccacgcccagaccatcaaggtggactacaagcagagatactacaccatcgagaacctggaccccagcagccactacgtgatcaccctgaaggccttcaacaacgtgggcgagggcatccccctgtacgagagcgccgtgaccagaccccacaccgacaccagcgaggtggacctgttcgtgatcaacgccccctacacccccgtgcccgaccccacccccatgatgccccccgtgggcgtgcaggccagcatcctgagccacgacaccatcagaatcacctgggccgacaacagcctgcccaagcaccagaagatcaccgacagcagatactacaccgtgagatggaagaccaacatccccgccaacaccaagtacaagaacgccaacgccaccaccctgagctacctggtgaccggcctgaagcccaacaccctgtacgagttcagcgtgatggtgaccaagggcagaagaagcagcacctggagcatgaccgcccacggcaccaccttcgagctggtgcccaccagcccccccaaggacgtgaccgtggtgagcaaggagggcaagcccaagaccatcatcgtgaactggcagccccccagcgaggccaacggcaagatcaccggctacatcatctactacagcaccgacgtgaacgccgagatccacgactgggtgatcgagcccgtggtgggcaacagactgacccaccagatccaggagctgaccctggacaccccctactacttcaagatccaggccagaaacagcaagggcatgggccccatgagcgaggccgtgcagttcagaacccccaaggccgacagcagcgacaagatgcccaacgaccaggccagcggcagcggcggcaagggcagcagactgcccgacctgggcagcgactacaagccccccatgagcggcagcaacagcccccacggcagccccaccagccccctggacagcaacatgctgctggtgatcatcgtgagcgtgggcgtgatcaccatcgtggtggtggtgatcatcgccgtgttctgcaccagaagaaccaccagccaccagaagaagaagagagccgcctgcaagagcgtgaacggcagccacaagtacaagggcaacagcaaggacgtgaagccccccgacctgtggatccaccacgagagactggagctgaagcccatcgacaagagccccgaccccaaccccatcatgaccgacacccccatccccagaaacagccaggacatcacccccgtggacaacagcatggacagcaacatccaccagagaagaaacagctacagaggccacgagagcgaggacagcatgagcaccctggccggcagaagaggcatgagacccaagatgatgatgcccttcgacagccagcccccccagcagagcgtgagaaacacccccagcaccgacaccatgcccgccagcagcagccagacctgctgcaccgaccaccaggaccccgagggcgccaccagcagcagctacctggccagcagccaggaggaggacagcggccagagcctgcccaccgcccacgtgagacccagccaccccctgaagagcttcgccgtgcccgccatccccccccccggcccccccacctacgaccccgccctgcccagcacccccctgctgagccagcaggccctgaaccaccacatccacagcgtgaagaccgccagcatcggcaccctgggcagaagcagaccccccatgcccgtggtggtgcccagcgcccccgaggtgcaggagaccaccagaatgctggaggacagcgagagcagctacgagcccgacgagctgaccaaggagatggcccacctggagggcctgatgaaggacctgaacgccatcaccaccgcctag

SEQ ID NO: 90581 - DNA, 1074 bp, Artificial Sequence
  Description of Artificial Sequence: Synthetic coding sequence
atgcagagcgtgcagagcaccagcttctgcctgagaaagcagtgcctgtgcctgaccttcctgctgctgcacctgctgggccaggtggccgccacccagagatgccccccccagtgccccggcagatgccccgccaccccccccacctgcgcccccggcgtgagagccgtgctggacggctgcagctgctgcctggtgtgcgccagacagagaggcgagagctgcagcgacctggagccctgcgacgagagcagcggcctgtactgcgacagaagcgccgaccccagcaaccagaccggcatctgcaccgccgtggagggcgacaactgcgtgttcgacggcgtgatctacagaagcggcgagaagttccagcccagctgcaagttccagtgcacctgcagagacggccagatcggctgcgtgcccagatgccagctggacgtgctgctgcccgagcccaactgccccgcccccagaaaggtggaggtgcccggcgagtgctgcgagaagtggatctgcggccccgacgaggaggacagcctgggcggcctgaccctggccgcctacagacccgaggccaccctgggcgtggaggtgagcgacagcagcgtgaactgcatcgagcagaccaccgagtggaccgcctgcagcaagagctgcggcatgggcttcagcaccagagtgaccaacagaaacagacagtgcgagatgctgaagcagaccagactgtgcatggtgagaccctgcgagcaggagcccgagcagcccaccgacaagaagggcaagaagtgcctgagaaccaagaagagcctgaaggccatccacctgcagttcaagaactgcaccagcctgcacacctacaagcccagattctgcggcgtgtgcagcgacggcagatgctgcaccccccacaacaccaagaccatccaggccgagttccagtgcagccccggccagatcgtgaagaagcccgtgatggtgatcggcacctgcacctgccacaccaactgccccaagaacaacgaggccttcctgcaggagctggagctgaagaccaccagaggcaagatgtag

SEQ ID NO: 90582 - DNA, 2202 bp, Artificial Sequence
  Description of Artificial Sequence: Synthetic coding sequence
atgctggccagaagacagagagaccccctgcaggccctgagaagaagaaaccaggagctgaagcagcaggtggacagcctgctgagcgagagccagctgaaggaggccctggagcccaacaagagacagcacatctaccagagatgcatccagctgaagcaggccatcgacgagaacaagaacgccctgcagaagctgagcaaggccgacgagagcgcccccgtggccaactacaaccagagaaaggaggaggagcacaccctgctggacaagctgacccagcagctgcagggcctggccgtgaccatcagcagagagaacatcaccgaggtgggcgcccccaccgaggaggaggaggagagcgagagcgaggacagcgaggacagcggcggcgaggaggaggacgccgaggaggaggaggaggagaaggaggagaacgagagccacaagtggagcaccggcgaggagtacatcgccgtgggcgacttcaccgcccagcaggtgggcgacctgaccttcaagaagggcgagatcctgctggtgatcgagaagaagcccgacggctggtggatcgccaaggacgccaagggcaacgagggcctggtgcccagaacctacctggagccctacagcgaggaggaggagggccaggagagcagcgaggagggcagcgaggaggacgtggaggccgtggacgagaccgccgacggcgccgaggtgaagcagagaaccgacccccactggagcgccgtgcagaaggccatcagcgaggccggcatcttctgcctggtgaaccacgtgagcttctgctacctgatcgtgctgatgagaaacagaatggagaccgtggaggacaccaacggcagcgagaccggcttcagagcctggaacgtgcagagcagaggcagaatcttcctggtgagcaagcccgtgctgcagcagatcaacaccgtggacgtgctgaccaccatgggcgccatccccgccggcttcagacccagcaccctgagccagctgctggaggagggcaaccagttcagagccaactacttcctgcagcccgagctgatgcccagccagctggccttcagagacctgatgtgggacgccaccgagggcaccatcagaagcagacccagcagaatcagcctgatcctgaccctgtggagctgcaagatgatccccctgcccggcatgagcatccaggtgctgagcagacacgtgagactgtgcctgttcgacggcaacaaggtgctgagcaacatccacaccgtgagagccacctggcagcccaagaagcccaagacctggaccttcagcccccaggtgaccagaatcctgccctgcctgctggacggcgactgcttcatcagaagcaacagcgccagccccgacctgggcatcctgttcgagctgggcatcagctacatcagaaacagcaccggcgagagaggcgagctgagctgcggctgggtgttcctgaagctgttcgacgccagcggcgtgcccatccccgccaagacctacgagctgttcctgaacggcggcaccccctacgagaagggcatcgaggtggaccccagcatcagcagaagagcccacggcagcgtgttctaccagatcatgaccatgagaagacagccccagctgctggtgaagctgagaagcctgaacagaagaagcagaaacgtgctgagcctgctgcccgagaccctgatcggcaacatgtgcagcatccacctgctgatcttctacagacagatcctgggcgacgtgctgctgaaggacagaatgagcctgcagagcaccgacctgatcagccaccccatgctggccaccttccccatgctgctggagcagcccgacgtgatggacgccctgagaagcagctgggccggcaaggagagcaccctgaagagaagcgagaagagagacaaggagttcctgaagagcaccttcctgctggtgtaccacgactgcgtgctgcccctgctgcacagcaccagactgccccccttcagatgggccgaggaggagaccgagaccgccagatggaaggtgatcaccgacttcctgaagcagaaccaggagaaccagggcgccctgcaggccctgctgagccccgacggcgtgcacgagcccttcgacctgagcgagcagacctacgacttcctgggcgagatgagaaagaacgccgtgtag

SEQ ID NO: 90583 - DNA, 1845 bp, Artificial Sequence
  Description of Artificial Sequence: Synthetic coding sequence
atgctggccagaagacagagagaccccctgcaggccctgagaagaagaaaccaggagctgaagcagcaggtggacagcctgctgagcgagagccagctgaaggaggccctggagcccaacaagagacagcacatctaccagagagtgggcgcccccaccgaggaggaggaggagagcgagagcgaggacagcgaggacagcggcggcgaggaggaggacgccgaggaggaggaggaggagaaggaggagaacgagagccacaagtggagcaccggcgaggagtacatcgccgtgggcgacttcaccgcccagcaggtgggcgacctgaccttcaagaagggcgagatcctgctggtgatcgagaagaagcccgacggctggtggatcgccaaggacgccaagggcaacgagggcctggtgcccagaacctacctggagccctacagcgaggaggaggagggccaggagagcagcgaggagggcagcgaggaggacgtggaggccgtggacgagaccgccgacggcgccgaggtgaagcagagaaccgacccccactggagcgccgtgcagaaggccatcagcgagatcaacaccgtggacgtgctgaccaccatgggcgccatccccgccggcttcagacccagcaccctgagccagctgctggaggagggcaaccagttcagagccaactacttcctgcagcccgagctgatgcccagccagctggccttcagagacctgatgtgggacgccaccgagggcaccatcagaagcagacccagcagaatcagcctgatcctgaccctgtggagctgcaagatgatccccctgcccggcatgagcatccaggtgctgagcagacacgtgagactgtgcctgttcgacggcaacaaggtgctgagcaacatccacaccgtgagagccacctggcagcccaagaagcccaagacctggaccttcagcccccaggtgaccagaatcctgccctgcctgctggacggcgactgcttcatcagaagcaacagcgccagccccgacctgggcatcctgttcgagctgggcatcagctacatcagaaacagcaccggcgagagaggcgagctgagctgcggctgggtgttcctgaagctgttcgacgccagcggcgtgcccatccccgccaagacctacgagctgttcctgaacggcggcaccccctacgagaagggcatcgaggtggaccccagcatcagcagaagagcccacggcagcgtgttctaccagatcatgaccatgagaagacagccccagctgctggtgaagctgagaagcctgaacagaagaagcagaaacgtgctgagcctgctgcccgagaccctgatcggcaacatgtgcagcatccacctgctgatcttctacagacagatcctgggcgacgtgctgctgaaggacagaatgagcctgcagagcaccgacctgatcagccaccccatgctggccaccttccccatgctgctggagcagcccgacgtgatggacgccctgagaagcagctgggccggcaaggagagcaccctgaagagaagcgagaagagagacaaggagttcctgaagagcaccttcctgctggtgtaccacgactgcgtgctgcccctgctgcacagcaccagactgccccccttcagatgggccgaggaggagaccgagaccgccagatggaaggtgatcaccgacttcctgaagcagaaccaggagaaccagggcgccctgcaggccctgctgagccccgacggcgtgcacgagcccttcgacctgagcgagcagacctacgacttcctgggcgagatgagaaagaacgccgtgtag

SEQ ID NO: 90584 - DNA, 2199 bp, Artificial Sequence
  Description of Artificial Sequence: Synthetic coding sequence
atgctggccagaagacagagagaccccctgcaggccctgagaagaagaaaccaggagctgaagcagcaggtggacagcctgctgagcgagagccagctgaaggaggccctggagcccaacaagagacagcacatctaccagagatgcatccagctgaagcaggccatcgacgagaacaagaacgccctgcagaagctgagcaaggccgacgagagcgcccccgtggccaactacaaccagagaaaggaggaggagcacaccctgctggacaagctgacccagcagctgcagggcctggccgtgaccatcagcagagagaacatcaccgaggtgggcgcccccaccgaggaggaggaggagagcgagagcgaggacagcgaggacagcggcggcgaggaggaggacgccgaggaggaggaggaggagaaggaggagaacgagagccacaagtggagcaccggcgaggagtacatcgccgtgggcgacttcaccgcccagcaggtgggcgacctgaccttcaagaagggcgagatcctgctggtgatcgagaagaagcccgacggctggtggatcgccaaggacgccaagggcaacgagggcctggtgcccagaacctacctggagccctacagcgaggaggaggagggccaggagagcagcgaggagggcagcgaggaggacgtggaggccgtggacgagaccgccgacggcgccgaggtgaagcagagaaccgacccccactggagcgccgtgcagaaggccatcagcgaggccggcatcttctgcctggtgaaccacgtgagcttctgctacctgatcgtgctgatgagaaacagaatggagaccgtggaggacaccaacggcagcgagaccggcttcagagcctggaacgtgcagagcagaggcagaatcttcctggtgagcaagcccgtgctgcagatcaacaccgtggacgtgctgaccaccatgggcgccatccccgccggcttcagacccagcaccctgagccagctgctggaggagggcaaccagttcagagccaactacttcctgcagcccgagctgatgcccagccagctggccttcagagacctgatgtgggacgccaccgagggcaccatcagaagcagacccagcagaatcagcctgatcctgaccctgtggagctgcaagatgatccccctgcccggcatgagcatccaggtgctgagcagacacgtgagactgtgcctgttcgacggcaacaaggtgctgagcaacatccacaccgtgagagccacctggcagcccaagaagcccaagacctggaccttcagcccccaggtgaccagaatcctgccctgcctgctggacggcgactgcttcatcagaagcaacagcgccagccccgacctgggcatcctgttcgagctgggcatcagctacatcagaaacagcaccggcgagagaggcgagctgagctgcggctgggtgttcctgaagctgttcgacgccagcggcgtgcccatccccgccaagacctacgagctgttcctgaacggcggcaccccctacgagaagggcatcgaggtggaccccagcatcagcagaagagcccacggcagcgtgttctaccagatcatgaccatgagaagacagccccagctgctggtgaagctgagaagcctgaacagaagaagcagaaacgtgctgagcctgctgcccgagaccctgatcggcaacatgtgcagcatccacctgctgatcttctacagacagatcctgggcgacgtgctgctgaaggacagaatgagcctgcagagcaccgacctgatcagccaccccatgctggccaccttccccatgctgctggagcagcccgacgtgatggacgccctgagaagcagctgggccggcaaggagagcaccctgaagagaagcgagaagagagacaaggagttcctgaagagcaccttcctgctggtgtaccacgactgcgtgctgcccctgctgcacagcaccagactgccccccttcagatgggccgaggaggagaccgagaccgccagatggaaggtgatcaccgacttcctgaagcagaaccaggagaaccagggcgccctgcaggccctgctgagccccgacggcgtgcacgagcccttcgacctgagcgagcagacctacgacttcctgggcgagatgagaaagaacgccgtgtag

SEQ ID NO: 90585 - DNA, 2034 bp, Artificial Sequence
  Description of Artificial Sequence: Synthetic coding sequence
atgctggccagaagacagagagaccccctgcaggccctgagaagaagaaaccaggagctgaagcagcaggtggacagcctgctgagcgagagccagctgaaggaggccctggagcccaacaagagacagcacatctaccagagatgcatccagctgaagcaggccatcgacgagaacaagaacgccctgcagaagctgagcaaggccgacgagagcgcccccgtggccaactacaaccagagaaaggaggaggagcacaccctgctggacaagctgacccagcagctgcagggcctggccgtgaccatcagcagagagaacatcaccgaggtgggcgcccccaccgaggaggaggaggagagcgagagcgaggacagcgaggacagcggcggcgaggaggaggacgccgaggaggaggaggaggagaaggaggagaacgagagccacaagtggagcaccggcgaggagtacatcgccgtgggcgacttcaccgcccagcaggtgggcgacctgaccttcaagaagggcgagatcctgctggtgatcgagaagaagcccgacggctggtggatcgccaaggacgccaagggcaacgagggcctggtgcccagaacctacctggagccctacagcgaggaggaggagggccaggagagcagcgaggagggcagcgaggaggacgtggaggccgtggacgagaccgccgacggcgccgaggtgaagcagagaaccgacccccactggagcgccgtgcagaaggccatcagcgagcagatcaacaccgtggacgtgctgaccaccatgggcgccatccccgccggcttcagacccagcaccctgagccagctgctggaggagggcaaccagttcagagccaactacttcctgcagcccgagctgatgcccagccagctggccttcagagacctgatgtgggacgccaccgagggcaccatcagaagcagacccagcagaatcagcctgatcctgaccctgtggagctgcaagatgatccccctgcccggcatgagcatccaggtgctgagcagacacgtgagactgtgcctgttcgacggcaacaaggtgctgagcaacatccacaccgtgagagccacctggcagcccaagaagcccaagacctggaccttcagcccccaggtgaccagaatcctgccctgcctgctggacggcgactgcttcatcagaagcaacagcgccagccccgacctgggcatcctgttcgagctgggcatcagctacatcagaaacagcaccggcgagagaggcgagctgagctgcggctgggtgttcctgaagctgttcgacgccagcggcgtgcccatccccgccaagacctacgagctgttcctgaacggcggcaccccctacgagaagggcatcgaggtggaccccagcatcagcagaagagcccacggcagcgtgttctaccagatcatgaccatgagaagacagccccagctgctggtgaagctgagaagcctgaacagaagaagcagaaacgtgctgagcctgctgcccgagaccctgatcggcaacatgtgcagcatccacctgctgatcttctacagacagatcctgggcgacgtgctgctgaaggacagaatgagcctgcagagcaccgacctgatcagccaccccatgctggccaccttccccatgctgctggagcagcccgacgtgatggacgccctgagaagcagctgggccggcaaggagagcaccctgaagagaagcgagaagagagacaaggagttcctgaagagcaccttcctgctggtgtaccacgactgcgtgctgcccctgctgcacagcaccagactgccccccttcagatgggccgaggaggagaccgagaccgccagatggaaggtgatcaccgacttcctgaagcagaaccaggagaaccagggcgccctgcaggccctgctgagccccgacggcgtgcacgagcccttcgacctgagcgagcagacctacgacttcctgggcgagatgagaaagaacgccgtgtag

SEQ ID NO: 90586 - DNA, 2115 bp, Artificial Sequence
  Description of Artificial Sequence: Synthetic coding sequence
atgggcaccgccagcagcctggtgagccccgccggcggcgaggtgatcgaggacacctacggcgccggcggcggcgaggcctgcgagatccccgtggaggtgaagcccaaggccagactgctgagaaacagcttcagaagaggcgccggcgccgccgccggcgccggccccggcagcctgcccagaggcgtgggcgccggcggcctgctgggcgccagcttcaagagcaccggcagcagcgtgcccgagctggagtacgccgccgccgagtacgagagactgagaaaggagtacgagatcttcagagtgagcaagaaccaggagctgctgagcatgggcagaagagaggccaagctggacaccgagaacaagagactgagagccgagctgcaggccctgcagaagacctaccagaagatcctgagagagaaggagagcgccctggaggccaagtaccaggccatggagagagccgccaccttcgagcacgacagagacaaggtgaagagacagttcaagatcttcagagagaccaaggagaacgagatccaggacctgctgagagccaagagagagctggagagcaagctgcagagactgcaggcccagggcatccaggtgttcgaccccggcgagagcgacagcgacgacaactgcaccgacgtgaccgccgccggcacccagtgcgagtactggaccggcggcgccctgggcagcgagcccagcatcggcagcatgatccagctgcagcagagcttcagaggccccgagttcgcccacagcagcatcgacgtggagggccccttcgccaacgtgaacagagacgactgggacatcgccgtggccagcctgctgcaggtgacccccctgttcagccacagcctgtggagcaacaccgtgagatgctacctgatctacaccgacgagacccagcccgagatggacctgttcctgaaggactacagccccaagctgaagagaatgtgcgagaccatgggctacttcttccacgccgtgtacttccccatcgacgtggagaaccagtacctgaccgtgagaaagtgggagatcgagaagagcagcctggtgatcctgttcatccacctgaccctgcccagcctgctgctggaggactgcgaggaggccttcctgaagaaccccgagggcaagcccagactgatcttccacagactggaggacggcaaggtgagcagcgacagcgtgcagcagctgatcgaccaggtgagcaacctgaacaagaccagcaaggccaagatcatcgaccacagcggcgaccccgccgagggcgtgtacaagacctacatctgcgtggagaagatcatcaagcaggacatcctgggcttcgagaacaccgacctggagaccaaggacctgggcagcgaggacagcatccccgaggaggacgacttcggcgacgtgctgtgggacatccacgacgagcaggagcagatggagaccttccagcaggccagcaacagcgcccacgagctgggcttcgagaagtactaccagagactgaacgacctggtggccgcccccgcccccatcccccccctgctggtgagcggcggccccggcagcggcaagagcctgctgctgagcaagtggatccagctgcagcagaagaacagccccaacaccctgatcctgagccacttcgtgggcagacccatgagcaccagcagcgagagcagcctgatcatcaagagactgaccctgaagctgatgcagcacagctggagcgtgagcgccctgaccctggaccccgccaagctgctggaggagttccccagatggctggagaagctgagcgccagacaccagggcagcatcatcatcgtgatcgacagcatcgaccaggtgcagcaggtggagaagcacatgaagtggctgatcgaccccctgcccgtgaacgtgagagtgatcgtgagcgtgaacgtggagacctgcccccccgcctggagactgtggcccaccctgcacctggaccccctgagccccaaggacgccaagagcatcatcatcgccgagtgccacagcgtggacatcaagctgagcaaggagcagtgctgggagagcagacagttcagatag

SEQ ID NO: 90587 - DNA, 3993 bp, Artificial Sequence
  Description of Artificial Sequence: Synthetic coding sequence
atgggcaccgccagcagcctggtgagccccgccggcggcgaggtgatcgaggacacctacggcgccggcggcggcgaggcctgcgagatccccgtggaggtgaagcccaaggccagactgctgagaaacagcttcagaagaggcgccggcgccgccgccggcgccggccccggcagcctgcccagaggcgtgggcgccggcggcctgctgggcgccagcttcaagagcaccggcagcagcgtgcccgagctggagtacgccgccgccgagtacgagagactgagaaaggagtacgagatcttcagagtgagcaagaaccaggagctgctgagcatgggcagaagagaggccaagctggacaccgagaacaagagactgagagccgagctgcaggccctgcagaagacctaccagaagatcctgagagagaaggagagcgccctggaggccaagtaccaggccatggagagagccgccaccttcgagcacgacagagacaaggtgaagagacagttcaagatcttcagagagaccaaggagaacgagatccaggacctgctgagagccaagagagagctggagagcaagctgcagagactgcaggcccagggcatccaggtgttcgaccccggcgagagcgacagcgacgacaactgcaccgacgtgaccgccgccggcacccagtgcgagtactggaccggcggcgccctgggcagcgagcccagcatcggcagcatgatccagctgcagcagagcttcagaggccccgagttcgcccacagcagcatcgacgtggagggccccttcgccaacgtgaacagagacgactgggacatcgccgtggccagcctgctgcaggtgacccccctgttcagccacagcctgtggagcaacaccgtgagatgctacctgatctacaccgacgagacccagcccgagatggacctgttcctgaaggactacagccccaagctgaagagaatgtgcgagaccatgggctacttcttccacgccgtgtacttccccatcgacgtggagaaccagtacctgaccgtgagaaagtgggagatcgagaagagcagcctggtgatcctgttcatccacctgaccctgcccagcctgctgctggaggactgcgaggaggccttcctgaagaaccccgagggcaagcccagactgatcttccacagactggaggacggcaaggtgagcagcgacagcgtgcagcagctgatcgaccaggtgagcaacctgaacaagaccagcaaggccaagatcatcgaccacagcggcgaccccgccgagggcgtgtacaagacctacatctgcgtggagaagatcatcaagcaggacatcctgggcttcgagaacaccgacctggagaccaaggacctgggcagcgaggacagcatccccgaggaggacgacttcggcgacgtgctgtgggacatccacgacgagcaggagcagatggagaccttccagcaggccagcaacagcgcccacgagctgggcttcgagaagtactaccagagactgaacgacctggtggccgcccccgcccccatcccccccctgctggtgagcggcggccccggcagcggcaagagcctgctgctgagcaagtggatccagctgcagcagaagaacagccccaacaccctgatcctgagccacttcgtgggcagacccatgagcaccagcagcgagagcagcctgatcatcaagagactgaccctgaagctgatgcagcacagctggagcgtgagcgccctgaccctggaccccgccaagctgctggaggagttccccagatggctggagaagctgagcgccagacaccagggcagcatcatcatcgtgatcgacagcatcgaccaggtgcagcaggtggagaagcacatgaagtggctgatcgaccccctgcccgtgaacgtgagagtgatcgtgagcgtgaacgtggagacctgcccccccgcctggagactgtggcccaccctgcacctggaccccctgagccccaaggacgccaagagcatcatcatcgccgagtgccacagcgtggacatcaagctgagcaaggagcaggagaagaagctggagagacactgcagaagcgccaccacctgcaacgccctgtacgtgaccctgttcggcaagatgatcgccagagccggcagagccggcaacctggacaagatcctgcaccagtgcttccagtgccaggacaccctgagcctgtacagactggtgctgcacagcatcagagagagcatggccaacgacgtggacaaggagctgatgaagcagatcctgtgcctggtgaacgtgagccacaacggcgtgagcgagagcgagctgatggagctgtaccccgagatgagctggaccttcctgaccagcctgatccacagcctgtacaagatgtgcctgctgacctacggctgcggcctgctgagattccagcacctgcaggcctgggagaccgtgagactggagtacctggagggccccaccgtgaccagcagctacagacagaagctgatcaactacttcaccctgcagctgagccaggacagagtgacctggagaagcgccgacgagctgccctggctgttccagcagcagggcagcaagcagaagctgcacgactgcctgctgaacctgttcgtgagccagaacctgtacaagagaggccacttcgccgagctgctgagctactggcagttcgtgggcaaggacaagagcgccatggccaccgagtacttcgacagcctgaagcagtacgagaagaactgcgagggcgaggacaacatgagctgcctggccgacctgtacgagaccctgggcagattcctgaaggacctgggcctgctgagccaggccatcgtgcccctgcagagaagcctggagatcagagagaccgccctggaccccgaccaccccagagtggcccagagcctgcaccagctggccagcgtgtacgtgcagtggaagaagttcggcaacgccgagcagctgtacaagcaggccctggagatcagcgagaacgcctacggcgccgaccacccctacaccgccagagagctggaggccctggccaccctgtaccagaagcagaacaagtacgagcaggccgagcacttcagaaagaagagcttcaagatccaccagaaggccatcaagaagaagggcaacctgtacggcttcgccctgctgagaagaagagccctgcagctggaggagctgaccctgggcaaggacacccccgacaacgccagaaccctgaacgagctgggcgtgctgtactacctgcagaacaacctggagaccgccgaccagttcctgaagagaagcctggagatgagagagagagtgctgggccccgaccaccccgactgcgcccagagcctgaacaacctggccgccctgtgcaacgagaagaagcagtacgacaaggccgaggagctgtacgagagagccctggacatcagaagaagagccctggcccccgaccaccccagcctggcctacaccgtgaagcacctggccatcctgtacaagaagatgggcaagctggacaaggccgtgcccctgtacgagctggccgtggagatcagacagaagagcttcggccccaagcaccccagcgtggccaccgccctggtgaacctggccgtgctgtacagccagatgaagaagcacgtggaggccctgcccctgtacgagagagccctgaagatctacgaggacagcctgggcagaatgcaccccagagtgggcgagaccctgaagaacctggccgtgctgagctacgagggcggcgacttcgagaaggccgccgagctgtacaagagagccatggagatcaaggaggccgagaccagcctgctgggcggcaaggcccccagcagacacagcagcagcggcgacaccttcagcctgaagaccgcccacagccccaacgtgttcctgcagcagggccagagatag

SEQ ID NO: 90588 - DNA, 720 bp, Artificial Sequence
  Description of Artificial Sequence: Synthetic coding sequence
atgggcaccgccagcagcctggtgagccccgccggcggcgaggtgatcgaggacacctacggcgccggcggcggcgaggcctgcgagatccccgtggaggtgaagcccaaggccagactgctgagaaacagcttcagaagaggcgccggcgccgccgccggcgccggccccggcagcctgcccagaggcgtgggcgccggcggcctgctgggcgccagcttcaagagcaccggcagcagcgtgcccgagctggagtacgccgccgccgagtacgagagactgagaaaggagtacgagatcttcagagtgagcaagaaccaggagctgctgagcatgggcagaagagaggccaagctggacaccgagaacaagagactgagagccgagctgcaggccctgcagaagacctaccagaagatcctgagagagaaggagagcgccctggaggccaagtaccaggccatggagagagccgccaccttcgagcacgacagagacaaggtgaagagacagttcaagatcttcagagagaccaaggagaacgagatccaggacctgctgagagccaagagagagctggagagcaagctgcagagactgcaggcccagggcatccaggtgttcgaccccggcgagagcgacagcgacgacaactgcaccgacgtgaccgtgagcctggagagcgaccagcaccccggcatcttcatcgccaacttctag

SEQ ID NO: 90589 - DNA, 453 bp, Artificial Sequence
  Description of Artificial Sequence: Synthetic coding sequence
atgggcaccgccagcagcctggtgagccccgccggcggcgaggtgatcgaggacacctacggcgccggcggcggcgaggcctgcgagatccccgtggaggtgaagcccaaggccagactgctgagaaacagcttcagaagaggcgccggcgccgccgccggcgccggccccggcagcctgcccagaggcgtgggcgccggcggcctgctgggcgccagcttcaagagcaccggcagcagcgtgcccgagctggagtacgccgccgccgagtacgagagactgagaaaggagtacgagatcttcagagtgagcaagaaccaggagctgctgagcatgggcagaagagaggccaagctggacaccgagaacaagagactgagagccgagctgcagggcctggccgccgtggccagaagcagactgaccgccacctggaacagctgggcccagtag

SEQ ID NO: 90590 - DNA, 1914 bp, Artificial Sequence
  Description of Artificial Sequence: Synthetic coding sequence
atcatcgccaacgccggcagagccggcaacctggacaagatcctgcaccagtgcttccagtgccaggacaccctgagcctgtacagactggtgctgcacagcatcagagagagcatggccaacgacgtggacaaggagctgatgaagcagatcctgtgcctggtgaacgtgagccacaacggcgtgagcgagagcgagctgatggagctgtaccccgagatgagctggaccttcctgaccagcctgatccacagcctgtacaagatgtgcctgctgacctacggctgcggcctgctgagattccagcacctgcaggcctgggagaccgtgagactggagtacctggagggccccaccgtgaccagcagctacagacagaagctgatcaactacttcaccctgcagctgagccaggacagagtgacctggagaagcgccgacgagctgccctggctgttccagcagcagggcagcaagcagaagctgcacgactgcctgctgaacctgttcgtgagccagaacctgtacaagagaggccacttcgccgagctgctgagctactggcagttcgtgggcaaggacaagagcgccatggccaccgagtacttcgacagcctgaagcagtacgagaagaactgcgagggcgaggacaacatgagctgcctggccgacctgtacgagaccctgggcagattcctgaaggacctgggcctgctgagccaggccatcgtgcccctgcagagaagcctggagatcagagagaccgccctggaccccgaccaccccagagtggcccagagcctgcaccagctggccagcgtgtacgtgcagtggaagaagttcggcaacgccgagcagctgtacaagcaggccctggagatcagcgagaacgcctacggcgccgaccacccctacaccgccagagagctggaggccctggccaccctgtaccagaagcagaacaagtacgagcaggccgagcacttcagaaagaagagcttcaagatccaccagaaggccatcaagaagaagggcaacctgtacggcttcgccctgctgagaagaagagccctgcagctggaggagctgaccctgggcaaggacacccccgacaacgccagaaccctgaacgagctgggcgtgctgtactacctgcagaacaacctggagaccgccgaccagttcctgaagagaagcctggagatgagagagagagtgctgggccccgaccaccccgactgcgcccagagcctgaacaacctggccgccctgtgcaacgagaagaagcagtacgacaaggccgaggagctgtacgagagagccctggacatcagaagaagagccctggcccccgaccaccccagcctggcctacaccgtgaagcacctggccatcctgtacaagaagatgggcaagctggacaaggccgtgcccctgtacgagctggccgtggagatcagacagaagagcttcggccccaagcaccccagcgtggccaccgccctggtgaacctggccgtgctgtacagccagatgaagaagcacgtggaggccctgcccctgtacgagagagccctgaagatctacgaggacagcctgggcagaatgcaccccagagtgggcgagaccctgaagaacctggccgtgctgagctacgagggcggcgacttcgagaaggccgccgagctgtacaagagagccatggagatcaaggaggccgagaccagcctgctgggcggcaaggcccccagcagacacagcagcagcggcgacaccttcagcctgaagaccgcccacagccccaacgtgttcctgcagcagggccagagaaaggtgcagagcaacctgctgagccccgagggcctgagcaacatctgcgcccaggagaagaccaccagattcaccagcagctag

SEQ ID NO: 90591 - DNA, 1236 bp, Artificial Sequence
  Description of Artificial Sequence: Synthetic coding sequence
atgagctgcctggccgacctgtacgagaccctgggcagattcctgaaggacctgggcctgctgagccaggccatcgtgcccctgcagagaagcctggagatcagagagaccgccctggaccccgaccaccccagagtggcccagagcctgcaccagctggccagcgtgtacgtgcagtggaagaagttcggcaacgccgagcagctgtacaagcaggccctggagatcagcgagaacgcctacggcgccgaccacccctacaccgccagagagctggaggccctggccaccctgtaccagaagcagaacaagtacgagcaggccgagcacttcagaaagaagagcttcaagatccaccagaaggccatcaagaagaagggcaacctgtacggcttcgccctgctgagaagaagagccctgcagctggaggagctgaccctgggcaaggacacccccgacaacgccagaaccctgaacgagctgggcgtgctgtactacctgcagaacaacctggagaccgccgaccagttcctgaagagaagcctggagatgagagagagagtgctgggccccgaccaccccgactgcgcccagagcctgaacaacctggccgccctgtgcaacgagaagaagcagtacgacaaggccgaggagctgtacgagagagccctggacatcagaagaagagccctggcccccgaccaccccagcctggcctacaccgtgaagcacctggccatcctgtacaagaagatgggcaagctggacaaggccgtgcccctgtacgagctggccgtggagatcagacagaagagcttcggccccaagcaccccagcgtggccaccgccctggtgaacctggccgtgctgtacagccagatgaagaagcacgtggaggccctgcccctgtacgagagagccctgaagatctacgaggacagcctgggcagaatgcaccccagagtgggcgagaccctgaagaacctggccgtgctgagctacgagggcggcgacttcgagaaggccgccgagctgtacaagagagccatggagatcaaggaggccgagaccagcctgctgggcggcaaggcccccagcagacacagcagcagcggcgacaccttcagcctgaagaccgcccacagccccaacgtgttcctgcagcagggccagagagccggcaagagcaaccccaccttctacctgcagaagggcttccagacctacgtgctgtag

SEQ ID NO: 90592 - DNA, 4281 bp, Artificial Sequence
  Description of Artificial Sequence: Synthetic coding sequence
atgaacgactggcacagaatcttcacccagaacgtgctggtgcccccccacccccagagagccagacagccctggaaggagagcaccgccttccagtgcgtgctgaagtggctggacggccccgtgatcagacagggcgtgctggaggtgctgagcgaggtggagtgccacctgagagtgagcttcttcgacgtgacctacagacacttcttcggcagaacctggaagaccaccgtgaagcccaccaagagaccccccagcagaatcgtgttcaacgagcccctgtacttccacaccagcctgaaccacccccacatcgtggccgtggtggaggtggtggccgagggcaagaagagagacggcagcctgcagaccctgagctgcggcttcggcatcctgagaatcttcagcaaccagcccgacagccccatcagcgccagccaggacaagagactgagactgtaccacggcacccccagagccctgctgcaccccctgctgcaggaccccgccgagcagaacagacacatgaccctgatcgagaactgcagcctgcagtacaccctgaagccccaccccgccctggagcccgccttccacctgctgcccgagaacctgctggtgagcggcctgcagcagatccccggcctgctgcccgcccacggcgagagcggcgacgccctgagaaagcccagactgcagaagcccatcaccggccacctggacgacctgttcttcaccctgtaccccagcctggagaagttcgaggaggagctgctggagctgcacgtgcaggaccacttccaggagggctgcggccccctggacggcggcgccctggagatcctggagagaagactgagagtgggcgtgcacaacggcctgggcttcgtgcagagaccccaggtggtggtgctggtgcccgagatggacgtggccctgaccagaagcgccagcttcagcagaaaggtggtgagcagcagcaagaccagcagcggcagccaggccctggtgctgagaagcagactgagactgcccgagatggtgggccaccccgccttcgccgtgatcttccagctggagtacgtgttcagcagccccgccggcgtggacggcaacgccgccagcgtgaccagcctgagcaacctggcctgcatgcacatggtgagatgggccgtgtggaaccccctgctggaggccgacagcggcagagtgaccctgcccctgcagggcggcatccagcccaaccccagccactgcctggtgtacaaggtgcccagcgccagcatgagcagcgaggaggtgaagcaggtggagagcggcaccctgagattccagttcagcctgggcagcgaggagcacctggacgcccccaccgagcccgtgagcggccccaaggtggagagaagacccagcagaaagccccccaccagccccagcagcccccccgcccccgtgcccagagtgctggccgccccccagaacagccccgtgggccccggcctgagcatcagccagctggccgccagccccagaagccccacccagcactgcctggccagacccaccagccagctgccccacggcagccaggccagccccgcccaggcccaggagttccccctggaggccggcatcagccacctggaggccgacctgagccagaccagcctggtgctggagaccagcatcgccgagcagctgcaggagctgcccttcacccccctgcacgcccccatcgtggtgggcacccagaccagaagcagcgccggccagcccagcagagccagcatggtgctgctgcagagcagcggcttccccgagatcctggacgccaacaagcagcccgccgaggccgtgagcgccaccgagcccgtgaccttcaacccccagaaggaggagagcgactgcctgcagagcaacgagatggtgctgcagttcctggccttcagcagagtggcccaggactgcagaggcaccagctggcccaagaccgtgtacttcaccttccagttctacagattcccccccgccaccacccccagactgcagctggtgcagctggacgaggccggccagcccagcagcggcgccctgacccacatcctggtgcccgtgagcagagacggcaccttcgacgccggcagccccggcttccagctgagatacatggtgggccccggcttcctgaagcccggcgagagaagatgcttcgccagatacctggccgtgcagaccctgcagatcgacgtgtgggacggcgacagcctgctgctgatcggcagcgccgccgtgcagatgaagcacctgctgagacagggcagacccgccgtgcaggccagccacgagctggaggtggtggccaccgagtacgagcaggacaacatggtggtgagcggcgacatgctgggcttcggcagagtgaagcccatcggcgtgcacagcgtggtgaagggcagactgcacctgaccctggccaacgtgggccacccctgcgagcagaaggtgagaggctgcagcaccctgccccccagcagaagcagagtgatcagcaacgacggcgccagcagattcagcggcggcagcctgctgaccaccggcagcagcagaagaaagcacgtggtgcaggcccagaagctggccgacgtggacagcgagctggccgccatgctgctgacccacgccagacagggcaagggcccccaggacgtgagcagagagagcgacgccaccagaagaagaaagctggagagaatgagaagcgtgagactgcaggaggccggcggcgacctgggcagaagaggcaccagcgtgctggcccagcagagcgtgagaacccagcacctgagagacctgcaggtgatcgccgcctacagagagagaaccaaggccgagagcatcgccagcctgctgagcctggccatcaccaccgagcacaccctgcacgccaccctgggcgtggccgagttcttcgagttcgtgctgaagaacccccacaacacccagcacaccgtgaccgtggagatcgacaaccccgagctgagcgtgatcgtggacagccaggagtggagagacttcaagggcgccgccggcctgcacacccccgtggaggaggacatgttccacctgagaggcagcctggccccccagctgtacctgagaccccacgagaccgcccacgtgcccttcaagttccagagcttcagcgccggccagctggccatggtgcaggccagccccggcctgagcaacgagaagggcatggacgccgtgagcccctggaagagcagcgccgtgcccaccaagcacgccaaggtgctgttcagagccagcggcggcaagcccatcgccgtgctgtgcctgaccgtggagctgcagccccacgtggtggaccaggtgttcagattctaccaccccgagctgagcttcctgaagaaggccatcagactgcccccctggcacaccttccccggcgcccccgtgggcatgctgggcgaggacccccccgtgcacgtgagatgcagcgaccccaacgtgatctgcgagacccagaacgtgggccccggcgagcccagagacatcttcctgaaggtggccagcggccccagccccgagatcaaggacttcttcgtgatcatctacagcgacagatggctggccacccccacccagacctggcaggtgtacctgcacagcctgcagagagtggacgtgagctgcgtggccggccagctgaccagactgagcctggtgctgagaggcacccagaccgtgagaaaggtgagagccttcaccagccacccccaggagctgaagaccgaccccaagggcgtgttcgtgctgccccccagaggcgtgcaggacctgcacgtgggcgtgagacccctgagagccggcagcagattcgtgcacctgaacctggtggacgtggactgccaccagctggtggccagctggctggtgtgcctgtgctgcagacagcccctgatcagcaaggccttcgagatcatgctggccgccggcgagggcaagggcgtgaacaagagaatcacctacaccaacccctaccccagcagaagaaccttccacctgcacagcgaccaccccgagctgctgagattcagagaggacagcttccaggtgggcggcggcgagacctacaccatcggcctgcagttcgcccccagccagagagtgggcgaggaggagatcctgatctacatcaacgaccacgaggacaagaacgaggaggccttctgcgtgaaggtgatctaccagtag

SEQ ID NO: 90593 - DNA, 546 bp, Artificial Sequence
  Description of Artificial Sequence: Synthetic coding sequence
atggtgctgctgcagagcagcggcttccccgagatcctggacgccaacaagcagcccgccgaggccgtgagcgccaccgagcccgtgaccttcaacccccagaaggaggagagcgactgcctgcagagcaacgagatggtgctgcagttcctggccttcagcagagtggcccaggactgcagaggcaccagctggcccaagaccgtgtacttcaccttccagttctacagattcccccccgccaccacccccagactgcagctggtgcagctggacgaggccggccagcccagcagcggcgccctgacccacatcctggtgcccgtgagcagagacggcaccttcgacgccggcagccccggcttccagctgagatacatggtgggccccggcttcctgaagcccggcgagagaagatgcttcgccagatacctggccgtgcagaccctgcagatcgacgtgtgggacggcgacagcctgctgctgatcggcagcgccgccgtgcagatgaaggagaccagccacatcttcagcgtgagccagtag

SEQ ID NO: 90594 - DNA, 3606 bp, Artificial Sequence
  Description of Artificial Sequence: Synthetic coding sequence
atggccctgggcaccaccctgagagccagcctgctgctgctgggcctgctgaccgagggcctggcccagctggccatccccgccagcgtgcccagaggcttctgggccctgcccgagaacctgaccgtggtggagggcgccagcgtggagctgagatgcggcgtgagcacccccggcagcgccgtgcagtgggccaaggacggcctgctgctgggccccgaccccagaatccccggcttccccagatacagactggagggcgaccccgccagaggcgagttccacctgcacatcgaggcctgcgacctgagcgacgacgccgagtacgagtgccaggtgggcagaagcgagatgggccccgagctggtgagccccagagtgatcctgagcatcctggtgccccccaagctgctgctgctgacccccgaggccggcaccatggtgacctgggtggccggccaggagtacgtggtgaactgcgtgagcggcgacgccaagcccgcccccgacatcaccatcctgctgagcggccagaccatcagcgacatcagcgccaacgtgaacgagggcagccagcagaagctgttcaccgtggaggccaccgccagagtgacccccagaagcagcgacaacagacagctgctggtgtgcgaggccagcagccccgccctggaggcccccatcaaggccagcttcaccgtgaacgtgctgttcccccccggcccccccgtgatcgagtggcccggcctggacgagggccacgtgagagccggccagagcctggagctgccctgcgtggccagaggcggcaaccccctggccaccctgcagtggctgaagaacggccagcccgtgagcaccgcctggggcaccgagcacacccaggccgtggccagaagcgtgctggtgatgaccgtgagacccgaggaccacggcgcccagctgagctgcgaggcccacaacagcgtgagcgccggcacccaggagcacggcatcaccctgcaggtgaccttcccccccagcgccatcatcatcctgggcagcgccagccagaccgagaacaagaacgtgaccctgagctgcgtgagcaagagcagcagacccagagtgctgctgagatggtggctgggctggagacagctgctgcccatggaggagaccgtgatggacggcctgcacggcggccacatcagcatgagcaacctgaccttcctggccagaagagaggacaacggcctgaccctgacctgcgaggccttcagcgaggccttcaccaaggagaccttcaagaagagcctgatcctgaacgtgaagtaccccgcccagaagctgtggatcgagggcccccccgagggccagaagctgagagccggcaccagagtgagactggtgtgcctggccatcggcggcaaccccgagcccagcctgatgtggtacaaggacagcagaaccgtgaccgagagcagactgccccaggagagcagaagagtgcacctgggcagcgtggagaagagcggcagcaccttcagcagagagctggtgctggtgaccggccccagcgacaaccaggccaagttcacctgcaaggccggccagctgagcgccagcacccagctggccgtgcagttcccccccaccaacgtgaccatcctggccaacgccagcgccctgagacccggcgacgccctgaacctgacctgcgtgagcgtgagcagcaacccccccgtgaacctgagctgggacaaggagggcgagagactggagggcgtggccgccccccccagaagagcccccttcaagggcagcgccgccgccagaagcgtgctgctgcaggtgagcagcagagaccacggccagagagtgacctgcagagcccacagcgccgagctgagagagaccgtgagcagcttctacagactgaacgtgctgtacagacccgagttcctgggcgagcaggtgctggtggtgaccgccgtggagcagggcgaggccctgctgcccgtgagcgtgagcgccaaccccgcccccgaggccttcaactggaccttcagaggctacagactgagccccgccggcggccccagacacagaatcctgagcagcggcgccctgcacctgtggaacgtgaccagagccgacgacggcctgtaccagctgcactgccagaacagcgagggcaccgccgaggccagactgagactggacgtgcactacgcccccaccatcagagccctgcaggaccccaccgaggtgaacgtgggcggcagcgtggacatcgtgtgcaccgtggacgccaaccccatcctgcccggcatgttcaactgggagagactgggcgaggacgaggaggaccagagcctggacgacatggagaagatcagcagaggccccaccggcagactgagaatccaccacgccaagctggcccaggccggcgcctaccagtgcatcgtggacaacggcgtggccccccccgccagaagactgctgagactggtggtgagattcgccccccaggtggagcaccccacccccctgaccaaggtggccgccgccggcgacagcaccagcagcgccaccctgcactgcagagccagaggcgtgcccaacatcgtgttcacctggaccaagaacggcgtgcccctggacctgcaggaccccagatacaccgagcacacctaccaccagggcggcgtgcacagcagcctgctgaccatcgccaacgtgagcgccgcccaggactacgccctgttcacctgcaccgccaccaacgccctgggcagcgaccagaccaacatccagctggtgagcatcagcagacccgacccccccagcggcctgaaggtggtgagcctgaccccccacagcgtgggcctggagtggaagcccggcttcgacggcggcctgccccagagattctgcatcagatacgaggccctgggcacccccggcttccactacgtggacgtggtgcccccccaggccaccaccttcaccctgaccggcctgcagcccagcaccagatacagagtgtggctgctggccagcaacgccctgggcgacagcggcctggccgacaagggcacccagctgcccatcaccacccccggcctgcaccagcccagcggcgagcccgaggaccagctgcccaccgagccccccagcggcatcagcgagaagaccgaggccggcagcgaggaggacagagtgagaaacgagtacgaggagagccagtggaccggcgagagagacacccagagcagcaccgtgagcaccaccgaggccgagccctactacagaagcctgagagacttcagcccccagctgccccccacccaggaggaggtgagctacagcagaggcttcaccggcgaggacgaggacatggccttccccggccacctgtacgacgaggtggagagaacctacccccccagcggcgcctggggccccctgtacgacgaggtgcagatgggcccctgggacctgcactggcccgaggacacctaccaggaccccagaggcatctacgaccaggtggccggcgacctggacaccctggagcccgacagcctgcccttcgagctgagaggccacctggtgtag

SEQ ID NO: 90595 - DNA, 3726 bp, Artificial Sequence
  Description of Artificial Sequence: Synthetic coding sequence
atggccctgggcaccaccctgagagccagcctgctgctgctgggcctgctgaccgagggcctggcccagctggccatccccgccagcgtgcccagaggcttctgggccctgcccgagaacctgaccgtggtggagggcgccagcgtggagctgagatgcggcgtgagcacccccggcagcgccgtgcagtgggccaaggacggcctgctgctgggccccgaccccagaatccccggcttccccagatacagactggagggcgaccccgccagaggcgagttccacctgcacatcgaggcctgcgacctgagcgacgacgccgagtacgagtgccaggtgggcagaagcgagatgggccccgagctggtgagccccagagtgatcctgagcatcctggtgccccccaagctgctgctgctgacccccgaggccggcaccatggtgacctgggtggccggccaggagtacgtggtgaactgcgtgagcggcgacgccaagcccgcccccgacatcaccatcctgctgagcggccagaccatcagcgacatcagcgccaacgtgaacgagggcagccagcagaagctgttcaccgtggaggccaccgccagagtgacccccagaagcagcgacaacagacagctgctggtgtgcgaggccagcagccccgccctggaggcccccatcaaggccagcttcaccgtgaacgtgctgttcccccccggcccccccgtgatcgagtggcccggcctggacgagggccacgtgagagccggccagagcctggagctgccctgcgtggccagaggcggcaaccccctggccaccctgcagtggctgaagaacggccagcccgtgagcaccgcctggggcaccgagcacacccaggccgtggccagaagcgtgctggtgatgaccgtgagacccgaggaccacggcgcccagctgagctgcgaggcccacaacagcgtgagcgccggcacccaggagcacggcatcaccctgcaggtgaccttcccccccagcgccatcatcatcctgggcagcgccagccagaccgagaacaagaacgtgaccctgagctgcgtgagcaagagcagcagacccagagtgctgctgagatggtggctgggctggagacagctgctgcccatggaggagaccgtgatggacggcctgcacggcggccacatcagcatgagcaacctgaccttcctggccagaagagaggacaacggcctgaccctgacctgcgaggccttcagcgaggccttcaccaaggagaccttcaagaagagcctgatcctgaacgtgaagtaccccgcccagaagctgtggatcgagggcccccccgagggccagaagctgagagccggcaccagagtgagactggtgtgcctggccatcggcggcaaccccgagcccagcctgatgtggtacaaggacagcagaaccgtgaccgagagcagactgccccaggagagcagaagagtgcacctgggcagcgtggagaagagcggcagcaccttcagcagagagctggtgctggtgaccggccccagcgacaaccaggccaagttcacctgcaaggccggccagctgagcgccagcacccagctggccgtgcagttcccccccaccaacgtgaccatcctggccaacgccagcgccctgagacccggcgacgccctgaacctgacctgcgtgagcgtgagcagcaacccccccgtgaacctgagctgggacaaggagggcgagagactggagggcgtggccgccccccccagaagagcccccttcaagggcagcgccgccgccagaagcgtgctgctgcaggtgagcagcagagaccacggccagagagtgacctgcagagcccacagcgccgagctgagagagaccgtgagcagcttctacagactgaacgtgctgtacagacccgagttcctgggcgagcaggtgctggtggtgaccgccgtggagcagggcgaggccctgctgcccgtgagcgtgagcgccaaccccgcccccgaggccttcaactggaccttcagaggctacagactgagccccgccggcggccccagacacagaatcctgagcagcggcgccctgcacctgtggaacgtgaccagagccgacgacggcctgtaccagctgcactgccagaacagcgagggcaccgccgaggccagactgagactggacgtgcactacgcccccaccatcagagccctgcaggaccccaccgaggtgaacgtgggcggcagcgtggacatcgtgtgcaccgtggacgccaaccccatcctgcccggcatgttcaactgggagagactgggcgaggacgaggaggaccagagcctggacgacatggagaagatcagcagaggccccaccggcagactgagaatccaccacgccaagctggcccaggccggcgcctaccagtgcatcgtggacaacggcgtggccccccccgccagaagactgctgagactggtggtgagattcgccccccaggtggagcaccccacccccctgaccaaggtggccgccgccggcgacagcaccagcagcgccaccctgcactgcagagccagaggcgtgcccaacatcgtgttcacctggaccaagaacggcgtgcccctggacctgcaggaccccagatacaccgagcacacctaccaccagggcggcgtgcacagcagcctgctgaccatcgccaacgtgagcgccgcccaggactacgccctgttcacctgcaccgccaccaacgccctgggcagcgaccagaccaacatccagctggtgagcatcagcagacccgacccccccagcggcctgaaggtggtgagcctgaccccccacagcgtgggcctggagtggaagcccggcttcgacggcggcctgccccagagattctgcatcagatacgaggccctgggcacccccggcttccactacgtggacgtggtgcccccccaggccaccaccttcaccctgaccggcctgcagcccagcaccagatacagagtgtggctgctggccagcaacgccctgggcgacagcggcctggccgacaagggcacccagctgcccatcaccacccccggcctgcaccagcccagcggcgagcccgaggaccagctgcccaccgagccccccagcggccccagcggcctgcccctgctgcccgtgctgttcgccctgggcggcctgctgctgctgagcaacgccagctgcgtgggcggcgtgctgtggcagagaagactgagaagactggccgagggcatcagcgagaagaccgaggccggcagcgaggaggacagagtgagaaacgagtacgaggagagccagtggaccggcgagagagacacccagagcagcaccgtgagcaccaccgaggccgagccctactacagaagcctgagagacttcagcccccagctgccccccacccaggaggaggtgagctacagcagaggcttcaccggcgaggacgaggacatggccttccccggccacctgtacgacgaggtggagagaacctacccccccagcggcgcctggggccccctgtacgacgaggtgcagatgggcccctgggacctgcactggcccgaggacacctaccaggaccccagaggcatctacgaccaggtggccggcgacctggacaccctggagcccgacagcctgcccttcgagctgagaggccacctggtgtag

SEQ ID NO: 90596 - DNA, 1152 bp, Artificial Sequence
  Description of Artificial Sequence: Synthetic coding sequence
atggagagaagagccagaagcagcagcagagagagcagaggcagaggcggcagaaccccccacaaggagaacaagagagccaaggccgagagaagcggcggcggcagaggcagacaggaggccggccccgagcccagcggcagcggcagagccggcacccccggcgagcccagagcccccgccgccaccgtggtggacgtggacgaggtgagaggcagcggcgaggagggcaccgaggtggtggccctgctggagagcgagagacccgaggagggcaccaagagcagcggcctgggcgcctgcgagtggctgctggtgctgatcagcctgctgttcatcatcatgaccttccccttcagcatctggttctgcgtgaaggtggtgcaggagtacgagagagtgatcatcttcagactgggccacctgctgcccggcagagccaagggccccggcctgttcttcttcctgccctgcctggacacctaccacaaggtggacctgagactgcagaccctggagatccccttccacgagatcgtgaccaaggacatgttcatcatggagatcgacgccatctgctactacagaatggagaacgccagcctgctgctgagcagcctggcccacgtgagcaaggccgtgcagttcctggtgcagaccaccatgaagagactgctggcccacagaagcctgaccgagatcctgctggagagaaagagcatcgcccaggacgccaaggtggccctggacagcgtgacctgcatctggggcatcaaggtggagagaatcgagatcaaggacgtgagactgcccgccggcctgcagcacagcctggccgtggaggccgaggcccagagacaggccaaggtgagaatgatcgccgccgaggccgagaaggccgccagcgagagcctgagaatggccgccgagatcctgagcggcacccccgccgccgtgcagctgagatacctgcacaccctgcagagcctgagcaccgagaagcccagcaccgtggtgctgcccctgcccttcgacctgctgaactgcctgagcagccccagcaacagaacccagggcagcctgcccttccccagccccagcaagcccgtggagcccctgaaccccaagaagaaggacagccccatgctgtag

SEQ ID NO: 90597 - DNA, 948 bp, Artificial Sequence
  Description of Artificial Sequence: Synthetic coding sequence
atggagagaagagccagaagcagcagcagagagagcagaggcagaggcggcagaaccccccacaaggagaacaagagagccaaggccgagagaagcggcggcggcagaggcagacaggaggccggccccgagcccagcggcagcggcagagccggcacccccggcgagcccagagcccccgccgccaccgtggtggacgtggacgaggtgagaggcagcggcgaggagggcaccgaggtggtggccctgctggagagcgagagacccgaggagggcaccaagagcagcggcctgggcgcctgcgagtggctgctggtgctgatcagcctgctgttcatcatcatgaccttccccttcagcatctggttctgcgtgaaggtggtgcaggagtacgagagagtgatcatcttcagactgggccacctgctgcccggcagagccaagggccccggcctgttcttcttcctgccctgcctggacacctaccacaaggtggacctgagactgcagaccctggagatccccttccacgaggtggccctggacagcgtgacctgcatctggggcatcaaggtggagagaatcgagatcaaggacgtgagactgcccgccggcctgcagcacagcctggccgtggaggccgaggcccagagacaggccaaggtgagaatgatcgccgccgaggccgagaaggccgccagcgagagcctgagaatggccgccgagatcctgagcggcacccccgccgccgtgcagctgagatacctgcacaccctgcagagcctgagcaccgagaagcccagcaccgtggtgctgcccctgcccttcgacctgctgaactgcctgagcagccccagcaacagaacccagggcagcctgcccttccccagccccagcaagcccgtggagcccctgaaccccaagaagaaggacagccccatgctgtag

SEQ ID NO: 90598 - DNA, 1284 bp, Artificial Sequence
  Description of Artificial Sequence: Synthetic coding sequence
atgggcgccggcgccaccggcagagccatggacggccccagactgctgctgctgctgctgctgggcgtgagcctgggcggcgccaaggaggcctgccccaccggcctgtacacccacagcggcgagtgctgcaaggcctgcaacctgggcgagggcgtggcccagccctgcggcgccaaccagaccgtgtgcgagccctgcctggacagcgtgaccttcagcgacgtggtgagcgccaccgagccctgcaagccctgcaccgagtgcgtgggcctgcagagcatgagcgccccctgcgtggaggccgacgacgccgtgtgcagatgcgcctacggctactaccaggacgagaccaccggcagatgcgaggcctgcagagtgtgcgaggccggcagcggcctggtgttcagctgccaggacaagcagaacaccgtgtgcgaggagtgccccgacggcacctacagcgacgaggccaaccacgtggacccctgcctgccctgcaccgtgtgcgaggacaccgagagacagctgagagagtgcaccagatgggccgacgccgagtgcgaggagatccccggcagatggatcaccagaagcaccccccccgagggcagcgacagcaccgcccccagcacccaggagcccgaggccccccccgagcaggacctgatcgccagcaccgtggccggcgtggtgaccaccgtgatgggcagcagccagcccgtggtgaccagaggcaccaccgacaacctgatccccgtgtactgcagcatcctggccgccgtggtggtgggcctggtggcctacatcgccttcaagagatggaacagctgcaagcagaacaagcagggcgccaacagcagacccgtgaaccagacccccccccccgagggcgagaagctgcacagcgacagcggcatcagcgtggacagccagagcctgcacgaccagcagccccacacccagaccgccagcggccaggccctgaagggcgacggcggcctgtacagcagcctgccccccgccaagagagaggaggtggagaagctgctgaacggcagcgccggcgacacctggagacacctggccggcgagctgggctaccagcccgagcacatcgacagcttcacccacgaggcctgccccgtgagagccctgctggccagctgggccacccaggacagcgccaccctggacgccctgctggccgccctgagaagaatccagagagccgacctggtggagagcctgtgcagcgagagcaccgccaccagccccgtgtag

SEQ ID NO: 90599 - DNA, 1002 bp, Artificial Sequence
  Description of Artificial Sequence: Synthetic coding sequence
atgagcgccccctgcgtggaggccgacgacgccgtgtgcagatgcgcctacggctactaccaggacgagaccaccggcagatgcgaggcctgcagagtgtgcgaggccggcagcggcctggtgttcagctgccaggacaagcagaacaccgtgtgcgaggagtgccccgacggcacctacagcgacgaggccaaccacgtggacccctgcctgccctgcaccgtgtgcgaggacaccgagagacagctgagagagtgcaccagatgggccgacgccgagtgcgaggagatccccggcagatggatcaccagaagcaccccccccgagggcagcgacagcaccgcccccagcacccaggagcccgaggccccccccgagcaggacctgatcgccagcaccgtggccggcgtggtgaccaccgtgatgggcagcagccagcccgtggtgaccagaggcaccaccgacaacctgatccccgtgtactgcagcatcctggccgccgtggtggtgggcctggtggcctacatcgccttcaagagatggaacagctgcaagcagaacaagcagggcgccaacagcagacccgtgaaccagacccccccccccgagggcgagaagctgcacagcgacagcggcatcagcgtggacagccagagcctgcacgaccagcagccccacacccagaccgccagcggccaggccctgaagggcgacggcggcctgtacagcagcctgccccccgccaagagagaggaggtggagaagctgctgaacggcagcgccggcgacacctggagacacctggccggcgagctgggctaccagcccgagcacatcgacagcttcacccacgaggcctgccccgtgagagccctgctggccagctgggccacccaggacagcgccaccctggacgccctgctggccgccctgagaagaatccagagagccgacctggtggagagcctgtgcagcgagagcaccgccaccagccccgtgtag

SEQ ID NO: 90600 - DNA, 336 bp, Artificial Sequence
  Description of Artificial Sequence: Synthetic coding sequence
atggccaacatccaccaggagaacgaggagatggagcagcccatgcagaacggcgaggaggacagacccctgggcggcggcgagggccaccagcccgccggcaacagaagaggccaggccagaagactggcccccaacttcagatgggccatccccaacagacagatcaacgacggcatgggcggcgacggcgacgacatggagatcttcatggaggagatgagagagatcagaagaaagctgagagagctgcagctgagaaactgcctgagaatcctgatgggcgagctgagcaaccaccacgaccaccacgacgagttctgcctgatgccctag

SEQ ID NO: 90601 - DNA, 306 bp, Artificial Sequence
  Description of Artificial Sequence: Synthetic coding sequence
atggagcagcccatgcagaacggcgaggaggacagacccctgggcggcggcgagggccaccagcccgccggcaacagaagaggccaggccagaagactggcccccaacttcagatgggccatccccaacagacagatcaacgacggcatgggcggcgacggcgacgacatggagatcttcatggaggagatgagagagatcagaagaaagctgagagagctgcagctgagaaactgcctgagaatcctgatgggcgagctgagcaaccaccacgaccaccacgacgagttctgcctgatgccctag

SEQ ID NO: 90602 - DNA, 306 bp, Artificial Sequence; identical to SEQ ID NO: 90601
  Description of Artificial Sequence: Synthetic coding sequence

SEQ ID NO: 90603 - DNA, 336 bp, Artificial Sequence; identical to SEQ ID NO: 90600
  Description of Artificial Sequence: Synthetic coding sequence

SEQ ID NO: 90604 - DNA, 336 bp, Artificial Sequence; identical to SEQ ID NO: 90600
  Description of Artificial Sequence: Synthetic coding sequence

SEQ ID NO: 90605 - DNA, 402 bp, Artificial Sequence
  Description of Artificial Sequence: Synthetic coding sequence
atgatgctgaacagcgacaccatggagctggacctgccccccacccacagcgagaccgagagcggcttcagcgactgcggcggcggcgccggccccgacggcgccggccccggcggccccggcggcggccaggccagaggccccgagcccggcgagcccggcagaaaggacctgcagcacctgagcagagaggagagaagaagaagaagaagagccaccgccaagtacagaaccgcccacgccaccagagagagaatcagagtggaggccttcaacctggccttcgccgagctgagaaagctgctgcccaccctgccccccgacaagaagctgagcaagatcgagatcctgagactggccatctgctacatcagctacctgaaccacgtgctggacgtgtag

SEQ ID NO: 90606 - DNA, 408 bp, Artificial Sequence
  Description of Artificial Sequence: Synthetic coding sequence
atgatgctgagccccgaccaggccgccgacagcgaccaccccagcagcgcccacagcgaccccgagagcctgggcggcaccgacaccaaggtgctgggcagcgtgagcgacctggagcccgtggaggaggccgagggcgacggcaagggcggcagcagagccgccctgtacccccacccccagcagctgagcagagaggagaagagaagaagaagaagagccaccgccaagtacagaagcgcccacgccaccagagagagaatcagagtggaggccttcaacctggccttcgccgagctgagaaagctgctgcccaccctgccccccgacaagaagctgagcaagatcgagatcctgagactggccatctgctacatcagctacctgaaccacgtgctggacgtgtag

SEQ ID NO: 90607 - DNA, 408 bp, Artificial Sequence; identical to SEQ ID NO: 90606
  Description of Artificial Sequence: Synthetic coding sequence

SEQ ID NO: 90608 - DNA, 324 bp, Artificial Sequence
  Description of Artificial Sequence: Synthetic coding sequence
atgatgctgagccccgaccaggccgccgacagcgaccaccccagcagcgcccacagcgaccccgagagcctgggcggcaccgacaccaaggtgctgggcagcgtgagcgacctggagcccgtggaggaggccgagggcgacggcaagggcggcagcagagccgccctgtacccccacccccagcagctgagcagagaggagaagagaagaagaagaagagccaccgccaagtacagaagcgcccacgccaccagagagagaatcagagtggaggccttcaacctggccttcgccgagctgagaaagctgctgcccaccctgtag

SEQ ID NO: 90609 - DNA, 1125 bp, Artificial Sequence
  Description of Artificial Sequence: Synthetic coding sequence
atgggcctgcccagaggcagcttcttctggctgctgctgctgctgaccgccgcctgcagcggcctgctgttcgccctgtacttcagcgccgtgcagagataccccggccccgccgccggcgccagagacaccaccagcttcgaggccttcttccagagcaaggccagcaacagctggaccggcaagggccaggcctgcagacacctgctgcacctggccatccagagacacccccacttcagaggcctgttcaacctgagcatccccgtgctgctgtggggcgacctgttcacccccgccctgtgggacagactgagccagcacaaggccccctacggctggagaggcctgagccaccaggtgatcgccagcaccctgagcctgctgaacggcagcgagagcgccaagctgttcgccccccccagagacaccccccccaagtgcatcagatgcgccgtggtgggcaacggcggcatcctgaacggcagcagacagggccccaacatcgacgcccacgactacgtgttcagactgaacggcgccgtgatcaagggcttcgagagagacgtgggcaccaagaccagcttctacggcttcaccgtgaacaccatgaagaacagcctggtgagctactggaacctgggcttcaccagcgtgccccagggccaggacctgcagtacatcttcatccccagcgacatcagagactacgtgatgctgagaagcgccatcctgggcgtgcccgtgcccgagggcctggacaagggcgacagaccccacgcctacttcggccccgaggccagcgccagcaagttcaagctgctgcaccccgacttcatcagctacctgaccgagagattcctgaagagcaagctgatcaacacccacttcggcgacctgtacatgcccagcaccggcgccctgatgctgctgaccgccctgcacacctgcgaccaggtgagcgcctacggcttcatcaccagcaactactggaagttcagcgaccactacttcgagagaaagatgaagcccctgatcttctacgccaaccacgacctgagcctggaggccgccctgtggagagacctgcacaaggccggcatcctgcagctgtaccagagatag

SEQ ID NO: 90610 - DNA, 2235 bp, Artificial Sequence
  Description of Artificial Sequence: Synthetic coding sequence
atggccggcagaagcatgcaggccgccagatgccccaccgacgagctgagcctgaccaactgcgccgtggtgaacgagaaggacttccagagcggccagcacgtgatcgtgagaaccagccccaaccacagatacaccttcaccctgaagacccaccccagcgtggtgcccggcagcatcgccttcagcctgccccagagaaagtgggccggcctgagcatcggccaggagatcgaggtgagcctgtacaccttcgacaaggccaagcagtgcatcggcaccatgaccatcgagatcgacttcctgcagaagaagagcatcgacagcaacccctacgacaccgacaagatggccgccgagttcatccagcagttcaacaaccaggccttcagcgtgggccagcagctggtgttcagcttcaacgagaagctgttcggcctgctggtgaaggacatcgaggccatggaccccagcatcctgaagggcgagcccgccaccggcaagagacagaagatcgaggtgggcctggtggtgggcaacagccaggtggccttcgagaaggccgagaacagcagcctgaacctgatcggcaaggccaagaccaaggagaacagacagagcatcatcaaccccgactggaacttcgagaagatgggcatcggcggcctggacaaggagttcagcgacatcttcagaagagccttcgccagcagagtgttcccccccgagatcgtggagcagatgggctgcaagcacgtgaagggcatcctgctgtacggcccccccggctgcggcaagaccctgctggccagacagatcggcaagatgctgaacgccagagagcccaaggtggtgaacggccccgagatcctgaacaagtacgtgggcgagagcgaggccaacatcagaaagctgttcgccgacgccgaggaggagcagagaagactgggcgccaacagcggcctgcacatcatcatcttcgacgagatcgacgccatctgcaagcagagaggcagcatggccggcagcaccggcgtgcacgacaccgtggtgaaccagctgctgagcaagatcgacggcgtggagcagctgaacaacatcctggtgatcggcatgaccaacagacccgacctgatcgacgaggccctgctgagacccggcagactggaggtgaagatggagatcggcctgcccgacgagaagggcagactgcagatcctgcacatccacaccgccagaatgagaggccaccagctgctgagcgccgacgtggacatcaaggagctggccgtggagaccaagaacttcagcggcgccgagctggagggcctggtgagagccgcccagagcaccgccatgaacagacacatcaaggccagcaccaaggtggaggtggacatggagaaggccgagagcctgcaggtgaccagaggcgacttcctggccagcctggagaacgacatcaagcccgccttcggcaccaaccaggaggactacgccagctacatcatgaacggcatcatcaagtggggcgaccccgtgaccagagtgctggacgacggcgagctgctggtgcagcagaccaagaacagcgacagaacccccctggtgagcgtgctgctggagggccccccccacagcggcaagaccgccctggccgccaagatcgccgaggagagcaacttccccttcatcaagatctgcagccccgacaagatgatcggcttcagcgagaccgccaagtgccaggccatgaagaagatcttcgacgacgcctacaagagccagctgagctgcgtggtggtggacgacatcgagagactgctggactacgtgcccatcggccccagattcagcaacctggtgctgcaggccctgctggtgctgctgaagaaggcccccccccagggcagaaagctgctgatcatcggcaccaccagcagaaaggacgtgctgcaggagatggagatgctgaacgccttcagcaccaccatccacgtgcccaacatcgccaccggcgagcagctgctggaggccctggagctgctgggcaacttcaaggacaaggagagaaccaccatcgcccagcaggtgaagggcaagaaggtgtggatcggcatcaagaagctgctgatgctgatcgagatgagcctgcagatggaccccgagtacagagtgagaaagttcctggccctgctgagagaggagggcgccagccccctggacttcgactag

SEQ ID NO: 90611 - DNA, 888 bp, Artificial Sequence
  Description of Artificial Sequence: Synthetic coding sequence
atggacaacagcggcaaggaggccgaggccatggccctgctggccgaggccgagagaaaggtgaagaacagccagagcttcttcagcggcctgttcggcggcagcagcaagatcgaggaggcctgcgagatctacgccagagccgccaacatgttcaagatggccaagaactggagcgccgccggcaacgccttctgccaggccgcccagctgcacctgcagctgcagagcaagcacgacgccgccacctgcttcgtggacgccggcaacgccttcaagaaggccgacccccaggaggccatcaactgcctgatgagagccatcgagatctacaccgacatgggcagattcaccatcgccgccaagcaccacatcagcatcgccgagatctacgagaccgagctggtggacatcgagaaggccatcgcccactacgagcagagcgccgactactacaagggcgaggagagcaacagcagcgccaacaagtgcctgctgaaggtggccggctacgccgccctgctggagcagtaccagaaggccatcgacatctacgagcaggtgggcaccaacgccatggacagccccctgctgaagtacagcgccaaggactacttcttcaaggccgccctgtgccacttctgcatcgacatgctgaacgccaagctggccgtgcagaagtacgaggagctgttccccgccttcagcgacagcagagagtgcaagctgatgaagaagctgctggaggcccacgaggagcagaacgtggacagctacaccgagagcgtgaaggagtacgacagcatcagcagactggaccagtggctgaccaccatgctgctgagaatcaagaagaccatccagggcgacgaggaggacctgagatag

SEQ ID NO: 90612 - DNA, 897 bp, Artificial Sequence
  Description of Artificial Sequence: Synthetic coding sequence
atggacaacgccggcaaggagagagaggccgtgcagctgatggccgaggccgagaagagagtgaaggccagccacagcttcctgagaggcctgttcggcggcaacaccagaatcgaggaggcctgcgagatgtacaccagagccgccaacatgttcaagatggccaagaactggagcgccgccggcaacgccttctgccaggccgccaagctgcacatgcagctgcagagcaagcacgacagcgccaccagcttcgtggacgccggcaacgcctacaagaaggccgacccccaggaggccatcaactgcctgaacgccgccatcgacatctacaccgacatgggcagattcaccatcgccgccaagcaccacatcaccatcgccgagatctacgagaccgagctggtggacatcgagaaggccatcgcccactacgagcagagcgccgactactacaagggcgaggagagcaacagcagcgccaacaagtgcctgctgaaggtggccgcctacgccgcccagctggagcagtaccagaaggccatcgagatctacgagcaggtgggcgccaacaccatggacaaccccctgctgaagtacagcgccaaggactacttcttcaaggccgccctgtgccacttcatcgtggacgagctgaacgccaagctggccctggagaagtacgaggagatgttccccgccttcaccgacagcagagagtgcaagctgctgaagaagctgctggaggcccacgaggagcagaacagcgaggcctacaccgaggccgtgaaggagttcgacagcatcagcagactggaccagtggctgaccaccatgctgctgagaatcaagaagagcatccagggcgacggcgagggcgacggcgacctgaagtag

SEQ ID NO: 90613 - DNA, 615 bp, Artificial Sequence
  Description of Artificial Sequence: Synthetic coding sequence
atgaccctgctgcccgccctgtggatgctggagatgctgaccaagagacagatccccaagggcagattcaccatcgccgccaagcaccacatcaccatcgccgagatctacgagaccgagctggtggacatcgagaaggccatcgcccactacgagcagagcgccgactactacaagggcgaggagagcaacagcagcgccaacaagtgcctgctgaaggtggccgcctacgccgcccagctggagcagtaccagaaggccatcgagatctacgagcaggtgggcgccaacaccatggacaaccccctgctgaagtacagcgccaaggactacttcttcaaggccgccctgtgccacttcatcgtggacgagctgaacgccaagctggccctggagaagtacgaggagatgttccccgccttcaccgacagcagagagtgcaagctgctgaagaagctgctggaggcccacgaggagcagaacagcgaggcctacaccgaggccgtgaaggagttcgacagcatcagcagactggaccagtggctgaccaccatgctgctgagaatcaagaagagcatccagggcgacggcgagggcgacggcgacctgaagtag

SEQ ID NO: 90614 - DNA, 768 bp, Artificial Sequence
  Description of Artificial Sequence: Synthetic coding sequence
atgtacaccagagccgccaacatgttcaagatggccaagaactggagcgccgccggcaacgccttctgccaggccgccaagctgcacatgcagctgcagagcaagcacgacagcgccaccagcttcgtggacgccggcaacgcctacaagaaggccgacccccaggaggccatcaactgcctgaacgccgccatcgacatctacaccgacatgggcagattcaccatcgccgccaagcaccacatcaccatcgccgagatctacgagaccgagctggtggacatcgagaaggccatcgcccactacgagcagagcgccgactactacaagggcgaggagagcaacagcagcgccaacaagtgcctgctgaaggtggccgcctacgccgcccagctggagcagtaccagaaggccatcgagatctacgagcaggtgggcgccaacaccatggacaaccccctgctgaagtacagcgccaaggactacttcttcaaggccgccctgtgccacttcatcgtggacgagctgaacgccaagctggccctggagaagtacgaggagatgttccccgccttcaccgacagcagagagtgcaagctgctgaagaagctgctggaggcccacgaggagcagaacagcgaggcctacaccgaggccgtgaaggagttcgacagcatcagcagactggaccagtggctgaccaccatgctgctgagaatcaagaagagcatccagggcgacggcgagggcgacggcgacctgaagtag

SEQ ID NO: 90615 - DNA, 780 bp, Artificial Sequence
  Description of Artificial Sequence: Synthetic coding sequence
atggacaacgccggcaaggagagagaggccgtgcagctgatggccgaggccgagaagagagtgaaggccagccacagcttcctgagaggcctgttcggcggcaacaccagaatcgaggaggcctgcgagatgtacaccagagccgccaacatgttcaagatggccaagaactggagcgaggccatcaactgcctgaacgccgccatcgacatctacaccgacatgggcagattcaccatcgccgccaagcaccacatcaccatcgccgagatctacgagaccgagctggtggacatcgagaaggccatcgcccactacgagcagagcgccgactactacaagggcgaggagagcaacagcagcgccaacaagtgcctgctgaaggtggccgcctacgccgcccagctggagcagtaccagaaggccatcgagatctacgagcaggtgggcgccaacaccatggacaaccccctgctgaagtacagcgccaaggactacttcttcaaggccgccctgtgccacttcatcgtggacgagctgaacgccaagctggccctggagaagtacgaggagatgttccccgccttcaccgacagcagagagtgcaagctgctgaagaagctgctggaggcccacgaggagcagaacagcgaggcctacaccgaggccgtgaaggagttcgacagcatcagcagactggaccagtggctgaccaccatgctgctgagaatcaagaagagcatccagggcgacggcgagggcgacggcgacctgaagtag

SEQ ID NO: 90616 - DNA, 1887 bp, Artificial Sequence
  Description of Artificial Sequence: Synthetic coding sequence
atgggcagctgcgccagactgctgctgctgtggggctgcaccgtggtggccgccggcctgagcggcgtggccggcgtgagcagcagatgcgagaaggcctgcaaccccagaatgggcaacctggccctgggcagaaagctgtgggccgacaccacctgcggccagaacgccaccgagctgtactgcttctacagcgagaacaccgacctgacctgcagacagcccaagtgcgacaagtgcaacgccgcctacccccacctggcccacctgcccagcgccatggccgacagcagcttcagattccccagaacctggtggcagagcgccgaggacgtgcacagagagaagatccagctggacctggaggccgagttctacttcacccacctgatcgtgatgttcaagagccccagacccgccgccatggtgctggacagaagccaggacttcggcaagacctggaagccctacaagtacttcgccaccaactgcagcgccaccttcggcctggaggacgacgtggtgaagaagggcgccatctgcaccagcaagtacagcagccccttcccctgcaccggcggcgaggtgatcttcaaggccctgagccccccctacgacaccgagaacccctacagcgccaaggtgcaggagcagctgaagatcaccaacctgagagtgcagctgctgaagagacagagctgcccctgccagagaaacgacctgaacgaggagccccagcacttcacccactacgccatctacgacttcatcgtgaagggcagctgcttctgcaacggccacgccgaccagtgcatccccgtgcacggcttcagacccgtgaaggcccccggcaccttccacatggtgcacggcaagtgcatgtgcaagcacaacaccgccggcagccactgccagcactgcgcccccctgtacaacgacagaccctgggaggccgccgacggcaagaccggcgcccccaacgagtgcagaacctgcaagtgcaacggccacgccgacacctgccacttcgacgtgaacgtgtgggaggccagcggcaacagaagcggcggcgtgtgcgacgactgccagcacaacaccgagggccagtactgccagagatgcaagcccggcttctacagagacctgagaagacccttcagcgcccccgacgcctgcaagccctgcagctgccaccccgtgggcagcgccgtgctgcccgccaacagcgtgaccttctgcgaccccagcaacggcgactgcccctgcaagcccggcgtggccggcagaagatgcgacagatgcatggtgggctactggggcttcggcgactacggctgcagaccctgcgactgcgccggcagctgcgaccccatcaccggcgactgcatcagcagccacaccgacatcgactggtaccacgaggtgcccgacttcagacccgtgcacaacaagagcgagcccgcctgggagtgggaggacgcccagggcttcagcgccctgctgcacagcggcaagtgcgagtgcaaggagcagaccctgggcaacgccaaggccttctgcggcatgaagtacagctacgtgctgaagatcaagatcctgagcgcccacgacaagggcacccacgtggaggtgaacgtgaagatcaagaaggtgctgaagagcaccaagctgaagatcttcagaggcaagagaaccctgtaccccgagagctggaccgacagaggctgcacctgccccatcctgaaccccggcctggagtacctggtggccggccacgaggacatcagaaccggcaagctgatcgtgaacatgaagagcttcgtgcagcactggaagcccagcctgggcagaaaggtgatggacatcctgaagagagagtgcaagtag

SEQ ID NO: 90617 - DNA, 1776 bp, Artificial Sequence
  Description of Artificial Sequence: Synthetic coding sequence
atgggcaacctggccctgggcagaaagctgtgggccgacaccacctgcggccagaacgccaccgagctgtactgcttctacagcgagaacaccgacctgacctgcagacagcccaagtgcgacaagtgcaacgccgcctacccccacctggcccacctgcccagcgccatggccgacagcagcttcagattccccagaacctggtggcagagcgccgaggacgtgcacagagagaagatccagctggacctggaggccgagttctacttcacccacctgatcgtgatgttcaagagccccagacccgccgccatggtgctggacagaagccaggacttcggcaagacctggaagccctacaagtacttcgccaccaactgcagcgccaccttcggcctggaggacgacgtggtgaagaagggcgccatctgcaccagcaagtacagcagccccttcccctgcaccggcggcgaggtgatcttcaaggccctgagccccccctacgacaccgagaacccctacagcgccaaggtgcaggagcagctgaagatcaccaacctgagagtgcagctgctgaagagacagagctgcccctgccagagaaacgacctgaacgaggagccccagcacttcacccactacgccatctacgacttcatcgtgaagggcagctgcttctgcaacggccacgccgaccagtgcatccccgtgcacggcttcagacccgtgaaggcccccggcaccttccacatggtgcacggcaagtgcatgtgcaagcacaacaccgccggcagccactgccagcactgcgcccccctgtacaacgacagaccctgggaggccgccgacggcaagaccggcgcccccaacgagtgcagaacctgcaagtgcaacggccacgccgacacctgccacttcgacgtgaacgtgtgggaggccagcggcaacagaagcggcggcgtgtgcgacgactgccagcacaacaccgagggccagtactgccagagatgcaagcccggcttctacagagacctgagaagacccttcagcgcccccgacgcctgcaagccctgcagctgccaccccgtgggcagcgccgtgctgcccgccaacagcgtgaccttctgcgaccccagcaacggcgactgcccctgcaagcccggcgtggccggcagaagatgcgacagatgcatggtgggctactggggcttcggcgactacggctgcagaccctgcgactgcgccggcagctgcgaccccatcaccggcgactgcatcagcagccacaccgacatcgactggtaccacgaggtgcccgacttcagacccgtgcacaacaagagcgagcccgcctgggagtgggaggacgcccagggcttcagcgccctgctgcacagcggcaagtgcgagtgcaaggagcagaccctgggcaacgccaaggccttctgcggcatgaagtacagctacgtgctgaagatcaagatcctgagcgcccacgacaagggcacccacgtggaggtgaacgtgaagatcaagaaggtgctgaagagcaccaagctgaagatcttcagaggcaagagaaccctgtaccccgagagctggaccgacagaggctgcacctgccccatcctgaaccccggcctggagtacctggtggccggccacgaggacatcagaaccggcaagctgatcgtgaacatgaagagcttcgtgcagcactggaagcccagcctgggcagaaaggtgatggacatcctgaagagagagtgcaagtag

SEQ ID NO: 90618 - DNA, 1818 bp, Artificial Sequence
  Description of Artificial Sequence: Synthetic coding sequence
atgggcagctgcgccagactgctgctgctgtggggctgcaccgtggtggccgccggcctgagcggcgtggccggcgtgagcagcagatgcgagaaggcctgcaaccccagaatgggcaacctggccctgggcagaaagctgtgggccgacaccacctgcggccagaacgccaccgagctgtactgcttctacagcgagaacaccgacctgacctgcagacagcccaagtgcgacaagtgcaacgccgcctacccccacctggcccacctgcccagcgccatggccgacagcagcttcagattccccagaacctggtggcagagcgccgaggacgtgcacagagagaagatccagctggacctggaggccgagttctacttcacccacctgatcgtgatgttcaagagccccagacccgccgccatggtgctggacagaagccaggacttcggcaagacctggaagccctacaagtacttcgccaccaactgcagcgccaccttcggcctggaggacgacgtggtgaagaagggcgccatctgcaccagcaagtacagcagccccttcccctgcaccggcggcgaggtgatcttcaaggccctgagccccccctacgacaccgagaacccctacagcgccaaggtgcaggagcagctgaagatcaccaacctgagagtgcagctgctgaagagacagagctgcccctgccagagaaacgacctgaacgaggagccccagcacttcacccactacgccatctacgacttcatcgtgaagggcagctgcttctgcaacggccacgccgaccagtgcatccccgtgcacggcttcagacccgtgaaggcccccggcaccttccacatggtgcacggcaagtgcatgtgcaagcacaacaccgccggcagccactgccagcactgcgcccccctgtacaacgacagaccctgggaggccgccgacggcaagaccggcgcccccaacgagtgcagaacctgcaagtgcaacggccacgccgacacctgccacttcgacgtgaacgtgtgggaggccagcggcaacagaagcggcggcgtgtgcgacgactgccagcacaacaccgagggccagtactgccagagatgcaagcccggcttctacagagacctgagaagacccttcagcgcccccgacgcctgcaagccctgcagctgccaccccgtgggcagcgccgtgctgcccgccaacagcgtgaccttctgcgaccccagcaacggcgactgcccctgcaagcccggcgtggccggcagaagatgcgacagatgcatggtgggctactggggcttcggcgactacggctgcagaccctgcgactgcgccggcagctgcgaccccatcaccggcgactgcatcagcagccacaccgacatcgactggtaccacgaggtgcccgacttcagacccgtgcacaacaagagcgagcccgcctgggagtgggaggacgcccagggcttcagcgccctgctgcacagcgtgctgaagatcaagatcctgagcgcccacgacaagggcacccacgtggaggtgaacgtgaagatcaagaaggtgctgaagagcaccaagctgaagatcttcagaggcaagagaaccctgtaccccgagagctggaccgacagaggctgcacctgccccatcctgaaccccggcctggagtacctggtggccggccacgaggacatcagaaccggcaagctgatcgtgaacatgaagagcttcgtgcagcactggaagcccagcctgggcagaaaggtgatggacatcctgaagagagagtgcaagtag

SEQ ID NO: 90619 - DNA, 1095 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcagcaagtag

SEQ ID NO: 90620 - DNA, 1518 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaacccccccaagttcaacagaatctggcccaacatcagcagcctggaggtgagcaaccccaagcaggagtgctactgcaaccccctgggcagcatccacgacagatgcaacggcagcggcttctgcgagtgcaagaccggcaccaccggccccaagtgcgacgagtgcctgcccggcaacagctggcactacggctgccagcccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90621 - DNA, 861 bp, Artificial Sequence
  Description of Artificial Sequence: Synthetic coding sequence
atggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaacccccccaagttcaacagaatctggcccaacatcagcagcctggaggtgagcaaccccaagcaggtggcccccaagctggccctgagcaccgtgagcagcgtgcaggtggccaaccacaagagagagtgctactgcaaccccctgggcagcatccacgacagatgcaacggcagcggcttctgcgagtgcaagaccggcaccaccggccccaagtgcgacgagtgcctgcccggcaacagctggcactacggctgccagcccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90622 - DNA, 1029 bp, Artificial Sequence
  Description of Artificial Sequence: Synthetic coding sequence
atggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaacccccccaagttcaacagaatctggcccaacatcagcagcctggaggtgagcaaccccaagcaggtggcccccaagctggccctgagcaccgtgagcagcgtgcaggtggccaaccacaagagagactgcgagtgcttcggccacagcaacagatgcagctacatcgacctgctgaacaccgtgatctgcgtgagctgcaagcacaacaccagaggccagcactgcgagctgtgcagactgggctacttcagaaacgccagcgcccagctggacgacgagaacgtgtgcatcgagtgctactgcaaccccctgggcagcatccacgacagatgcaacggcagcggcttctgcgagtgcaagaccggcaccaccggccccaagtgcgacgagtgcctgcccggcaacagctggcactacggctgccagcccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90623 - DNA, 1485 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaactgcgagtgcttcggccacagcaacagatgcagctacatcgacctgctgaacaccgtgatctgcgtgagctgcaagcacaacaccagaggccagcactgcgagctgtgcagactgggctacttcagaaacgccagcgcccagctggacgacgagaacgtgtgcatcgccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90624 - DNA, 1443 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaacccccccaagttcaacagaatctggcccaacatcagcagcctggaggtgagcaaccccaagcaggtggcccccaagctggccctgagcaccgtgagcagcgtgcaggtggccaaccacaagagagccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90625 - DNA, 1383 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaacccccccaagttcaacagaatctggcccaacatcagcagcctggaggtgagcaaccccaagcaggccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90626 - DNA, 1620 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaactgcgagtgcttcggccacagcaacagatgcagctacatcgacctgctgaacaccgtgatctgcgtgagctgcaagcacaacaccagaggccagcactgcgagctgtgcagactgggctacttcagaaacgccagcgcccagctggacgacgagaacgtgtgcatcgagtgctactgcaaccccctgggcagcatccacgacagatgcaacggcagcggcttctgcgagtgcaagaccggcaccaccggccccaagtgcgacgagtgcctgcccggcaacagctggcactacggctgccagcccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90627 - DNA, 1383 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcgacccctacctgaccagctgcggcgacccccccaagttcaacagaatctggcccaacatcagcagcctggaggtgagcaaccccaagcaggccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90628 - DNA, 1443 bp, Artificial Sequence; identical to SEQ ID NO: 90624
  Description of Artificial Sequence: Synthetic coding sequence

SEQ ID NO: 90629 - DNA, 1485 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcgacccctacctgaccagctgcggcgactgcgagtgcttcggccacagcaacagatgcagctacatcgacctgctgaacaccgtgatctgcgtgagctgcaagcacaacaccagaggccagcactgcgagctgtgcagactgggctacttcagaaacgccagcgcccagctggacgacgagaacgtgtgcatcgccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90630 - DNA, 1620 bp, Artificial Sequence; identical to SEQ ID NO: 90626
  Description of Artificial Sequence: Synthetic coding sequence

SEQ ID NO: 90631 - DNA, 1317 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcatccccagcatcagcagcatcggcaccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90632 - DNA, 1095 bp, Artificial Sequence; identical to SEQ ID NO: 90619
  Description of Artificial Sequence: Synthetic coding sequence

SEQ ID NO: 90633 - DNA, 1317 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctacctgcccagcatgtacagcgtggccgccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90634 - DNA, 1620 bp, Artificial Sequence
  Description of Artificial Sequence: Synthetic coding sequence
atgtacctgagcagattcctgagcatccacgccctgtgggtgaccgtgagcagcgtgatgcagccctaccccctggtgtggggccactacgacctgtgcaagacccagatctacaccgaggagggcaaggtgtgggactacatggcctgccagcccgagagcaccgacatgaccaagtacctgaaggtgaagctggacccccccgacatcacctgcggcgacccccccgagaccttctgcgccatgggcaacccctacatgtgcaacaacgagtgcgacgccagcacccccgagctggcccacccccccgagctgatgttcgacttcgagggcagacaccccagcaccttctggcagagcgccacctggaaggagtaccccaagcccctgcaggtgaacatcaccctgagctggagcaagaccatcgagctgaccgacaacatcgtgatcaccttcgagagcggcagacccgaccagatgatcctggagaagagcctggactacggcagaacctggcagccctaccagtactacgccaccgactgcctggacgccttccacatggaccccaagagcgtgaaggacctgagccagcacaccgtgctggagatcatctgcaccgaggagtacagcaccggctacaccaccaacagcaagatcatccacttcgagatcaaggacagattcgccttcttcgccggccccagactgagaaacatggccagcctgtacggccagctggacaccaccaagaagctgagagacttcttcaccgtgaccgacctgagaatcagactgctgagacccgccgtgggcgagatcttcgtggacgagctgcacctggccagatacttctacgccatcagcgacatcaaggtgagaggcagatgcaagtgcaacctgcacgccaccgtgtgcgtgtacgacaacagcaagctgacctgcgagtgcgagcacaacaccaccggccccgactgcggcaagtgcaagaagaactaccagggcagaccctggagccccggcagctacctgcccatccccaagggcaccgccaacacctgcgacccctacctgaccagctgcggcgactgcgagtgcttcggccacagcaacagatgcagctacatcgacctgctgaacaccgtgatctgcgtgagctgcaagcacaacaccagaggccagcactgcgagctgtgcagactgggctacttcagaaacgccagcgcccagctggacgacgagaacgtgtgcatcgagtgctactgcaaccccctgggcagcatccacgacagatgcaacggcagcggcttctgcgagtgcaagaccggcaccaccggccccaagtgcgacgagtgcctgcccggcaacagctggcactacggctgccagcccaacgtgtgcgacaacgagctgctgcactgccagaacggcggcacctgccacaacaacgtgagatgcctgtgccccgccgcctacaccggcatcctgtgcgagaagctgagatgcgaggaggccggcagctgcggcagcgacagcggccagggcgcccccccccacggcagccccgccctgctgctgctgaccaccctgctgggcaccgccagccccctggtgttctag

SEQ ID NO: 90635 - DNA, 519 bp, Artificial Sequence
  Description of Artificial Sequence: Synthetic coding sequence
atggtgggccccgcccccagaagaagactgagacccctggccgccctggccctggtgctggccctggcccccggcctgcccaccgccagagccggccagacccccagacccgccgagagaggcccccccgtgagactgttcaccgaggaggagctggccagatacggcggcgaggaggaggaccagcccatctacctggccgtgaagggcgtggtgttcgacgtgaccagcggcaaggagttctacggcagaggcgccccctacaacgccctgaccggcaaggacagcaccagaggcgtggccaagatgagcctggaccccgccgacctgacccacgacaccaccggcctgaccgccaaggagctggaggccctggacgaggtgttcaccaaggtgtacaaggccaagtaccccatcgtgggctacaccgccagaagaatcctgaacgaggacggcagccccaacctggacttcaagcccgaggaccagccccacttcgacatcaaggacgagttctag

SEQ ID NO: 90636 - DNA, 2088 bp, Artificial Sequence
  Description of Artificial Sequence: Synthetic coding sequence
atgagcctgctgctgagcttctacctgctgggcctgctggtgagcagcggccaggacagattcgccatgctggccaacaacaacctgcagatcctgaacatcaacaagagcgacgagggcatctacagatgcgagggcagagtggaggccagaggcgagatcgacttcagagacatcatcgtgatcgtgaacgtgccccccgccatcagcatgccccagaagagcttcaacgccaccgccgagagaggcgaggagatgaccttcagctgcagagccagcggcagccccgagcccgccatcagctggttcagaaacggcaagctgatcgaggagaacgagaagtacatcctgaagggcagcaacaccgagctgaccgtgagaaacatcatcaacagcgacggcggcccctacgtgtgcagagccaccaacaaggccggcgaggacgagaagcaggccttcctgcaggtgttcgtgcagccccacatcatccagctgaagaacgagaccacctacgagaacggccaggtgaccctggtgtgcgacgccgagggcgagcccatccccgagatcacctggaagagagccgtggacggcttcaccttcaccgagggcgacaagagcctggacggcagaatcgaggtgaagggccagcacggcagcagcagcctgcacatcaaggacgtgaagctgagcgacagcggcagatacgactgcgaggccgccagcagaatcggcggccaccagaagagcatgtacctggacatcgagtacgcccccaagttcatcagcaaccagaccatctactacagctgggagggcaaccccatcaacatcagctgcgacgtgaagagcaacccccccgccagcatccactggagaagagacaagctggtgctgcccgccaagaacaccaccaacctgaagacctacagcaccggcagaaagatgatcctggagatcgcccccaccagcgacaacgacttcggcagatacaactgcaccgccaccaaccacatcggcaccagattccaggagtacatcctggccctggccgacgtgcccagcagcccctacggcgtgaagatcatcgagctgagccagaccaccgccaaggtgagcttcaacaagcccgacagccacggcggcgtgcccatccaccactaccaggtggacgtgaaggaggtggccagcgagatctggaagatcgtgagaagccacggcgtgcagaccatggtggtgctgaacaacctggagcccaacaccacctacgagatcagagtggccgccgtgaacggcaagggccagggcgactacagcaagatcgagatcttccagaccctgcccgtgagagagcccagcccccccagcatccacggccagcccagcagcggcaagagcttcaagctgagcatcaccaagcaggacgacggcggcgcccccatcctggagtacatcgtgaagtacagaagcaaggacaaggaggaccagtggctggagaagaaggtgcagggcaacaaggaccacatcatcctggagcacctgcagtggaccatgggctacgaggtgcagatcaccgccgccaacagactgggctacagcgagcccaccgtgtacgagttcagcatgccccccaagcccaacatcatcaaggacaccctgttcaacggcctgggcctgggcgccgtgatcggcctgggcgtggccgccctgctgctgatcctggtggtgaccgacgtgagctgcttcttcatcagacagtgcggcctgctgatgtgcatcaccagaagaatgtgcggcaagaagagcggcagcagcggcaagagcaaggagctggaggagggcaaggccgcctacctgaaggacggcagcaaggagcccatcgtggagatgagaaccgaggacgagagagtgaccaaccacgaggacggcagccccgtgaacgagcccaacgagaccacccccctgaccgagcccgagaagctgcccctgaaggaggaggacggcaaggaggccctgaaccccgagaccatcgagatcaaggtgagcaacgacatcatccagagcaaggaggacgacagcaaggcctag

SEQ ID NO: 90637 - DNA, 2514 bp, Artificial Sequence
  Description of Artificial Sequence: Synthetic coding sequence
atgagcctgctgctgagcttctacctgctgggcctgctggtgagcagcggccaggccctgctgcaggtgaccatcagcctgagcaaggtggagctgagcgtgggcgagagcaagttcttcacctgcaccgccatcggcgagcccgagagcatcgactggtacaacccccagggcgagaagatcatcagcacccagagagtggtggtgcagaaggagggcgtgagaagcagactgaccatctacaacgccaacatcgaggacgccggcatctacagatgccaggccaccgacgccaagggccagacccaggaggccaccgtggtgctggagatctaccagaagctgaccttcagagaggtggtgagcccccaggagttcaagcagggcgaggacgccgaggtggtgtgcagagtgagcagcagccccgcccccgccgtgagctggctgtaccacaacgaggaggtgaccaccatcagcgacaacagattcgccatgctggccaacaacaacctgcagatcctgaacatcaacaagagcgacgagggcatctacagatgcgagggcagagtggaggccagaggcgagatcgacttcagagacatcatcgtgatcgtgaacgtgccccccgccatcagcatgccccagaagagcttcaacgccaccgccgagagaggcgaggagatgaccttcagctgcagagccagcggcagccccgagcccgccatcagctggttcagaaacggcaagctgatcgaggagaacgagaagtacatcctgaagggcagcaacaccgagctgaccgtgagaaacatcatcaacagcgacggcggcccctacgtgtgcagagccaccaacaaggccggcgaggacgagaagcaggccttcctgcaggtgttcgtgcagccccacatcatccagctgaagaacgagaccacctacgagaacggccaggtgaccctggtgtgcgacgccgagggcgagcccatccccgagatcacctggaagagagccgtggacggcttcaccttcaccgagggcgacaagagcctggacggcagaatcgaggtgaagggccagcacggcagcagcagcctgcacatcaaggacgtgaagctgagcgacagcggcagatacgactgcgaggccgccagcagaatcggcggccaccagaagagcatgtacctggacatcgagtacgcccccaagttcatcagcaaccagaccatctactacagctgggagggcaaccccatcaacatcagctgcgacgtgaagagcaacccccccgccagcatccactggagaagagacaagctggtgctgcccgccaagaacaccaccaacctgaagacctacagcaccggcagaaagatgatcctggagatcgcccccaccagcgacaacgacttcggcagatacaactgcaccgccaccaaccacatcggcaccagattccaggagtacatcctggccctggccgacgtgcccagcagcccctacggcgtgaagatcatcgagctgagccagaccaccgccaaggtgagcttcaacaagcccgacagccacggcggcgtgcccatccaccactaccaggtggacgtgaaggaggtggccagcgagatctggaagatcgtgagaagccacggcgtgcagaccatggtggtgctgaacaacctggagcccaacaccacctacgagatcagagtggccgccgtgaacggcaagggccagggcgactacagcaagatcgagatcttccagaccctgcccgtgagagagcccagcccccccagcatccacggccagcccagcagcggcaagagcttcaagctgagcatcaccaagcaggacgacggcggcgcccccatcctggagtacatcgtgaagtacagaagcaaggacaaggaggaccagtggctggagaagaaggtgcagggcaacaaggaccacatcatcctggagcacctgcagtggaccatgggctacgaggtgcagatcaccgccgccaacagactgggctacagcgagcccaccgtgtacgagttcagcatgccccccaagcccaacatcatcaaggacaccctgttcaacggcctgggcctgggcgccgtgatcggcctgggcgtggccgccctgctgctgatcctggtggtgaccgacgtgagctgcttcttcatcagacagtgcggcctgctgatgtgcatcaccagaagaatgtgcggcaagaagagcggcagcagcggcaagagcaaggagctggaggagggcaaggccgcctacctgaaggacggcagcaaggagcccatcgtggagatgagaaccgaggacgagagagtgaccaaccacgaggacggcagccccgtgaacgagcccaacgagaccacccccctgaccgagcccgagaagctgcccctgaaggaggaggacggcaaggaggccctgaaccccgagaccatcgagatcaaggtgagcaacgacatcatccagagcaaggaggacgacagcaaggcctag

SEQ ID NO: 90638 - DNA, 1275 bp, Artificial Sequence
  Description of Artificial Sequence: Synthetic coding sequence
atggtgagaagcgacagcggcggccaggtgtacctggactaccacaacagacagggcctgttcgtggactggaagtacaacgaggccctgtacctggaggagggccagcccgagacctactacagaaccgccctgctgcaggtgaccatcagcctgagcaaggtggagctgagcgtgggcgagagcaagttcttcacctgcaccgccatcggcgagcccgagagcatcgactggtacaacccccagggcgagaagatcatcagcacccagagagtggtggtgcagaaggagggcgtgagaagcagactgaccatctacaacgccaacatcgaggacgccggcatctacagatgccaggccaccgacgccaagggccagacccaggaggccaccgtggtgctggagatctaccagaagctgaccttcagagaggtggtgagcccccaggagttcaagcagggcgaggacgccgaggtggtgtgcagagtgagcagcagccccgcccccgccgtgagctggctgtaccacaacgaggaggtgaccaccatcagcgacaacagattcgccatgctggccaacaacaacctgcagatcctgaacatcaacaagagcgacgagggcatctacagatgcgagggcagagtggaggccagaggcgagatcgacttcagagacatcatcgtgatcgtgaacgtgccccccgccatcagcatgccccagaagagcttcaacgccaccgccgagagaggcgaggagatgaccttcagctgcagagccagcggcagccccgagcccgccatcagctggttcagaaacggcaagctgatcgaggagaacgagaagtacatcctgaagggcagcaacaccgagctgaccgtgagaaacatcatcaacagcgacggcggcccctacgtgtgcagagccaccaacaaggccggcgaggacgagaagcaggccttcctgcaggtgttcgtgcagccccacatcatccagctgaagaacgagaccacctacgagaacggccaggtgaccctggtgtgcgacgccgagggcgagcccatccccgagatcacctggaagagagccgtggacggcttcaccttcaccgagggcgacaagagcctggacggcagaatcgaggtgaagggccagcacggcagcagcagcctgcacatcaaggacgtgaagctgagcgacagcggcagatacgactgcgaggccgccagcagaatcggcggccaccagaagagcatgtacctggacatcgagagctag

SEQ ID NO: 90639 - DNA, 1983 bp, Artificial Sequence
  Description of Artificial Sequence: Synthetic coding sequence
atgcaggagaacctgagattcgccagcagcggcgacgacatcaagatctgggacgccagcagcatgaccctggtggacaagttcaacccccacaccagcccccacggcatcagcagcatctgctggagcagcaacaacaacttcctggtgaccgccagcagcagcggcgacaagatcgtggtgagcagctgcaagtgcaagcccgtgcccctgctggagctggccgagggccagaagcagacctgcgtgaacctgaacagcaccagcatgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggcagcaaccagagcgtgagacacctgaagtacagcctgttcaagaagagcctgctgggcagcgtgagcgacaacggcatcgtgaccctgtgggacgtgaacagccagagcccctaccacaacttcgacagcgtgcacaaggcccccgccagcggcatctgcttcagccccgtgaacgagctgctgttcgtgaccatcggcctggacaagagaatcatcctgtacgacaccagcagcaagaagctggtgaagaccctggtggccgacacccccctgaccgccgtggacttcatgcccgacggcgccaccctggccatcggcagcagcagaggcaagatctaccagtacgacctgagaatgctgaagagccccgtgaagaccatcagcgcccacaagaccagcgtgcagtgcatcgccttccagtacagcaccgtgctgaccaagagcagcctgaacaagggctgcagcaacaagcccaccaccgtgaacaagagaagcgtgaacgtgaacgccgccagcggcggcgtgcagaacagcggcatcgtgagagaggcccccgccaccagcatcgccaccgtgctgccccagcccatgaccagcgccatgggcaagggcaccgtggccgtgcaggagaaggccggcctgcccagaagcatcaacaccgacaccctgagcaaggagaccgacagcggcaagaaccaggacttcagcagcttcgacgacaccggcaagagcagcctgggcgacatgttcagccccatcagagacgacgccgtggtgaacaagggcagcgacgagagcatcggcaagggcgacggcttcgacttcctgccccagctgaacagcgtgttcccccccagaaagaaccccgtgaccagcagcaccagcgtgctgcacagcagccccctgaacgtgttcatgggcagccccggcaaggaggagaacgagaacagagacctgaccgccgagagcaagaagatctacatgggcaagcaggagagcaaggacagcttcaagcagctggccaagctggtgaccagcggcgccgagagcggcaacctgaacaccagccccagcagcaaccagaccagaaacagcgagaagttcgagaagcccgagaacgagatcgaggcccagctgatctgcgagccccccatcaacggcagcagcacccccaaccccaagatcgccagcagcgtgaccgccggcgtggccagcagcctgagcgagaagatcgccgacagcatcggcaacaacagacagaacgcccccctgaccagcatccagatcagattcatccagaacatgatccaggagaccctggacgacttcagagaggcctgccacagagacatcgtgaacctgcaggtggagatgatcaagcagttccacatgcagctgaacgagatgcacagcctgctggagagatacagcgtgaacgagggcctggtggccgagatcgagagactgagagaggagaacaagagactgagagcccacttctag

SEQ ID NO: 90640 - DNA, 1716 bp, Artificial Sequence
  Description of Artificial Sequence: Synthetic coding sequence
atgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggcagcaaccagagcgtgagacacctgaagtacagcctgttcaagaagagcctgctgggcagcgtgagcgacaacggcatcgtgaccctgtgggacgtgaacagccagagcccctaccacaacttcgacagcgtgcacaaggcccccgccagcggcatctgcttcagccccgtgaacgagctgctgttcgtgaccatcggcctggacaagagaatcatcctgtacgacaccagcagcaagaagctggtgaagaccctggtggccgacacccccctgaccgccgtggacttcatgcccgacggcgccaccctggccatcggcagcagcagaggcaagatctaccagtacgacctgagaatgctgaagagccccgtgaagaccatcagcgcccacaagaccagcgtgcagtgcatcgccttccagtacagcaccgtgctgaccaagagcagcctgaacaagggctgcagcaacaagcccaccaccgtgaacaagagaagcgtgaacgtgaacgccgccagcggcggcgtgcagaacagcggcatcgtgagagaggcccccgccaccagcatcgccaccgtgctgccccagcccatgaccagcgccatgggcaagggcaccgtggccgtgcaggagaaggccggcctgcccagaagcatcaacaccgacaccctgagcaaggagaccgacagcggcaagaaccaggacttcagcagcttcgacgacaccggcaagagcagcctgggcgacatgttcagccccatcagagacgacgccgtggtgaacaagggcagcgacgagagcatcggcaagggcgacggcttcgacttcctgccccagctgaacagcgtgttcccccccagaaagaaccccgtgaccagcagcaccagcgtgctgcacagcagccccctgaacgtgttcatgggcagccccggcaaggaggagaacgagaacagagacctgaccgccgagagcaagaagatctacatgggcaagcaggagagcaaggacagcttcaagcagctggccaagctggtgaccagcggcgccgagagcggcaacctgaacaccagccccagcagcaaccagaccagaaacagcgagaagttcgagaagcccgagaacgagatcgaggcccagctgatctgcgagccccccatcaacggcagcagcacccccaaccccaagatcgccagcagcgtgaccgccggcgtggccagcagcctgagcgagaagatcgccgacagcatcggcaacaacagacagaacgcccccctgaccagcatccagatcagattcatccagaacatgatccaggagaccctggacgacttcagagaggcctgccacagagacatcgtgaacctgcaggtggagatgatcaagcagttccacatgcagctgaacgagatgcacagcctgctggagagatacagcgtgaacgagggcctggtggccgagatcgagagactgagagaggagaacaagagactgagagcccacttctag

SEQ ID NO: 90641 - DNA, 1983 bp, Artificial Sequence; identical to SEQ ID NO: 90639
  Description of Artificial Sequence: Synthetic coding sequence

SEQ ID NO: 90642 - DNA, 1716 bp, Artificial Sequence; identical to SEQ ID NO: 90640
  Description of Artificial Sequence: Synthetic coding sequence

SEQ ID NO: 90643 - DNA, 483 bp, Artificial Sequence
  Description of Artificial Sequence: Synthetic coding sequence
atgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggcagcaaccagagcgtgagacacctgaagtacagcctgttcaagaagagcctgctgggcagcgtgagcgacaacggcatcgtgaccctgtgggacgtgaacagccagagcccctaccacaacttcgacagcgtgcacaaggcccccgccagcggcatctgcttcagccccgtgaacgagctgctgttcgtgaccatcggcctggacaagagaatcatcctgtacgacaccagcagcaagaagctggtgaagaccctggtggccgacacctag

SEQ ID NO: 90644 - DNA, 504 bp, Artificial Sequence
  Description of Artificial Sequence: Synthetic coding sequence
atgcacttcaccggcgccgtgatgcaggagaacctgagattcgccagcagcggcgacgacatcaagatctgggacgccagcagcatgaccctggtggacaagttcaacccccacaccagcccccacggcatcagcagcatctgctggagcagcaacaacaacttcctggtgaccgccagcagcagcggcgacaagatcgtggtgagcagctgcaagtgcaagcccgtgcccctgctggagctggccgagggccagaagcagacctgcgtgaacctgaacagcaccagcatgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggctag

SEQ ID NO: 90645 - DNA, 306 bp, Artificial Sequence
  Description of Artificial Sequence: Synthetic coding sequence
atgcaggagaacctgagattcgccagcagcggcgacgacatcaagatctgggacgccagcagcatgaccctggtggacaagttcaacccccacaccagcccccacggcatcagcagcatctgctggagcagcaacaacaacttcctggtgaccgccagcagcagcggcgacaagatcgtggtgagcagctgcaagtgcaagcccgtgcccctgctggagctggccgagggccagaagcagacctgcgtgaacctgaacagcaccagcatgtacctggtgagcggcggcctgaacaacaccgtgtag

SEQ ID NO: 90646 - DNA, 498 bp, Artificial Sequence
  Description of Artificial Sequence: Synthetic coding sequence
atgcaggagaacctgagattcgccagcagcggcgacgacatcaagatctgggacgccagcagcatgaccctggtggacaagttcaacccccacaccagcccccacggcatcagcagcatctgctggagcagcaacaacaacttcctggtgaccgccagcagcagcggcgacaagatcgtggtgagcagctgcaagtgcaagcccgtgcccctgctggagctggccgagggccagaagcagacctgcgtgaacctgaacagcaccagcatgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggcagcaaccagagcgtgtag

SEQ ID NO: 90647 - DNA, 2004 bp, Artificial Sequence
  Description of Artificial Sequence: Synthetic coding sequence
atgcacttcaccggcgccgtgatgcaggagaacctgagattcgccagcagcggcgacgacatcaagatctgggacgccagcagcatgaccctggtggacaagttcaacccccacaccagcccccacggcatcagcagcatctgctggagcagcaacaacaacttcctggtgaccgccagcagcagcggcgacaagatcgtggtgagcagctgcaagtgcaagcccgtgcccctgctggagctggccgagggccagaagcagacctgcgtgaacctgaacagcaccagcatgtacctggtgagcggcggcctgaacaacaccgtgaacatctgggacctgaagagcaagagagtgcacagaagcctgaaggaccacaaggaccaggtgacctgcgtgacctacaactggaacgactgctacatcgccagcggcagcctgagcggcgagatcatcctgcacagcgtgaccaccaacctgagcagcacccccttcggccacggcagcaaccagagcgtgagacacctgaagtacagcctgttcaagaagagcctgctgggcagcgtgagcgacaacggcatcgtgaccctgtgggacgtgaacagccagagcccctaccacaacttcgacagcgtgcacaaggcccccgccagcggcatctgcttcagccccgtgaacgagctgctgttcgtgaccatcggcctggacaagagaatcatcctgtacgacaccagcagcaagaagctggtgaagaccctggtggccgacacccccctgaccgccgtggacttcatgcccgacggcgccaccctggccatcggcagcagcagaggcaagatctaccagtacgacctgagaatgctgaagagccccgtgaagaccatcagcgcccacaagaccagcgtgcagtgcatcgccttccagtacagcaccgtgctgaccaagagcagcctgaacaagggctgcagcaacaagcccaccaccgtgaacaagagaagcgtgaacgtgaacgccgccagcggcggcgtgcagaacagcggcatcgtgagagaggcccccgccaccagcatcgccaccgtgctgccccagcccatgaccagcgccatgggcaagggcaccgtggccgtgcaggagaaggccggcctgcccagaagcatcaacaccgacaccctgagcaaggagaccgacagcggcaagaaccaggacttcagcagcttcgacgacaccggcaagagcagcctgggcgacatgttcagccccatcagagacgacgccgtggtgaacaagggcagcgacgagagcatcggcaagggcgacggcttcgacttcctgccccagctgaacagcgtgttcccccccagaaagaaccccgtgaccagcagcaccagcgtgctgcacagcagccccctgaacgtgttcatgggcagccccggcaaggaggagaacgagaacagagacctgaccgccgagagcaagaagatctacatgggcaagcaggagagcaaggacagcttcaagcagctggccaagctggtgaccagcggcgccgagagcggcaacctgaacaccagccccagcagcaaccagaccagaaacagcgagaagttcgagaagcccgagaacgagatcgaggcccagctgatctgcgagccccccatcaacggcagcagcacccccaaccccaagatcgccagcagcgtgaccgccggcgtggccagcagcctgagcgagaagatcgccgacagcatcggcaacaacagacagaacgcccccctgaccagcatccagatcagattcatccagaacatgatccaggagaccctggacgacttcagagaggcctgccacagagacatcgtgaacctgcaggtggagatgatcaagcagttccacatgcagctgaacgagatgcacagcctgctggagagatacagcgtgaacgagggcctggtggccgagatcgagagactgagagaggagaacaagagactgagagcccacttctag

SEQ ID NO: 90648 - DNA, 3744 bp, Artificial Sequence
  Description of Artificial Sequence: Synthetic coding sequence
atggcccagagcctgagactgcacttcgccgccagaagaagcaacacctaccccctgagcgagaccagcggcgacgacctggacagccacgtgcacatgtgcttcaagagacccaccagaatcagcaccagcaacgtggtgcagatgaagctgacccccagacagaccgccctggcccccctgatcaaggagaacgtgcagagccaggagagaagcagcgtgcccagcagcgagaacgtgaacaagaagagcagctgcctgcagatcagcctgcagcccaccagatacagcggctacctgcagagcagcaacgtgctggccgacagcgacgacgccagcttcacctgcatcctgaaggacggcatctacagcagcgccgtggtggacaacgagctgaacgccgtgaacgacggccacctggtgagcagccccgccatctgcagcggcagcctgagcaacttcagcaccagcgacaacggcagctacagcagcaacggcagcgacttcggcagctgcgccagcatcaccagcggcggcagctacaccaacagcgtgatcagcgacagcagcagctacaccttcccccccagcgacgacaccttcctgggcggcaacctgcccagcgacagcaccagcaacagaagcgtgcccaacagaaacaccaccccctgcgagatcttcagcagaagcaccagcaccgaccccttcgtgcaggacgacctggagcacggcctggagatcatgaagctgcccgtgagcagaaacaccaagatccccctgaagagatacagcagcctggtgatcttccccagaagccccagcaccaccagacccaccagccccaccagcctgtgcaccctgctgagcaagggcagctaccagaccagccaccagttcatcatcagccccagcgagatcgcccacaacgaggacggcaccagcgccaagggcttcctgagcaccgccgtgaacggcctgagactgagcaagaccatctgcacccccggcgaggtgagagacatcagacccctgcacagaaagggcagcctgcagaagaagatcgtgctgagcaacaacacccccagacagaccgtgtgcgagaagagcagcgagggctacagctgcgtgagcgtgcacttcacccagagaaaggccgccaccctggactgcgagaccaccaacggcgactgcaagcccgagatgagcgagatcaagctgaacagcgacagcgagtacatcaagctgatgcacagaaccagcgcctgcctgcccagcagccagaacgtggactgccagatcaacatcaacggcgagctggagagaccccacagccagatgaacaagaaccacggcatcctgagaagaagcatcagcctgggcggcgcctaccccaacatcagctgcctgagcagcctgaagcacaactgcagcaagggcggccccagccagctgctgatcaagttcgccagcggcaacgagggcaaggtggacaacctgagcagagacagcaacagagactgcaccaacgagctgagcaacagctgcaagcccggctgggtggtgctggaccagcccgacgccgcctgccacctgcagcagcagcaggagcccagccccctgccccccggctgggaggagagacaggacatcctgggcagaacctactacgtgaaccacgagagcagaagaacccagtggaagagacccaccccccaggacaacctgaccgacgccgagaacggcaacatccagctgcaggcccagagagccttcaccaccagaagacagatcagcgaggagaccgagagcgtggacaacagagagagcagcgagaactgggagatcatcagagaggacgaggccaccatgtacagcaaccaggccttccccagccccccccccagcagcaacctggacgtgcccacccacctggccgaggagctgaacgccagactgaccatcttcggcaacagcgccgtgagccagcccgccagcagcagcaaccacagcagcagaagaggcagcctgcaggcctacaccttcgaggagcagcccaccctgcccgtgctgctgcccaccagcagcggcctgccccccggctgggaggagaagcaggacgagagaggcagaagctactacgtggaccacaacagcagaaccaccacctggaccaagcccaccgtgcaggccaccgtggagaccagccagctgaccagcagccagagcagcgccggcccccagagccaggccagcaccagcgacagcggccagcaggtgacccagcccagcgagatcgagcagggcttcctgcccaagggctgggaggtgagacacgcccccaacggcagacccttcttcatcgaccacaacaccaagaccaccacctgggaggaccccagactgaagatccccgcccacctgagaggcaagaccagcctggacaccagcaacgacctgggccccctgccccccggctgggaggagagaacccacaccgacggcagaatcttctacatcaaccacaacatcaagagaacccagtgggaggaccccagactggagaacgtggccatcaccggccccgccgtgccctacagcagagactacaagagaaagtacgagttcttcagaagaaagctgaagaagcagaacgacatccccaacaagttcgagatgaagctgagaagagccaccgtgctggaggacagctacagaagaatcatgggcgtgaagagagccgacttcctgaaggccagactgtggatcgagttcgacggcgagaagggcctggactacggcggcgtggccagagagtggttcttcctgatcagcaaggagatgttcaacccctactacggcctgttcgagtacagcgccaccgacaactacaccctgcagatcaaccccaacagcggcctgtgcaacgaggaccacctgagctacttcaagttcatcggcagagtggccggcatggccgtgtaccacggcaagctgctggacggcttcttcatcagacccttctacaagatgatgctgcacaagcccatcaccctgcacgacatggagagcgtggacagcgagtactacaacagcctgagatggatcctggagaacgaccccaccgagctggacctgagattcatcatcgacgaggagctgttcggccagacccaccagcacgagctgaagaacggcggcagcgagatcgtggtgaccaacaagaacaagaaggagtacatctacctggtgatccagtggagattcgtgaacagaatccagaagcagatggccgccttcaaggagggcttcttcgagctgatcccccaggacctgatcaagatcttcgacgagaacgagctggagctgctgatgtgcggcctgggcgacgtggacgtgaacgactggagagagcacaccaagtacaagaacggctacagcgccaaccaccaggtgatccagtggttctggaaggccgtgctgatgatggacagcgagaagagaatcagactgctgcagttcgtgaccggcaccagcagagtgcccatgaacggcttcgccgagctgtacggcagcaacggcccccagagcttcaccgtggagcagtggggcacccccgagaagctgcccagagcccacacctgcttcaacagactggacctgcccccctacgagagcttcgaggagctgtgggacaagctgcagatggccatcgagaacacccagggcttcgacggcgtggactag

SEQ ID NO: 90649 - DNA, 2703 bp, Artificial Sequence
  Description of Artificial Sequence: Synthetic coding sequence
atggccacctgcgccgtggaggtgttcggcctgctggaggacgaggagaacagcagaatcgtgagagtgagagtgatcgccggcatcggcctggccaagaaggacatcctgggcgccagcgacccctacgtgagagtgaccctgtacgaccccatgaacggcgtgctgaccagcgtgcagaccaagaccatcaagaagagcctgaaccccaagtggaacgaggagatcctgttcagagtgcacccccagcagcacagactgctgttcgaggtgttcgacgagaacagactgaccagagacgacttcctgggccaggtggacgtgcccctgtaccccctgcccaccgagaaccccagactggagagaccctacaccttcaaggacttcgtgctgcaccccagaagccacaagagcagagtgaagggctacctgagactgaagatgacctacctgcccaagaccagcggcagcgaggacgacaacgccgagcaggccgaggagctggagcccggctgggtggtgctggaccagcccgacgccgcctgccacctgcagcagcagcaggagcccagccccctgccccccggctgggaggagagacaggacatcctgggcagaacctactacgtgaaccacgagagcagaagaacccagtggaagagacccaccccccaggacaacctgaccgacgccgagaacggcaacatccagctgcaggcccagagagccttcaccaccagaagacagatcagcgaggagaccgagagcgtggacaacagagagagcagcgagaactgggagatcatcagagaggacgaggccaccatgtacagcaaccaggccttccccagccccccccccagcagcaacctggacgtgcccacccacctggccgaggagctgaacgccagactgaccatcttcggcaacagcgccgtgagccagcccgccagcagcagcaaccacagcagcagaagaggcagcctgcaggcctacaccttcgaggagcagcccaccctgcccgtgctgctgcccaccagcagcggcctgccccccggctgggaggagaagcaggacgagagaggcagaagctactacgtggaccacaacagcagaaccaccacctggaccaagcccaccgtgcaggccaccgtggagaccagccagctgaccagcagccagagcagcgccggcccccagagccaggccagcaccagcgacagcggccagcaggtgacccagcccagcgagatcgagcagggcttcctgcccaagggctgggaggtgagacacgcccccaacggcagacccttcttcatcgaccacaacaccaagaccaccacctgggaggaccccagactgaagatccccgcccacctgagaggcaagaccagcctggacaccagcaacgacctgggccccctgccccccggctgggaggagagaacccacaccgacggcagaatcttctacatcaaccacaacatcaagagaacccagtgggaggaccccagactggagaacgtggccatcaccggccccgccgtgccctacagcagagactacaagagaaagtacgagttcttcagaagaaagctgaagaagcagaacgacatccccaacaagttcgagatgaagctgagaagagccaccgtgctggaggacagctacagaagaatcatgggcgtgaagagagccgacttcctgaaggccagactgtggatcgagttcgacggcgagaagggcctggactacggcggcgtggccagagagtggttcttcctgatcagcaaggagatgttcaacccctactacggcctgttcgagtacagcgccaccgacaactacaccctgcagatcaaccccaacagcggcctgtgcaacgaggaccacctgagctacttcaagttcatcggcagagtggccggcatggccgtgtaccacggcaagctgctggacggcttcttcatcagacccttctacaagatgatgctgcacaagcccatcaccctgcacgacatggagagcgtggacagcgagtactacaacagcctgagatggatcctggagaacgaccccaccgagctggacctgagattcatcatcgacgaggagctgttcggccagacccaccagcacgagctgaagaacggcggcagcgagatcgtggtgaccaacaagaacaagaaggagtacatctacctggtgatccagtggagattcgtgaacagaatccagaagcagatggccgccttcaaggagggcttcttcgagctgatcccccaggacctgatcaagatcttcgacgagaacgagctggagctgctgatgtgcggcctgggcgacgtggacgtgaacgactggagagagcacaccaagtacaagaacggctacagcgccaaccaccaggtgatccagtggttctggaaggccgtgctgatgatggacagcgagaagagaatcagactgctgcagttcgtgaccggcaccagcagagtgcccatgaacggcttcgccgagctgtacggcagcaacggcccccagagcttcaccgtggagcagtggggcacccccgagaagctgcccagagcccacacctgcttcaacagactggacctgcccccctacgagagcttcgaggagctgtgggacaagctgcagatggccatcgagaacacccagggcttcgacggcgtggactag

SEQ ID NO: 90650 - DNA, 3912 bp, Artificial Sequence
  Description of Artificial Sequence: Synthetic coding sequence
atggcccagagcctgagactgcacttcgccgccagaagaagcaacacctaccccctgagcgagaccagcggcgacgacctggacagccacgtgcacatgtgcttcaagagacccaccagaatcagcaccagcaacgtggtgcagatgaagctgacccccagacagaccgccctggcccccctgatcaaggagaacgtgcagagccaggagagaagcagcgtgcccagcagcgagaacgtgaacaagaagagcagctgcctgcagatcagcctgcagcccaccagatacagcggctacctgcagagcagcaacgtgctggccgacagcgacgacgccagcttcacctgcatcctgaaggacggcatctacagcagcgccgtggtggacaacgagctgaacgccgtgaacgacggccacctggtgagcagccccgccatctgcagcggcagcctgagcaacttcagcaccagcgacaacggcagctacagcagcaacggcagcgacttcggcagctgcgccagcatcaccagcggcggcagctacaccaacagcgtgatcagcgacagcagcagctacaccttcccccccagcgacgacaccttcctgggcggcaacctgcccagcgacagcaccagcaacagaagcgtgcccaacagaaacaccaccccctgcgagatcttcagcagaagcaccagcaccgaccccttcgtgcaggacgacctggagcacggcctggagatcatgaagctgcccgtgagcagaaacaccaagatccccctgaagagatacagcagcctggtgatcttccccagaagccccagcaccaccagacccaccagccccaccagcctgtgcaccctgctgagcaagggcagctaccagaccagccaccagttcatcatcagccccagcgagatcgcccacaacgaggacggcaccagcgccaagggcttcctgagcaccgccgtgaacggcctgagactgagcaagaccatctgcacccccggcgaggtgagagacatcagacccctgcacagaaagggcagcctgcagaagaagatcgtgctgagcaacaacacccccagacagaccgtgtgcgagaagagcagcgagggctacagctgcgtgagcgtgcacttcacccagagaaaggccgccaccctggactgcgagaccaccaacggcgactgcaagcccgagatgagcgagatcaagctgaacagcgacagcgagtacatcaagctgatgcacagaaccagcgcctgcctgcccagcagccagaacgtggactgccagatcaacatcaacggcgagctggagagaccccacagccagatgaacaagaaccacggcatcctgagaagaagcatcagcctgggcggcgcctaccccaacatcagctgcctgagcagcctgaagcacaactgcagcaagggcggccccagccagctgctgatcaagttcgccagcggcaacgagggcaaggtggacaacctgagcagagacagcaacagagactgcaccaacgagctgagcaacagctgcaagaccagagacgacttcctgggccaggtggacgtgcccctgtaccccctgcccaccgagaaccccagactggagagaccctacaccttcaaggacttcgtgctgcaccccagaagccacaagagcagagtgaagggctacctgagactgaagatgacctacctgcccaagaccagcggcagcgaggacgacaacgccgagcaggccgaggagctggagcagcagcaggagcccagccccctgccccccggctgggaggagagacaggacatcctgggcagaacctactacgtgaaccacgagagcagaagaacccagtggaagagacccaccccccaggacaacctgaccgacgccgagaacggcaacatccagctgcaggcccagagagccttcaccaccagaagacagatcagcgaggagaccgagagcgtggacaacagagagagcagcgagaactgggagatcatcagagaggacgaggccaccatgtacagcaaccaggccttccccagccccccccccagcagcaacctggacgtgcccacccacctggccgaggagctgaacgccagactgaccatcttcggcaacagcgccgtgagccagcccgccagcagcagcaaccacagcagcagaagaggcagcctgcaggcctacaccttcgaggagcagcccaccctgcccgtgctgctgcccaccagcagcggcctgccccccggctgggaggagaagcaggacgagagaggcagaagctactacgtggaccacaacagcagaaccaccacctggaccaagcccaccgtgcaggccaccgtggagaccagccagctgaccagcagccagagcagcgccggcccccagagccaggccagcaccagcgacagcggccagcaggtgacccagcccagcgagatcgagcagggcttcctgcccaagggctgggaggtgagacacgcccccaacggcagacccttcttcatcgaccacaacaccaagaccaccacctgggaggaccccagactgaagatccccgcccacctgagaggcaagaccagcctggacaccagcaacgacctgggccccctgccccccggctgggaggagagaacccacaccgacggcagaatcttctacatcaaccacaacatcaagagaacccagtgggaggaccccagactggagaacgtggccatcaccggccccgccgtgccctacagcagagactacaagagaaagtacgagttcttcagaagaaagctgaagaagcagaacgacatccccaacaagttcgagatgaagctgagaagagccaccgtgctggaggacagctacagaagaatcatgggcgtgaagagagccgacttcctgaaggccagactgtggatcgagttcgacggcgagaagggcctggactacggcggcgtggccagagagtggttcttcctgatcagcaaggagatgttcaacccctactacggcctgttcgagtacagcgccaccgacaactacaccctgcagatcaaccccaacagcggcctgtgcaacgaggaccacctgagctacttcaagttcatcggcagagtggccggcatggccgtgtaccacggcaagctgctggacggcttcttcatcagacccttctacaagatgatgctgcacaagcccatcaccctgcacgacatggagagcgtggacagcgagtactacaacagcctgagatggatcctggagaacgaccccaccgagctggacctgagattcatcatcgacgaggagctgttcggccagacccaccagcacgagctgaagaacggcggcagcgagatcgtggtgaccaacaagaacaagaaggagtacatctacctggtgatccagtggagattcgtgaacagaatccagaagcagatggccgccttcaaggagggcttcttcgagctgatcccccaggacctgatcaagatcttcgacgagaacgagctggagctgctgatgtgcggcctgggcgacgtggacgtgaacgactggagagagcacaccaagtacaagaacggctacagcgccaaccaccaggtgatccagtggttctggaaggccgtgctgatgatggacagcgagaagagaatcagactgctgcagttcgtgaccggcaccagcagagtgcccatgaacggcttcgccgagctgtacggcagcaacggcccccagagcttcaccgtggagcagtggggcacccccgagaagctgcccagagcccacacctgcttcaacagactggacctgcccccctacgagagcttcgaggagctgtgggacaagctgcagatggccatcgagaacacccagggcttcgacggcgtggactag

SEQ ID NO: 90651 - DNA, 3960 bp, Artificial Sequence
  Description of Artificial Sequence: Synthetic coding sequence
atggcccagagcctgagactgcacttcgccgccagaagaagcaacacctaccccctgagcgagaccagcggcgacgacctggacagccacgtgcacatgtgcttcaagagacccaccagaatcagcaccagcaacgtggtgcagatgaagctgacccccagacagaccgccctggcccccctgatcaaggagaacgtgcagagccaggagagaagcagcgtgcccagcagcgagaacgtgaacaagaagagcagctgcctgcagatcagcctgcagcccaccagatacagcggctacctgcagagcagcaacgtgctggccgacagcgacgacgccagcttcacctgcatcctgaaggacggcatctacagcagcgccgtggtggacaacgagctgaacgccgtgaacgacggccacctggtgagcagccccgccatctgcagcggcagcctgagcaacttcagcaccagcgacaacggcagctacagcagcaacggcagcgacttcggcagctgcgccagcatcaccagcggcggcagctacaccaacagcgtgatcagcgacagcagcagctacaccttcccccccagcgacgacaccttcctgggcggcaacctgcccagcgacagcaccagcaacagaagcgtgcccaacagaaacaccaccccctgcgagatcttcagcagaagcaccagcaccgaccccttcgtgcaggacgacctggagcacggcctggagatcatgaagctgcccgtgagcagaaacaccaagatccccctgaagagatacagcagcctggtgatcttccccagaagccccagcaccaccagacccaccagccccaccagcctgtgcaccctgctgagcaagggcagctaccagaccagccaccagttcatcatcagccccagcgagatcgcccacaacgaggacggcaccagcgccaagggcttcctgagcaccgccgtgaacggcctgagactgagcaagaccatctgcacccccggcgaggtgagagacatcagacccctgcacagaaagggcagcctgcagaagaagatcgtgctgagcaacaacacccccagacagaccgtgtgcgagaagagcagcgagggctacagctgcgtgagcgtgcacttcacccagagaaaggccgccaccctggactgcgagaccaccaacggcgactgcaagcccgagatgagcgagatcaagctgaacagcgacagcgagtacatcaagctgatgcacagaaccagcgcctgcctgcccagcagccagaacgtggactgccagatcaacatcaacggcgagctggagagaccccacagccagatgaacaagaaccacggcatcctgagaagaagcatcagcctgggcggcgcctaccccaacatcagctgcctgagcagcctgaagcacaactgcagcaagggcggccccagccagctgctgatcaagttcgccagcggcaacgagggcaaggtggacaacctgagcagagacagcaacagagactgcaccaacgagctgagcaacagctgcaagaccagagacgacttcctgggccaggtggacgtgcccctgtaccccctgcccaccgagaaccccagactggagagaccctacaccttcaaggacttcgtgctgcaccccagaagccacaagagcagagtgaagggctacctgagactgaagatgacctacctgcccaagaccagcggcagcgaggacgacaacgccgagcaggccgaggagctggagcccggctgggtggtgctggaccagcccgacgccgcctgccacctgcagcagcagcaggagcccagccccctgccccccggctgggaggagagacaggacatcctgggcagaacctactacgtgaaccacgagagcagaagaacccagtggaagagacccaccccccaggacaacctgaccgacgccgagaacggcaacatccagctgcaggcccagagagccttcaccaccagaagacagatcagcgaggagaccgagagcgtggacaacagagagagcagcgagaactgggagatcatcagagaggacgaggccaccatgtacagcaaccaggccttccccagccccccccccagcagcaacctggacgtgcccacccacctggccgaggagctgaacgccagactgaccatcttcggcaacagcgccgtgagccagcccgccagcagcagcaaccacagcagcagaagaggcagcctgcaggcctacaccttcgaggagcagcccaccctgcccgtgctgctgcccaccagcagcggcctgccccccggctgggaggagaagcaggacgagagaggcagaagctactacgtggaccacaacagcagaaccaccacctggaccaagcccaccgtgcaggccaccgtggagaccagccagctgaccagcagccagagcagcgccggcccccagagccaggccagcaccagcgacagcggccagcaggtgacccagcccagcgagatcgagcagggcttcctgcccaagggctgggaggtgagacacgcccccaacggcagacccttcttcatcgaccacaacaccaagaccaccacctgggaggaccccagactgaagatccccgcccacctgagaggcaagaccagcctggacaccagcaacgacctgggccccctgccccccggctgggaggagagaacccacaccgacggcagaatcttctacatcaaccacaacatcaagagaacccagtgggaggaccccagactggagaacgtggccatcaccggccccgccgtgccctacagcagagactacaagagaaagtacgagttcttcagaagaaagctgaagaagcagaacgacatccccaacaagttcgagatgaagctgagaagagccaccgtgctggaggacagctacagaagaatcatgggcgtgaagagagccgacttcctgaaggccagactgtggatcgagttcgacggcgagaagggcctggactacggcggcgtggccagagagtggttcttcctgatcagcaaggagatgttcaacccctactacggcctgttcgagtacagcgccaccgacaactacaccctgcagatcaaccccaacagcggcctgtgcaacgaggaccacctgagctacttcaagttcatcggcagagtggccggcatggccgtgtaccacggcaagctgctggacggcttcttcatcagacccttctacaagatgatgctgcacaagcccatcaccctgcacgacatggagagcgtggacagcgagtactacaacagcctgagatggatcctggagaacgaccccaccgagctggacctgagattcatcatcgacgaggagctgttcggccagacccaccagcacgagctgaagaacggcggcagcgagatcgtggtgaccaacaagaacaagaaggagtacatctacctggtgatccagtggagattcgtgaacagaatccagaagcagatggccgccttcaaggagggcttcttcgagctgatcccccaggacctgatcaagatcttcgacgagaacgagctggagctgctgatgtgcggcctgggcgacgtggacgtgaacgactggagagagcacaccaagtacaagaacggctacagcgccaaccaccaggtgatccagtggttctggaaggccgtgctgatgatggacagcgagaagagaatcagactgctgcagttcgtgaccggcaccagcagagtgcccatgaacggcttcgccgagctgtacggcagcaacggcccccagagcttcaccgtggagcagtggggcacccccgagaagctgcccagagcccacacctgcttcaacagactggacctgcccccctacgagagcttcgaggagctgtgggacaagctgcagatggccatcgagaacacccagggcttcgacggcgtggactag

SEQ ID NO: 90652 - DNA, 2616 bp, Artificial Sequence
  Description of Artificial Sequence: Synthetic coding sequence
atggccaccggcctgggcgagcccgtgtacggcctgagcgaggacgagggcgagagcagaatcctgagagtgaaggtggtgagcggcatcgacctggccaagaaggacatcttcggcgccagcgacccctacgtgaagctgagcctgtacgtggccgacgagaacagagagctggccctggtgcagaccaagaccatcaagaagaccctgaaccccaagtggaacgaggagttctacttcagagtgaaccccagcaaccacagactgctgttcgaggtgttcgacgagaacagactgaccagagacgacttcctgggccaggtggacgtgcccctgagccacctgcccaccgaggaccccaccatggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgccccccggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90653 - DNA, 2508 bp, Artificial Sequence
  Description of Artificial Sequence: Synthetic coding sequence
atggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccaaggccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90654 - DNA, 2736 bp, Artificial Sequence
  Description of Artificial Sequence: Synthetic coding sequence
atggccaccggcctgggcgagcccgtgtacggcctgagcgaggacgagggcgagagcagaatcctgagagtgaaggtggtgagcggcatcgacctggccaagaaggacatcttcggcgccagcgacccctacgtgaagctgagcctgtacgtggccgacgagaacagagagctggccctggtgcagaccaagaccatcaagaagaccctgaaccccaagtggaacgaggagttctacttcagagtgaaccccagcaaccacagactgctgttcgaggtgttcgacgagaacagactgaccagagacgacttcctgggccaggtggacgtgcccctgagccacctgcccaccgaggaccccaccatggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgccccccctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90655 - DNA, 2904 bp, Artificial Sequence
  Description of Artificial Sequence: Synthetic coding sequence
atgagaagactggccttcgagcagggcgagagcagaatcctgagagtgaaggtggtgagcggcatcgacctggccaagaaggacatcttcggcgccagcgacccctacgtgaagctgagcctgtacgtggccgacgagaacagagagctggccctggtgcagaccaagaccatcaagaagaccctgaaccccaagtggaacgaggagttctacttcagagtgaaccccagcaaccacagactgctgttcgaggtgttcgacgagaacagactgaccagagacgacttcctgggccaggtggacgtgcccctgagccacctgcccaccgaggaccccaccatggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgcccccgccggcagagccagaagcagcaccgtgaccggcggcgaggagcccacccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90656 - DNA, 2868 bp, Artificial Sequence
  Description of Artificial Sequence: Synthetic coding sequence
atggccaccggcctgggcgagcccgtgtacggcctgagcgaggacgagggcgagagcagaatcctgagagtgaaggtggtgagcggcatcgacctggccaagaaggacatcttcggcgccagcgacccctacgtgaagctgagcctgtacgtggccgacgagaacagagagctggccctggtgcagaccaagaccatcaagaagaccctgaaccccaagtggaacgaggagttctacttcagagtgaaccccagcaaccacagactgctgttcgaggtgttcgacgagaacagactgaccagagacgacttcctgggccaggtggacgtgcccctgagccacctgcccaccgaggaccccaccatggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90657 - DNA, 2928 bp, Artificial Sequence
  Description of Artificial Sequence: Synthetic coding sequence
atggccaccggcctgggcgagcccgtgtacggcctgagcgaggacgagggcgagagcagaatcctgagagtgaaggtggtgagcggcatcgacctggccaagaaggacatcttcggcgccagcgacccctacgtgaagctgagcctgtacgtggccgacgagaacagagagctggccctggtgcagaccaagaccatcaagaagaccctgaaccccaagtggaacgaggagttctacttcagagtgaaccccagcaaccacagactgctgttcgaggtgttcgacgagaacagactgaccagagacgacttcctgggccaggtggacgtgcccctgagccacctgcccaccgaggaccccaccatggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgcccccgccggcagagccagaagcagcaccgtgaccggcggcgaggagcccacccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90658 - DNA, 2565 bp, Artificial Sequence
  Description of Artificial Sequence: Synthetic coding sequence
atggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgcccccgccggcagagccagaagcagcaccgtgaccggcggcgaggagcccacccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90659 - DNA, 2505 bp, Artificial Sequence
  Description of Artificial Sequence: Synthetic coding sequence
atggagagaccctacaccttcaaggacttcctgctgagacccagaagccacaagagcagagtgaagggcttcctgagactgaagatggcctacatgcccaagaacggcggccaggacgaggagaacagcgaccagagagacgacatggagcacggctgggaggtggtggacagcaacgacagcgccagccagcaccaggaggagctgccccccccccccctgccccccggctgggaggagaaggtggacaacctgggcagaacctactacgtgaaccacaacaacagaaccacccagtggcacagacccagcctgatggacgtgagcagcgagagcgacaacaacatcagacagatcaaccaggaggccgcccacagaagattcagaagcagaagacacatcagcgaggacctggagcccgagcccagcgagggcggcgacgtgcccgagccctgggagaccatcagcgaggaggtgaacatcgccggcgacagcctgggcctggccctgccccccccccccgccagccccggcagcagaaccagcccccaggagctgagcgaggagctgagcagaagactgcagatcacccccgacagcaacggcgagcagttcagcagcctgatccagagagagcccagcagcagactgagaagctgcagcgtgaccgacgccgtggccgagcagggccacctgcccccccccagcgtggcctacgtgcacaccacccccggcctgcccagcggctgggaggagagaaaggacgccaagggcagaacctactacgtgaaccacaacaacagaaccaccacctggaccagacccatcatgcagctggccgaggacggcgccagcggcagcgccaccaacagcaacaaccacctgatcgagccccagatcagaagacccagaagcctgagcagccccaccgtgaccctgagcgcccccctggagggcgccaaggacagccccgtgagaagagccgtgaaggacaccctgagcaacccccagagcccccagcccagcccctacaacagccccaagccccagcacaaggtgacccagagcttcctgccccccggctgggagatgagaatcgcccccaacggcagacccttcttcatcgaccacaacaccaagaccaccacctgggaggaccccagactgaagttccccgtgcacatgagaagcaagaccagcctgaaccccaacgacctgggccccctgccccccggctgggaggagagaatccacctggacggcagaaccttctacatcgaccacaacagcaagatcacccagtgggaggaccccagactgcagaaccccgccatcaccggccccgccgtgccctacagcagagagttcaagcagaagtacgactacttcagaaagaagctgaagaagcccgccgacatccccaacagattcgagatgaagctgcacagaaacaacatcttcgaggagagctacagaagaatcatgagcgtgaagagacccgacgtgctgaaggccagactgtggatcgagttcgagagcgagaagggcctggactacggcggcgtggccagagagtggttcttcctgctgagcaaggagatgttcaacccctactacggcctgttcgagtacagcgccaccgacaactacaccctgcagatcaaccccaacagcggcctgtgcaacgaggaccacctgagctacttcaccttcatcggcagagtggccggcctggccgtgttccacggcaagctgctggacggcttcttcatcagacccttctacaagatgatgctgggcaagcagatcaccctgaacgacatggagagcgtggacagcgagtactacaacagcctgaagtggatcctggagaacgaccccaccgagctggacctgatgttctgcatcgacgaggagaacttcggccagacctaccaggtggacctgaagcccaacggcagcgagatcatggtgaccaacgagaacaagagagagtacatcgacctggtgatccagtggagattcgtgaacagagtgcagaagcagatgaacgccttcctggagggcttcaccgagctgctgcccatcgacctgatcaagatcttcgacgagaacgagctggagctgctgatgtgcggcctgggcgacgtggacgtgaacgactggagacagcacagcatctacaagaacggctactgccccaaccaccccgtgatccagtggttctggaaggccgtgctgctgatggacgccgagaagagaatcagactgctgcagttcgtgaccggcaccagcagagtgcccatgaacggcttcgccgagctgtacggcagcaacggcccccagctgttcaccatcgagcagtggggcagccccgagaagctgcccagagcccacacctgcttcaacagactggacctgcccccctacgagaccttcgaggacctgagagagaagctgctgatggccgtggagaacgcccagggcttcgagggcgtggactag

SEQ ID NO: 90660 - DNA, 2505 bp, Artificial Sequence; identical to SEQ ID NO: 90659
  Description of Artificial Sequence: Synthetic coding sequence

SEQ ID NO: 90661 - DNA, 2565 bp, Artificial Sequence; identical to SEQ ID NO: 90658
  Description of Artificial Sequence: Synthetic coding sequence

SEQ ID NO: 90662 - DNA, 525 bp, Artificial Sequence
  Description of Artificial Sequence: Synthetic coding sequence
atgaagtacaagaacctgatggccagagccctgtacgacaacgtgcccgagtgcgccgaggagctggccttcagaaagggcgacatcctgaccgtgatcgagcagaacaccggcggcctggagggctggtggctgtgcagcctgcacggcagacagggcatcgtgcccggcaacagagtgaagctgctgatcggccccatgcaggagaccgccagcagccacgagcagcccgccagcggcctgatgcagcagaccttcggccagcagaagctgtaccaggtgcccaacccccaggccgcccccagagacaccatctaccaggtgccccccagctaccagaaccagggcatctaccaggtgcccaccggccacggcacccaggagcaggaggtgtaccaggtgccccccagcgtgcagagaagcatcggcggcaccagcggcccccacgtgggcaagaaggtgttccagagagacggccaggtgagctacttcctggtgagagccagcaagcagaccagcctgtag

SEQ ID NO: 90663 - DNA, 2505 bp, Artificial Sequence
  Description of Artificial Sequence: Synthetic coding sequence
atgaagtacaagaacctgatggccagagccctgtacgacaacgtgcccgagtgcgccgaggagctggccttcagaaagggcgacatcctgaccgtgatcgagcagaacaccggcggcctggagggctggtggctgtgcagcctgcacggcagacagggcatcgtgcccggcaacagagtgaagctgctgatcggccccatgcaggagaccgccagcagccacgagcagcccgccagcggcctgatgcagcagaccttcggccagcagaagctgtaccaggtgcccaacccccaggccgcccccagagacaccatctaccaggtgccccccagctaccagaaccagggcatctaccaggtgcccaccggccacggcacccaggagcaggaggtgtaccaggtgccccccagcgtgcagagaagcatcggcggcaccagcggcccccacgtgggcaagaaggtgatcacccccgtgagaaccggccacggctacgtgtacgagtaccccagcagataccagaaggacgtgtacgacatcccccccagccacaccacccagggcgtgtacgacatcccccccagcagcgccaagggccccgtgttcagcgtgcccgtgggcgagatcaagccccagggcgtgtacgacatcccccccaccaagggcgtgtacgccatcccccccagcgcctgcagagacgaggccggcctgagagagaaggactacgacttccccccccccatgagacaggccggcagacccgacctgagacccgagggcgtgtacgacatcccccccacctgcaccaagcccgccggcaaggacctgcacgtgaagtacaactgcgacatccccggcgccgccgagcccgtggccagaagacaccagagcctgagccccaaccacccccccccccagctgggccagagcgtgggcagccagaacgacgcctacgacgtgcccagaggcgtgcagttcctggagccccccgccgagaccagcgagaaggccaacccccaggagagagacggcgtgtacgacgtgcccctgcacaacccccccgacgccaagggcagcagagacctggtggacggcatcaacagactgagcttcagcagcaccggcagcaccagaagcaacatgagcaccagcagcaccagcagcaaggagagcagcctgagcgccagccccgcccaggacaagagactgttcctggaccccgacaccgccatcgagagactgcagagactgcagcaggccctggagatgggcgtgagcagcctgatggccctggtgaccaccgactggagatgctacggctacatggagagacacatcaacgagatcagaaccgccgtggacaaggtggagctgttcctgaaggagtacctgcacttcgtgaagggcgccgtggccaacgccgcctgcctgcccgagctgatcctgcacaacaagatgaagagagagctgcagagagtggaggacagccaccagatcctgagccagaccagccacgacctgaacgagtgcagctggagcctgaacatcctggccatcaacaagccccagaacaagtgcgacgacctggacagattcgtgatggtggccaagaccgtgcccgacgacgccaagcagctgaccaccaccatcaacaccaacgccgaggccctgttcagacccggccccggcagcctgcacctgaagaacggccccgagagcatcatgaacagcaccgagtacccccacggcggcagccagggccagctgctgcaccccggcgaccacaaggcccaggcccacaacaaggccctgccccccggcctgagcaaggagcaggcccccgactgcagcagcagcgacggcagcgagagaagctggatggacgactacgactacgtgcacctgcagggcaaggaggagttcgagagacagcagaaggagctgctggagaaggagaacatcatgaagcagaacaagatgcagctggagcaccaccagctgagccagttccagctgctggagcaggagatcaccaagcccgtggagaacgacatcagcaagtggaagcccagccagagcctgcccaccaccaacagcggcgtgagcgcccaggacagacagctgctgtgcttctactacgaccagtgcgagacccacttcatcagcctgctgaacgccatcgacgccctgttcagctgcgtgagcagcgcccagccccccagaatcttcgtggcccacagcaagttcgtgatcctgagcgcccacaagctggtgttcatcggcgacaccctgaccagacaggtgaccgcccaggacatcagaaacaaggtgatgaacagcagcaaccagctgtgcgagcagctgaagaccatcgtgatggccaccaagatggccgccctgcactaccccagcaccaccgccctgcaggagatggtgcaccaggtgaccgacctgagcagaaacgcccagctgttcaagagaagcctgctggagatggccaccttctag

SEQ ID NO: 90664 - DNA, 99 bp, Artificial Sequence
  Description of Artificial Sequence: Synthetic coding sequence
atgtggaccagaaacctgatggccagagccctgtacgacaacgtgcccgagtgcgccgaggagctggccttcagaaagggcgacatcctgaccgtgtag

SEQ ID NO: 90665 - DNA, 2505 bp, Artificial Sequence
  Description of Artificial Sequence: Synthetic coding sequence
atgtggaccagaaacctgatggccagagccctgtacgacaacgtgcccgagtgcgccgaggagctggccttcagaaagggcgacatcctgaccgtgatcgagcagaacaccggcggcctggagggctggtggctgtgcagcctgcacggcagacagggcatcgtgcccggcaacagagtgaagctgctgatcggccccatgcaggagaccgccagcagccacgagcagcccgccagcggcctgatgcagcagaccttcggccagcagaagctgtaccaggtgcccaacccccaggccgcccccagagacaccatctaccaggtgccccccagctaccagaaccagggcatctaccaggtgcccaccggccacggcacccaggagcaggaggtgtaccaggtgccccccagcgtgcagagaagcatcggcggcaccagcggcccccacgtgggcaagaaggtgatcacccccgtgagaaccggccacggctacgtgtacgagtaccccagcagataccagaaggacgtgtacgacatcccccccagccacaccacccagggcgtgtacgacatcccccccagcagcgccaagggccccgtgttcagcgtgcccgtgggcgagatcaagccccagggcgtgtacgacatcccccccaccaagggcgtgtacgccatcccccccagcgcctgcagagacgaggccggcctgagagagaaggactacgacttccccccccccatgagacaggccggcagacccgacctgagacccgagggcgtgtacgacatcccccccacctgcaccaagcccgccggcaaggacctgcacgtgaagtacaactgcgacatccccggcgccgccgagcccgtggccagaagacaccagagcctgagccccaaccacccccccccccagctgggccagagcgtgggcagccagaacgacgcctacgacgtgcccagaggcgtgcagttcctggagccccccgccgagaccagcgagaaggccaacccccaggagagagacggcgtgtacgacgtgcccctgcacaacccccccgacgccaagggcagcagagacctggtggacggcatcaacagactgagcttcagcagcaccggcagcaccagaagcaacatgagcaccagcagcaccagcagcaaggagagcagcctgagcgccagccccgcccaggacaagagactgttcctggaccccgacaccgccatcgagagactgcagagactgcagcaggccctggagatgggcgtgagcagcctgatggccctggtgaccaccgactggagatgctacggctacatggagagacacatcaacgagatcagaaccgccgtggacaaggtggagctgttcctgaaggagtacctgcacttcgtgaagggcgccgtggccaacgccgcctgcctgcccgagctgatcctgcacaacaagatgaagagagagctgcagagagtggaggacagccaccagatcctgagccagaccagccacgacctgaacgagtgcagctggagcctgaacatcctggccatcaacaagccccagaacaagtgcgacgacctggacagattcgtgatggtggccaagaccgtgcccgacgacgccaagcagctgaccaccaccatcaacaccaacgccgaggccctgttcagacccggccccggcagcctgcacctgaagaacggccccgagagcatcatgaacagcaccgagtacccccacggcggcagccagggccagctgctgcaccccggcgaccacaaggcccaggcccacaacaaggccctgccccccggcctgagcaaggagcaggcccccgactgcagcagcagcgacggcagcgagagaagctggatggacgactacgactacgtgcacctgcagggcaaggaggagttcgagagacagcagaaggagctgctggagaaggagaacatcatgaagcagaacaagatgcagctggagcaccaccagctgagccagttccagctgctggagcaggagatcaccaagcccgtggagaacgacatcagcaagtggaagcccagccagagcctgcccaccaccaacagcggcgtgagcgcccaggacagacagctgctgtgcttctactacgaccagtgcgagacccacttcatcagcctgctgaacgccatcgacgccctgttcagctgcgtgagcagcgcccagccccccagaatcttcgtggcccacagcaagttcgtgatcctgagcgcccacaagctggtgttcatcggcgacaccctgaccagacaggtgaccgcccaggacatcagaaacaaggtgatgaacagcagcaaccagctgtgcgagcagctgaagaccatcgtgatggccaccaagatggccgccctgcactaccccagcaccaccgccctgcaggagatggtgcaccaggtgaccgacctgagcagaaacgcccagctgttcaagagaagcctgctggagatggccaccttctag

SEQ ID NO: 90666 - DNA, 1212 bp, Artificial Sequence
  Description of Artificial Sequence: Synthetic coding sequence
atgctgagacccgaggccggcctggtgggcctgcacggccccgcccaggagaacagcgccctgcccggcagaagagacagcgccagcgagctgagagccctgagcggcctggaggtggaccccggcgagggctggggcagagtggtgctgatcagccccagaaccgtgagattcagagtgctgagccccggcgtgagagaggagggccacgtgcagaacaacggccagaaccaggccagacccgccagaggcgtgaccggcgccggcggctggggcagcgccgccgtgtgcagaggcagagccctgagaggcagagagcccgccctgcccagcgccagcttccccgacgtggccgcctgccccggcagcctggactgcgccctgaagagaagagccagatgcccccccggcgcccacgcctgcggcccctgcctgcagcccttccaggaggaccagcagggcctgtgcgtgcccagaatgagaagaccccccggcggcggcagaccccagcccagactggaggacgagatcgacttcctggcccaggagctggccagaaaggagagcggccacagcaccccccccctgcccaaggacagacagagactgcccgagcccgccaccctgggcttcagcgccagaggccagggcctggagctgggcctgcccagcacccccggcacccccacccccaccccccacaccagcctgggcagccccgtgagcagcgaccccgtgcacatgagccccctggagcccagaggcggccagggcgacggcctggccctggtgctgatcctggccttctgcgtggccggcgccgccgccctgagcgtggccagcctgtgctggtgcagactgcagagagagatcagactgacccagaaggccgactacgccaccgccaaggcccccggcagccccgccgcccccagaatcagccccggcgaccagagactggcccagagcgccgagatgtaccactaccagcaccagagacagcagatgctgtgcctggagagacacaaggagccccccaaggagctggacaccgccagcagcgacgaggagaacgaggacggcgacttcaccgtgtacgagtgccccggcctggcccccaccggcgagatggaggtgagaaaccccctgttcgaccacgccgccctgagcgcccccctgcccgcccccagcagcccccccgccctgccctag

SEQ ID NO: 90667 - DNA, 978 bp, Artificial Sequence
  Description of Artificial Sequence: Synthetic coding sequence
atggccacccccctgcccccccccagccccagacacctgagactgctgagactgctgctgagcggcctggtgctgggcgccgccctgagaggcgccgccgccggccaccccgacgtggccgcctgccccggcagcctggactgcgccctgaagagaagagccagatgcccccccggcgcccacgcctgcggcccctgcctgcagcccttccaggaggaccagcagggcctgtgcgtgcccagaatgagaagaccccccggcggcggcagaccccagcccagactggaggacgagatcgacttcctggcccaggagctggccagaaaggagagcggccacagcaccccccccctgcccaaggacagacagagactgcccgagcccgccaccctgggcttcagcgccagaggccagggcctggagctgggcctgcccagcacccccggcacccccacccccaccccccacaccagcctgggcagccccgtgagcagcgaccccgtgcacatgagccccctggagcccagaggcggccagggcgacggcctggccctggtgctgatcctggccttctgcgtggccggcgccgccgccctgagcgtggccagcctgtgctggtgcagactgcagagagagatcagactgacccagaaggccgactacgccaccgccaaggcccccggcagccccgccgcccccagaatcagccccggcgaccagagactggcccagagcgccgagatgtaccactaccagcaccagagacagcagatgctgtgcctggagagacacaaggagccccccaaggagctggacaccgccagcagcgacgaggagaacgaggacggcgacttcaccgtgtacgagtgccccggcctggcccccaccggcgagatggaggtgagaaaccccctgttcgaccacgccgccctgagcgcccccctgcccgcccccagcagcccccccgccctgccctag

SEQ ID NO: 90668 - DNA, 297 bp, Artificial Sequence
  Description of Artificial Sequence: Synthetic coding sequence
atgagcgtgagagagctgaacagacagctgagaggctgcggcagagacgaggccctgagactgaagcagagaagaagaaccctgaagaacagaggctacgcccaggcctgcagaagcaagagactgcagcagagaagaggcctggaggccgagagagccagactggccgcccagctggacgccctgagagccgaggtggccagactggccagagagagagacctgtacaaggccagatgcgacagactgaccagcagcggccccggcagcggcgaccccagccacctgttcctgtag

SEQ ID NO: 90669 - DNA, 714 bp, Artificial Sequence
  Description of Artificial Sequence: Synthetic coding sequence
atggccctgccccccagccccctggccatggagtacgtgaacgacttcgacctgatgaagttcgaggtgaagagagagcccagcgagggcagacccggcccccccaccgccagcctgggcagcaccccctacagcagcgtgccccccagccccaccttcagcgagcccggcatggtgggcgccaccgagggcaccagacccggcctggaggagctgtactggctggccaccctgcagcagcagctgggcgccggcgaggccctgggcctgagccccgaggaggccatggagctgctgcagggccagggccccgtgcccgtggacggcccccacggctactaccccggcagccccgaggagaccggcgcccagcacgtgcagctggccgagagattcagcgacgccgccctggtgagcatgagcgtgagagagctgaacagacagctgagaggctgcggcagagacgaggccctgagactgaagcagagaagaagaaccctgaagaacagaggctacgcccaggcctgcagaagcaagagactgcagcagagaagaggcctggaggccgagagagccagactggccgcccagctggacgccctgagagccgaggtggccagactggccagagagagagacctgtacaaggccagatgcgacagactgaccagcagcggccccggcagcggcgaccccagccacctgttcctgtag

SEQ ID NO: 90670 - DNA, 714 bp, Artificial Sequence; identical to SEQ ID NO: 90669
  Description of Artificial Sequence: Synthetic coding sequence

SEQ ID NO: 90671 - DNA, 198 bp, Artificial Sequence
  Description of Artificial Sequence: Synthetic coding sequence
atggccctgccccccagccccctggccatggagtacgtgaacgacttcgacctgatgaagttcgaggtgaagagagagcccagcgagggcagacccggcccccccaccgccagcctgggcagcaccccctacagcagcgtgccccccagccccaccttcagcgagcccggcatggtgggcgccaccgagggcacctag

SEQ ID NO: 90672 - DNA, 297 bp, Artificial Sequence; identical to SEQ ID NO: 90668
  Description of Artificial Sequence: Synthetic coding sequence

SEQ ID NO: 90673 - DNA, 714 bp, Artificial Sequence; identical to SEQ ID NO: 90669
  Description of Artificial Sequence: Synthetic coding sequence

SEQ ID NO: 90674 - DNA, 1674 bp, Artificial Sequence
  Description of Artificial Sequence: Synthetic coding sequence
atgggcggccagatcaccagaagcaccctgcacgacagcatcggcggccccttccccgtgaccagccacagatgccaccacaagcagaagcactgccccgccgtgctgcccagcggcggcctgcccgccacccccctgctgttccacccccacaccaagggcagccagatcctgatggacctgagccacaaggccgtgaagagacaggccagcttctgcaacgccatcaccttcagcaacagacccgtgctgatctacgagcaggtgagactgaagatcaccaagaagcagtgctgctggagcggcgccctgagactgggcttcaccagcaaggaccccagcagaatccaccccgacagcctgcccaagtacgcctgccccgacctggtgagccagagcggcttctgggccaaggccctgcccgaggagttcgccaacgagggcaacatcatcgccttctgggtggacaagaagggcagagtgttccacagaatcaacgacagcgccgtgatgctgttcttcagcggcgtgagaaccgccgaccccctgtgggccctggtggacgtgtacggcctgaccagaggcgtgcagctgctggacagcgagctggtgctgcccgactgcctgagacccagaagcttcaccgccctgagaagacccagcctgagaagagaggccgacgacgccagactgagcgtgagcctgtgcgacctgaacgtgcccggcgccgacggcgacgaggccgcccccgccgccggctgccccatcccccagaacagcctgaacagccagcacagcagagccctgcccgcccagctggacggcgacctgagattccacgccctgagagccggcgcccacgtgagaatcctggacgagcagaccgtggccagagtggagcacggcagagacgagagagccctggtgttcaccagcagacccgtgagagtggccgagaccatcttcgtgaaggtgaccagaagcggcggcgccagacccggcgccctgagcttcggcgtgaccacctgcgaccccggcaccctgagacccgccgacctgcccttcagccccgaggccctggtggacagaaaggagttctgggccgtgtgcagagtgcccggccccctgcacagcggcgacatcctgggcctggtggtgaacgccgacggcgagctgcacctgagccacaacggcgccgccgccggcatgcagctgtgcgtggacgccagccagcccctgtggatgctgttcggcctgcacggcaccatcacccagatcagaatcctgggcagcaccatcctggccgagagaggcatccccagcctgccctgcagccccgccagcacccccaccagccccagcgccctgggcagcagactgagcgaccccctgctgagcacctgcagcagcggccccctgggcagcagcgccggcggcaccgcccccaacagccccgtgagcctgcccgagagccccgtgacccccggcctgggccagtggagcgacgagtgcaccatctgctacgagcacgccgtggacaccgtgatctacacctgcggccacatgtgcctgtgctacgcctgcggcctgagactgaagaaggccctgcacgcctgctgccccatctgcagaagacccatcaaggacatcatcaagacctacagaagcagctag

SEQ ID NO: 90675 - DNA, 1725 bp, Artificial Sequence
  Description of Artificial Sequence: Synthetic coding sequence
atgggcaacaacttcagcagcatccccagcctgcccagaggcaaccccagcagagcccccagaggccacccccagaacctgaaggacagcatcggcggccccttccccgtgaccagccacagatgccaccacaagcagaagcactgccccgccgtgctgcccagcggcggcctgcccgccacccccctgctgttccacccccacaccaagggcagccagatcctgatggacctgagccacaaggccgtgaagagacaggccagcttctgcaacgccatcaccttcagcaacagacccgtgctgatctacgagcaggtgagactgaagatcaccaagaagcagtgctgctggagcggcgccctgagactgggcttcaccagcaaggaccccagcagaatccaccccgacagcctgcccaagtacgcctgccccgacctggtgagccagagcggcttctgggccaaggccctgcccgaggagttcgccaacgagggcaacatcatcgccttctgggtggacaagaagggcagagtgttccacagaatcaacgacagcgccgtgatgctgttcttcagcggcgtgagaaccgccgaccccctgtgggccctggtggacgtgtacggcctgaccagaggcgtgcagctgctggacagcgagctggtgctgcccgactgcctgagacccagaagcttcaccgccctgagaagacccagcctgagaagagaggccgacgacgccagactgagcgtgagcctgtgcgacctgaacgtgcccggcgccgacggcgacgaggccgcccccgccgccggctgccccatcccccagaacagcctgaacagccagcacagcagagccctgcccgcccagctggacggcgacctgagattccacgccctgagagccggcgcccacgtgagaatcctggacgagcagaccgtggccagagtggagcacggcagagacgagagagccctggtgttcaccagcagacccgtgagagtggccgagaccatcttcgtgaaggtgaccagaagcggcggcgccagacccggcgccctgagcttcggcgtgaccacctgcgaccccggcaccctgagacccgccgacctgcccttcagccccgaggccctggtggacagaaaggagttctgggccgtgtgcagagtgcccggccccctgcacagcggcgacatcctgggcctggtggtgaacgccgacggcgagctgcacctgagccacaacggcgccgccgccggcatgcagctgtgcgtggacgccagccagcccctgtggatgctgttcggcctgcacggcaccatcacccagatcagaatcctgggcagcaccatcctggccgagagaggcatccccagcctgccctgcagccccgccagcacccccaccagccccagcgccctgggcagcagactgagcgaccccctgctgagcacctgcagcagcggccccctgggcagcagcgccggcggcaccgcccccaacagccccgtgagcctgcccgagagccccgtgacccccggcctgggccagtggagcgacgagtgcaccatctgctacgagcacgccgtggacaccgtgatctacacctgcggccacatgtgcctgtgctacgcctgcggcctgagactgaagaaggccctgcacgcctgctgccccatctgcagaagacccatcaaggacatcatcaagacctacagaagcagctag

SEQ ID NO: 90676 - DNA, 600 bp, Artificial Sequence
  Description of Artificial Sequence: Synthetic coding sequence
atgggcggccagatcaccagaagcaccctgcacgacagcatcggcggccccttccccgtgaccagccacagatgccaccacaagcagaagcactgccccgccgtgctgcccagcggcggcctgcccgccacccccctgctgttccacccccacaccaagggcagccagatcctgatggacctgagccacaaggccgtgaagagacaggccagcttctgcaacgccatcaccttcagcaacagacccgtgctgatctacgagcaggtgagactgaagatcaccaagaagcagtgctgctggagcggcgccctgagactgggcttcaccagcaaggaccccagcagaatccaccccgacagcctgcccaagtacgcctgccccgacctggtgagccagagcggcttctgggccaaggccctgcccgaggagttcgccaacgagggcaacatcatcgccttctgggtggacaagaagggcagagtgttccacagaatcaacgacagcgccgtgatgctgttcttcagcggcgtgagaaccgccgaccccctgtgggccctggtggacgtgtacggcctgaccagaggcgtgcagctgctgtag

SEQ ID NO: 90677 - DNA, 327 bp, Artificial Sequence
  Description of Artificial Sequence: Synthetic coding sequence
atggacctgagccacaaggccgtgaagagacaggccagcttctgcaacgccatcaccttcagcaacagacccgtgctgatctacgagcaggtgagactgaagatcaccaagaagcagtgctgctggagcggcgccctgagactgggcttcaccagcaaggaccccagcagaatccaccccgacagcctgcccaagtacgcctgccccgacctggtgagccagagcggcttctgggccaaggccctgcccgaggagttcgccaacgagggcaacatcatcgccttctgggtggacaagaagggcagagtgttccacagaatcaactag

SEQ ID NO: 90678 - DNA, 2553 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccaacggcttcttcggccagagatgcctggagaagctgcccctgagactgtacatgcccgaccccaagcagaaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90679 - DNA, 1281 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccaacggcttcttcggccagagatgcctggagaagctgcccctgagactgtacatgcccgaccccaagcagagcgtgctgtgggacacccccggcaccggcgtgagcagcagccagtggagcaccagccccaagcccagaagctgcaccagaagaggcagctag

SEQ ID NO: 90680 - DNA, 2577 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccaacggcttcttcggccagagatgcctggagaagctgcccctgagactgtacatgcccgaccccaagcagagcttcctgagcttcgagctgagcaaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90681 - DNA, 2355 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90682 - DNA, 993 bp, Artificial Sequence
  Description of Artificial Sequence: Synthetic coding sequence
atgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccaacggcttcttcggccagagatgcctggagaagctgcccctgagactgtacatgcccgaccccaagcagagcgtgctgtgggacacccccggcaccggcgtgagcagcagccagtggagcaccagccccagcaccctggacctgaactag

SEQ ID NO: 90683 - DNA, 2559 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccgtgggctacaccggcgacagatgccagcagttcgccatggtgaacttcagcaccagactgggcggcgacgtggaggaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90684 - DNA, 2535 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccgtgggctacaccggcgacagatgccagcagttcgccatggtgaacttcagcaaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90685 - DNA, 2577 bp, Artificial Sequence
  Description of Artificial Sequence: Synthetic coding sequence
atgagacaggtgtgctgcagcgccctgccccccccccccctggagaagggcagatgcagcagctacagcgacagcagcagcagcagcagcgagagaagcagcagcagcagcagcagcagcagcgagagcggcagcagcagcagaagcagcagcaacaacagcagcatcagcagacccgccgccccccccgagcccagaccccagcagcagccccagcccagaagccccgccgccagaagagccgccgccagaagcagagccgccgccgccggcggcatgagaagagaccccgcccccggcttcagcatgctgctgttcggcgtgagcctggcctgctacagccccagcctgaagagcgtgcaggaccaggcctacaaggcccccgtggtggtggagggcaaggtgcagggcctggtgcccgccggcggcagcagcagcaacagcaccagagagccccccgccagcggcagagtggccctggtgaaggtgctggacaagtggcccctgagaagcggcggcctgcagagagagcaggtgatcagcgtgggcagctgcgtgcccctggagagaaaccagagatacatcttcttcctggagcccaccgagcagcccctggtgttcaagaccgccttcgcccccctggacaccaacggcaagaacctgaagaaggaggtgggcaagatcctgtgcaccgactgcgccaccagacccaagctgaagaagatgaagagccagaccggccaggtgggcgagaagcagagcctgaagtgcgaggccgccgccggcaacccccagcccagctacagatggttcaaggacggcaaggagctgaacagaagcagagacatcagaatcaagtacggcaacggcagaaagaacagcagactgcagttcaacaaggtgaaggtggaggacgccggcgagtacgtgtgcgaggccgagaacatcctgggcaaggacaccgtgagaggcagactgtacgtgaacagcgtgagcaccaccctgagcagctggagcggccacgccagaaagtgcaacgagaccgccaagagctactgcgtgaacggcggcgtgtgctactacatcgagggcatcaaccagctgagctgcaagtgccccaacggcttcttcggccagagatgcctggagaagctgcccctgagactgtacatgcccgaccccaagcagaagcacctgggcttcgagctgaaggaggccgaggagctgtaccagaagagagtgctgaccatcaccggcatctgcgtggccctgctggtggtgggcatcgtgtgcgtggtggcctactgcaagaccaagaagcagagaaagcagatgcacaaccacctgagacagaacatgtgccccgcccaccagaacagaagcctggccaacggccccagccaccccagactggaccccgaggagatccagatggccgactacatcagcaagaacgtgcccgccaccgaccacgtgatcagaagagagaccgagaccaccttcagcggcagccacagctgcagccccagccaccactgcagcaccgccacccccaccagcagccacagacacgagagccacacctggagcctggagagaagcgagagcctgaccagcgacagccagagcggcatcatgctgagcagcgtgggcaccagcaagtgcaacagccccgcctgcgtggaggccagagccagaagagccgccgcctacaacctggaggagagaagaagagccaccgcccccccctaccacgacagcgtggacagcctgagagacagcccccacagcgagagatacgtgagcgccctgaccacccccgccagactgagccccgtggacttccactacagcctggccacccaggtgcccaccttcgagatcaccagccccaacagcgcccacgccgtgagcctgccccccgccgcccccatcagctacagactggccgagcagcagcccctgctgagacaccccgccccccccggccccggccccggccccggccccggccccggccccggcgccgacatgcagagaagctacgacagctactactaccccgccgccggccccggccccagaagaggcacctgcgccctgggcggcagcctgggcagcctgcccgccagccccttcagaatccccgaggacgacgagtacgagaccacccaggagtgcgcccccccccccccccccagacccagagccagaggcgccagcagaagaaccagcgccggccccagaagatggagaagaagcagactgaacggcctggccgcccagagagccagagccgccagagacagcctgagcctgagcagcggcagcggcggcggcagcgccagcgccagcgacgacgacgccgacgacgccgacggcgccctggccgccgagagcacccccttcctgggcctgagaggcgcccacgacgccctgagaagcgacagcccccccctgtgccccgccgccgacagcagaacctactacagcctggacagccacagcaccagagccagcagcagacacagcagaggccccccccccagagccaagcaggacagcgcccccctgtag

SEQ ID NO: 90686 - DNA, 2091 bp, Artificial Sequence
  Description of Artificial Sequence: Synthetic coding sequence
atgagcgagggcgccgccgccgccagcccccccggcgccgccagcgccgccgccgccagcgccgaggagggcaccgccgccgccgccgccgccgccgccgccggcggcggccccgacggcggcggcgagggcgccgccgagccccccagagagctgagatgcagcgactgcatcgtgtggaacagacagcagacctggctgtgcgtggtgcccctgttcatcggcttcatcggcctgggcctgagcctgatgctgctgaagtggatcgtggtgggcagcgtgaaggagtacgtgcccaccgacctggtggacagcaagggcatgggccaggaccccttcttcctgagcaagcccagcagcttccccaaggccatggagaccaccaccaccaccaccagcaccaccagccccgccacccccagcgccggcggcgccgccagcagcagaacccccaacagaatcagcaccagactgaccaccatcaccagagcccccaccagattccccggccacagagtgcccatcagagccagccccagaagcaccaccgccagaaacaccgccgcccccgccaccgtgcccagcaccaccgcccccttcttcagcagcagcaccctgggcagcagaccccccgtgcccggcacccccagcacccaggccatgcccagctggcccaccgccgcctacgccaccagcagctacctgcacgacagcacccccagctggaccctgagccccttccaggacgccgccagcagcagcagcagcagcagcagcagcgccaccaccaccacccccgagaccagcaccagccccaagttccacaccaccacctacagcaccgagagaagcgagcacttcaagccctgcagagacaaggacctggcctactgcctgaacgacggcgagtgcttcgtgatcgagaccctgaccggcagccacaagcactgcagatgcaaggagggctaccagggcgtgagatgcgaccagttcctgcccaagaccgacagcatcctgagcgaccccaccgaccacctgggcatcgagttcatggagagcgaggaggtgtaccagagacaggtgctgagcatcagctgcatcatcttcggcatcgtgatcgtgggcatgttctgcgccgccttctacttcaagagcaagaagcaggccaagcagatccaggagcagctgaaggtgccccagaacggcaagagctacagcctgaaggccagcagcaccatggccaagagcgagaacctggtgaagagccacgtgcagctgcagaactacagcaaggtggagagacaccccgtgaccgccctggagaagatgatggagagcagcttcgtgggcccccagagcttccccgaggtgcccagccccgacagaggcagccagagcgtgaagcaccacagaagcctgagcagctgctgcagccccggccagagaagcggcatgctgcacagaaacgccttcagaagaaccccccccagccccagaagcagactgggcggcatcgtgggccccgcctaccagcagctggaggagagcagaatccccgaccaggacaccatcccctgccagggctacagcagcagcggcctgaagacccagagaaacaccagcatcaacatgcagctgcccagcagagagaccaacccctacttcaacagcctggagcagaaggacctggtgggctacagcagcaccagagccagcagcgtgcccatcatccccagcgtgggcctggaggagacctgcctgcagatgcccggcatcagcgaggtgaagagcatcaagtggtgcaagaacagctacagcgccgacgtggtgaacgtgagcatccccgtgagcgactgcctgatcgccgagcagcaggaggtgaagatcctgctggagaccgtgcaggagcagatcagaatcctgaccgacgccagaagaagcgaggactacgagctggccagcgtggagaccgaggacagcgccagcgagaacaccgccttcctgcccctgagccccaccgccaagagcgagagagaggcccagttcgtgctgagaaacgagatccagagagacagcgccctgaccaagtag

SEQ ID NO: 90687 - DNA, 1500 bp, Artificial Sequence
  Description of Artificial Sequence: Synthetic coding sequence
atggagtgcggcatcccccccaccctggtgtgcgtgggcagaggcggcggcctgcacaccatcaacatcatcatctggtactacttccccagcgcctggagaacctgcttcaacatcagcagcagcgtgggcctgctgctgaccaacagctacaagttctacaccaccacctacagcaccgagagaagcgagcacttcaagccctgcagagacaaggacctggcctactgcctgaacgacggcgagtgcttcgtgatcgagaccctgaccggcagccacaagcactgcagatgcaaggagggctaccagggcgtgagatgcgaccagttcctgcccaagaccgacagcatcctgagcgaccccaccgaccacctgggcatcgagttcatggagagcgaggaggtgtaccagagacaggtgctgagcatcagctgcatcatcttcggcatcgtgatcgtgggcatgttctgcgccgccttctacttcaagagcaagaagcaggccaagcagatccaggagcagctgaaggtgccccagaacggcaagagctacagcctgaaggccagcagcaccatggccaagagcgagaacctggtgaagagccacgtgcagctgcagaactacagcaaggtggagagacaccccgtgaccgccctggagaagatgatggagagcagcttcgtgggcccccagagcttccccgaggtgcccagccccgacagaggcagccagagcgtgaagcaccacagaagcctgagcagctgctgcagccccggccagagaagcggcatgctgcacagaaacgccttcagaagaaccccccccagccccagaagcagactgggcggcatcgtgggccccgcctaccagcagctggaggagagcagaatccccgaccaggacaccatcccctgccagggcatcgaggtgagaaagaccatcagccacctgcccatccagctgtggtgcgtggagagacccctggacctgaagtacagcagcagcggcctgaagacccagagaaacaccagcatcaacatgcagctgcccagcagagagaccaacccctacttcaacagcctggagcagaaggacctggtgggctacagcagcaccagagccagcagcgtgcccatcatccccagcgtgggcctggaggagacctgcctgcagatgcccggcatcagcgaggtgaagagcatcaagtggtgcaagaacagctacagcgccgacgtggtgaacgtgagcatccccgtgagcgactgcctgatcgccgagcagcaggaggtgaagatcctgctggagaccgtgcaggagcagatcagaatcctgaccgacgccagaagaagcgaggactacgagctggccagcgtggagaccgaggacagcgccagcgagaacaccgccttcctgcccctgagccccaccgccaagagcgagagagaggcccagttcgtgctgagaaacgagatccagagagacagcgccctgaccaagtag

SEQ ID NO: 90688 - DNA, 2163 bp, Artificial Sequence
  Description of Artificial Sequence: Synthetic coding sequence
atgagcgagggcgccgccgccgccagcccccccggcgccgccagcgccgccgccgccagcgccgaggagggcaccgccgccgccgccgccgccgccgccgccggcggcggccccgacggcggcggcgagggcgccgccgagccccccagagagctgagatgcagcgactgcatcgtgtggaacagacagcagacctggctgtgcgtggtgcccctgttcatcggcttcatcggcctgggcctgagcctgatgctgctgaagtggatcgtggtgggcagcgtgaaggagtacgtgcccaccgacctggtggacagcaagggcatgggccaggaccccttcttcctgagcaagcccagcagcttccccaaggccatggagaccaccaccaccaccaccagcaccaccagccccgccacccccagcgccggcggcgccgccagcagcagaacccccaacagaatcagcaccagactgaccaccatcaccagagcccccaccagattccccggccacagagtgcccatcagagccagccccagaagcaccaccgccagaaacaccgccgcccccgccaccgtgcccagcaccaccgcccccttcttcagcagcagcaccctgggcagcagaccccccgtgcccggcacccccagcacccaggccatgcccagctggcccaccgccgcctacgccaccagcagctacctgcacgacagcacccccagctggaccctgagccccttccaggacgccgccagcagcagcagcagcagcagcagcagcgccaccaccaccacccccgagaccagcaccagccccaagttccacaccaccacctacagcaccgagagaagcgagcacttcaagccctgcagagacaaggacctggcctactgcctgaacgacggcgagtgcttcgtgatcgagaccctgaccggcagccacaagcactgcagatgcaaggagggctaccagggcgtgagatgcgaccagttcctgcccaagaccgacagcatcctgagcgaccccaccgaccacctgggcatcgagttcatggagagcgaggaggtgtaccagagacaggtgctgagcatcagctgcatcatcttcggcatcgtgatcgtgggcatgttctgcgccgccttctacttcaagagcaagaagcaggccaagcagatccaggagcagctgaaggtgccccagaacggcaagagctacagcctgaaggccagcagcaccatggccaagagcgagaacctggtgaagagccacgtgcagctgcagaactacagcaaggtggagagacaccccgtgaccgccctggagaagatgatggagagcagcttcgtgggcccccagagcttccccgaggtgcccagccccgacagaggcagccagagcgtgaagcaccacagaagcctgagcagctgctgcagccccggccagagaagcggcatgctgcacagaaacgccttcagaagaaccccccccagccccagaagcagactgggcggcatcgtgggccccgcctaccagcagctggaggagagcagaatccccgaccaggacaccatcccctgccagggcatcgaggtgagaaagaccatcagccacctgcccatccagctgtggtgcgtggagagacccctggacctgaagtacagcagcagcggcctgaagacccagagaaacaccagcatcaacatgcagctgcccagcagagagaccaacccctacttcaacagcctggagcagaaggacctggtgggctacagcagcaccagagccagcagcgtgcccatcatccccagcgtgggcctggaggagacctgcctgcagatgcccggcatcagcgaggtgaagagcatcaagtggtgcaagaacagctacagcgccgacgtggtgaacgtgagcatccccgtgagcgactgcctgatcgccgagcagcaggaggtgaagatcctgctggagaccgtgcaggagcagatcagaatcctgaccgacgccagaagaagcgaggactacgagctggccagcgtggagaccgaggacagcgccagcgagaacaccgccttcctgcccctgagccccaccgccaagagcgagagagaggcccagttcgtgctgagaaacgagatccagagagacagcgccctgaccaagtag

SEQ ID NO: 90689 - DNA, 2088 bp, Artificial Sequence
  Description of Artificial Sequence: Synthetic coding sequence
atgagcgagggcgccgccgccgccagcccccccggcgccgccagcgccgccgccgccagcgccgaggagggcaccgccgccgccgccgccgccgccgccgccggcggcggccccgacggcggcggcgagggcgccgccgagccccccagagagctgagatgcagcgactgcatcgtgtggaacagacagcagacctggctgtgcgtggtgcccctgttcatcggcttcatcggcctgggcctgagcctgatgctgctgaagtggatcgtggtgggcagcgtgaaggagtacgtgcccaccgacctggtggacagcaagggcatgggccaggaccccttcttcctgagcaagcccagcagcttccccaaggccatggagaccaccaccaccaccaccagcaccaccagccccgccacccccagcgccggcggcgccgccagcagcagaacccccaacagaatcagcaccagactgaccaccatcaccagagcccccaccagattccccggccacagagtgcccatcagagccagccccagaagcaccaccgccagaaacaccgccgcccccgccaccgtgcccagcaccaccgcccccttcttcagcagcagcaccctgggcagcagaccccccgtgcccggcacccccagcacccaggccatgcccagctggcccaccgccgcctacgccaccagcagctacctgcacgacagcacccccagctggaccctgagccccttccaggacgccgccagcagcagcagcagcagcagcagcagcgccaccaccaccacccccgagaccagcaccagccccaagttccacaccaccacctacagcaccgagagaagcgagcacttcaagccctgcagagacaaggacctggcctactgcctgaacgacggcgagtgcttcgtgatcgagaccctgaccggcagccacaagcactgcagatgcaaggagggctaccagggcgtgagatgcgaccagttcctgcccaagaccgacagcatcctgagcgaccccacccacatcggcatcatcttcaccgagagcgaggaggtgtaccagagacaggtgctgagcatcagctgcatcatcttcggcatcgtgatcgtgggcatgttctgcgccgccttctacttcaagagcaagaagcaggccaagcagatccaggagcagctgaaggtgccccagaacggcaagagctacagcctgaaggccagcagcaccatggccaagagcgagaacctggtgaagagccacgtgcagctgcagaactacagcaaggtggagagacaccccgtgaccgccctggagaagatgatggagagcagcttcgtgggcccccagagcttccccgaggtgcccagccccgacagaggcagccagagcgtgaagcaccacagaagcctgagcagctgctgcagccccggccagagaagcggcatgctgcacagaaacgccttcagaagaaccccccccagccccagaagcagactgggcggcatcgtgggccccgcctaccagcagctggaggagagcagaatccccgaccaggacaccatcccctgccagggctacagcagcagcggcctgaagacccagagaaacaccagcatcaacatgcagctgcccagcagagagaccaacccctacttcaacagcctggagcagaaggacctggtgggctacagcagcaccagagccagcagcgtgcccatcatccccagcgtgggcctggaggagacctgcctgcagatgcccggcatcagcgaggtgaagagcatcaagtggtgcaagaacagctacagcgccgacgtggtgaacgtgagcatccccgtgagcgactgcctgatcgccgagcagcaggaggtgaagatcctgctggagaccgtgcaggagcagatcagaatcctgaccgacgccagaagaagcgaggactacgagctggccagcgtggagaccgaggacagcgccagcgagaacaccgccttcctgcccctgagccccaccgccaagagcgagagagaggcccagttcgtgctgagaaacgagatccagagagacagcgccctgaccaagtag

SEQ ID NO: 90690 - DNA, 1041 bp, Artificial Sequence
  Description of Artificial Sequence: Synthetic coding sequence
atggagagcgaggaggtgtaccagagacaggtgctgagcatcagctgcatcatcttcggcatcgtgatcgtgggcatgttctgcgccgccttctacttcaagagcaagaagcaggccaagcagatccaggagcagctgaaggtgccccagaacggcaagagctacagcctgaaggccagcagcaccatggccaagagcgagaacctggtgaagagccacgtgcagctgcagaactacagcaaggtggagagacaccccgtgaccgccctggagaagatgatggagagcagcttcgtgggcccccagagcttccccgaggtgcccagccccgacagaggcagccagagcgtgaagcaccacagaagcctgagcagctgctgcagccccggccagagaagcggcatgctgcacagaaacgccttcagaagaaccccccccagccccagaagcagactgggcggcatcgtgggccccgcctaccagcagctggaggagagcagaatccccgaccaggacaccatcccctgccagggctacagcagcagcggcctgaagacccagagaaacaccagcatcaacatgcagctgcccagcagagagaccaacccctacttcaacagcctggagcagaaggacctggtgggctacagcagcaccagagccagcagcgtgcccatcatccccagcgtgggcctggaggagacctgcctgcagatgcccggcatcagcgaggtgaagagcatcaagtggtgcaagaacagctacagcgccgacgtggtgaacgtgagcatccccgtgagcgactgcctgatcgccgagcagcaggaggtgaagatcctgctggagaccgtgcaggagcagatcagaatcctgaccgacgccagaagaagcgaggactacgagctggccagcgtggagaccgaggacagcgccagcgagaacaccgccttcctgcccctgagccccaccgccaagagcgagagagaggcccagttcgtgctgagaaacgagatccagagagacagcgccctgaccaagtag

SEQ ID NO: 90691 - DNA, 1041 bp, Artificial Sequence; identical to SEQ ID NO: 90690
  Description of Artificial Sequence: Synthetic coding sequence

SEQ ID NO: 90692 - DNA, 171 bp, Artificial Sequence
  Description of Artificial Sequence: Synthetic coding sequence
atgcccaccgaccacgaggagccctgcggccccagccacaagagcttctgcctgaacggcggcctgtgctacgtgatccccaccatccccagccccttctgcagcctgcacgagaacgagaacgacaacaacgaggacctgtacgacgacctgctgcccctgaacgagtag

SEQ ID NO: 90693 - DNA, 348 bp, Artificial Sequence
  Description of Artificial Sequence: Synthetic coding sequence
atgcccaccgaccacgaggagccctgcggccccagccacaagagcttctgcctgaacggcggcctgtgctacgtgatccccaccatccccagccccttctgcagatgcgtggagaactacaccggcgccagatgcgaggaggtgttcctgcccggcagcagcatccagaccaagagcaacctgttcgaggccttcgtggccctggccgtgctggtgaccctgatcatcggcgccttctacttcctgtgcagaaagggccacttccagagagccagcagcgtgcagtacgacatcaacctggtggagaccagcagcaccagcgcccaccacagccacgagcagcactag

SEQ ID NO: 90694 - DNA, 273 bp, Artificial Sequence
  Description of Artificial Sequence: Synthetic coding sequence
atgcccaccgaccacgaggagccctgcggccccagccacaagagcttctgcctgaacggcggcctgtgctacgtgatccccaccatccccagccccttctgcagatgcgtggagaactacaccggcgccagatgcgaggaggtgttcctgcccggcagcagcatccagaccaagagcaacctgttcgaggccttcgtggccctggccgtgctggtgaccctgatcatcggcgccttctacttcctgtgcagatgcggcaacacctgcatgtag

SEQ ID NO: 90695 - DNA, 615 bp, Artificial Sequence
  Description of Artificial Sequence: Synthetic coding sequence
atgatgcccagctgcaacagaagctgcagctgcagcagaggccccagcgtggaggacggcaagtggtacggcgtgagaagctacctgcacctgttctacgaggactgcgccggcaccgccctgagcgacgaccccgagggcccccccgtgctgtgccccagaagaccctggcccagcctgtgctggaagatcagcctgagcagcggcaccctgctgctgctgctgggcgtggccgccctgaccaccggctacgccgtgccccccaagctggagggcatcggcgagggcgagttcctggtgctggaccagagagccgccgactacaaccaggccctgggcacctgcagactggccggcaccgccctgtgcgtggccgccggcgtgctgctggccatctgcctgttctgggccatgatcggctggctgagccaggacaccaaggccgagcccctggaccccgaggccgacagccacgtggaggtgttcggcgacgagcccgagcagcagctgagccccatcttcagaaacgccagcggccagagctggttcagcccccccgccagccccttcggccagagcagcgtgcagaccatccagcccaagagagacagctag

SEQ ID NO: 90696 - DNA, 615 bp, Artificial Sequence; identical to SEQ ID NO: 90695
  Description of Artificial Sequence: Synthetic coding sequence

SEQ ID NO: 90697 - DNA, 1329 bp, Artificial Sequence
  Description of Artificial Sequence: Synthetic coding sequence
atgtaccagagaatgctgagatgcggcgccgagctgggcagccccggcggcggcggcggcggcggcggcggcggcggcgccggcggcagactggccctgctgtggatcgtgcccctgaccctgagcggcctgctgggcgtggcctggggcgccagcagcctgggcgcccaccacatccaccacttccacggcagcagcaagcaccacagcgtgcccatcgccatctacagaagccccgccagcctgagaggcggccacgccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90698 - DNA, 4524 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggaggacaacaacgtggagggcctggcccacctgatgatgggcgaccagggcaagagcaagggcaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacagcacagcggcatcggccacgccatggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcaacaacgacaacgagagactggccatcgccagacagagaatcccctacagactgggcagagtggtggacgagtggctgctggacaagggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90699 - DNA, 1488 bp, Artificial Sequence
  Description of Artificial Sequence: Synthetic coding sequence
atgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgaggtggccctgatgaaggccgacctgcagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90700 - DNA, 4500 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggccgacaccaacctggagggcctggcccacctgatgatgggcgaccaggccaagagcaagagaaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacaggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcaacaacgacaacgagagactggccatcgccagacagagaatcccctacagactgggcagagtggtggacgagtggctgctggacaagggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90701 - DNA, 4644 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggagatcaagttcggcctgcagtgcgtgctgcccgtgctgctgcacgacaacgaccagggcaagtactgctgcatcaacaccgccaagcccctgaccgagaaggacaacaacgtggagggcctggcccacctgatgatgggcgaccagggcaagagcaagggcaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacagcacagcggcatcggccacgccatggtgaacaagctgcactgcagcgtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcaacaacgacaacgagagactggccatcgccagacagagaatcccctacagactgggcagagtggtggacgagtggctgctggacaagggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90702 - DNA, 4434 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggaggacaacaacgtggagggcctggcccacctgatgatgggcgaccagggcaagagcaagggcaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacagcacagcggcatcggccacgccatggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90703 - DNA, 4434 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggccgacaccaacctggagggcctggcccacctgatgatgggcgaccaggccaagagcaagagaaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacagcacagcggcatcggccacgccatggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90704 - DNA, 4647 bp, Artificial Sequence
  Description of Artificial Sequence: Synthetic coding sequence
atgggcaccgccctgctgcagagaggcggctgcttcctgctgtgcctgagcctgctgctgctgggctgctgggccgagctgggcagcggcctggagttccccggcgccgagggccagtggaccagattccccaagtggaacgcctgctgcgagagcgagatgagcttccagctgaagaccagaagcgccagaggcctggtgctgtacttcgacgacgagggcttctgcgacttcctggagctgatcctgaccagaggcggcagactgcagctgagcttcagcatcttctgcgccgagcccgccaccctgctggccgacacccccgtgaacgacggcgcctggcacagcgtgagaatcagaagacagttcagaaacaccaccctgttcatcgaccaggtggaggccaagtgggtggaggtgaagagcaagagaagagacatgaccgtgttcagcggcctgttcgtgggcggcctgccccccgagctgagagccgccgccctgaagctgaccctggccagcgtgagagagagagagcccttcaagggctggatcagagacgtgagagtgaacagcagccaggtgctgcccgtggacagcggcgaggtgaagctggacgacgagccccccaacagcggcggcggcagcccctgcgaggccggcgaggagggcgagggcggcgtgtgcctgaacggcggcgtgtgcagcgtggtggacgaccaggccgtgtgcgactgcagcagaaccggcttcagaggcaaggactgcagccaggagatcaagttcggcctgcagtgcgtgctgcccgtgctgctgcacgacaacgaccagggcaagtactgctgcatcaacaccgccaagcccctgaccgagaagaaggacaacgacttcgagggcctggcccacctgatgatgggcgaccaggccaagagcaagagaaaggaggagtacatcgccaccttcaagggcagcgagtacttctgctacgacctgagccagaaccccatccagagcagcagcgacgagatcaccctgagcttcaagaccctgcagagaaacggcctgatgctgcacaccggcaagagcgccgactacgtgaacctggccctgaagaacggcgccgtgagcctggtgatcaacctgggcagcggcgccttcgaggccctggtggagcccgtgaacggcaagttcaacgacaacgcctggcacgacgtgaaggtgaccagaaacctgagacagcacagcggcatcggccacgccatggtgaacaagctgcactgcagcgtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacgtgagactggagctgagcagactggccaagcagggcgaccccaagatgaagatccacggcgtggtggccttcaagtgcgagaacgtggccaccctggaccccatcaccttcgagacccccgagagcttcatcagcctgcccaagtggaacgccaagaagaccggcagcatcagcttcgacttcagaaccaccgagcccaacggcctgatcctgttcagccacggcaagcccagacaccagaaggacgccaagcacccccagatgatcaaggtggacttcttcgccatcgagatgctggacggccacctgtacctgctgctggacatgggcagcggcaccatcaagatcaaggccctgctgaagaaggtgaacgacggcgagtggtaccacgtggacttccagagagacggcagaagcggcaccatcagcgtgaacaccctgagaaccccctacaccgcccccggcgagagcgagatcctggacctggacgacgagctgtacctgggcggcctgcccgagaacaaggccggcctggtgttccccaccgaggtgtggaccgccctgctgaactacggctacgtgggctgcatcagagacctgttcatcgacggccagagcaaggacatcagacagatggccgaggtgcagagcaccgccggcgtgaagcccagctgcagcaaggagaccgccaagccctgcctgagcaacccctgcaagaacaacggcatgtgcagagacggctggaacagatacgtgtgcgactgcagcggcaccggctacctgggcagaagctgcgagagagaggccaccgtgctgagctacgacggcagcatgttcatgaagatccagctgcccgtggtgatgcacaccgaggccgaggacgtgagcctgagattcagaagccagagagcctacggcatcctgatggccaccaccagcagagacagcgccgacaccctgagactggagctggacgccggcagagtgaagctgaccgtgaacctggactgcatcagaatcaactgcaacagcagcaagggccccgagaccctgttcgccggctacaacctgaacgacaacgagtggcacaccgtgagagtggtgagaagaggcaagagcctgaagctgaccgtggacgaccagcaggccatgaccggccagatggccggcgaccacaccagactggagttccacaacatcgagaccggcatcatcaccgagagaagatacctgagcagcgtgcccagcaacttcatcggccacctgcagagcctgaccttcaacggcatggcctacatcgacctgtgcaagaacggcgacatcgactactgcgagctgaacgccagattcggcttcagaaacatcatcgccgaccccgtgaccttcaagaccaagagcagctacgtggccctggccaccctgcaggcctacaccagcatgcacctgttcttccagttcaagaccaccagcctggacggcctgatcctgtacaacagcggcgacggcaacgacttcatcgtggtggagctggtgaagggctacctgcactacgtgttcgacctgggcaacggcgccaacctgatcaagggcagcagcaacaagcccctgaacgacaaccagtggcacaacgtgatgatcagcagagacaccagcaacctgcacaccgtgaagatcgacaccaagatcaccacccagatcaccgccggcgccagaaacctggacctgaagagcgacctgtacatcggcggcgtggccaaggagacctacaagagcctgcccaagctggtgcacgccaaggagggcttccagggctgcctggccagcgtggacctgaacggcagactgcccgacctgatcagcgacgccctgttctgcaacggccagatcgagagaggctgcgagggccccagcaccacctgccaggaggacagctgcagcaaccagggcgtgtgcctgcagcagtgggacggcttcagctgcgactgcagcatgaccagcttcagcggccccctgtgcaacgaccccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcaacaacgacaacgagagactggccatcgccagacagagaatcccctacagactgggcagagtggtggacgagtggctgctggacaagggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90705 - DNA, 1191 bp, Artificial Sequence
  Description of Artificial Sequence: Synthetic coding sequence
gccctggagatctgggagcagccccccgcccccagactgctgttccccggcctgcccttcagaaccagccccagccccgccgccttctacagaagccccgccagcctgagaggcggccacgccggcaccacctacatcttcagcaagggcggcggccagatcacctacaagtggccccccaacgacagacccagcaccagagccgacagactggccatcggcttcagcaccgtgcagaaggaggccgtgctggtgagagtggacagcagcagcggcctgggcgactacctggagctgcacatccaccagggcaagatcggcgtgaagttcaacgtgggcaccgacgacatcgccatcgaggagagcaacgccatcatcaacgacggcaagtaccacgtggtgagattcaccagaagcggcggcaacgccaccctgcaggtggacagctggcccgtgatcgagagataccccgccggcagacagctgaccatcttcaacagccaggccaccatcatcatcggcggcaaggagcagggccagcccttccagggccagctgagcggcctgtactacaacggcctgaaggtgctgaacatggccgccgagaacgacgccaacatcgccatcgtgggcaacgtgagactggtgggcgaggtgcccagcagcatgaccaccgagagcaccgccaccgccatgcagagcgagatgagcaccagcatcatggagaccaccaccaccctggccaccagcaccgccagaagaggcaagccccccaccaaggagcccatcagccagaccaccgacgacatcctggtggccagcgccgagtgccccagcgacgacgaggacatcgacccctgcgagcccagcagcggcggcctggccaaccccaccagagccggcggcagagagccctaccccggcagcgccgaggtgatcagagagagcagcagcaccaccggcatggtggtgggcatcgtggccgccgccgccctgtgcatcctgatcctgctgtacgccatgtacaagtacagaaacagagacgagggcagctaccacgtggacgagagcagaaactacatcagcaacagcgcccagagcaacggcgccgtggtgaaggagaagcagcccagcagcgccaagagcagcaacaagaacaagaagaacaaggacaaggagtactacgtgtag

SEQ ID NO: 90706 - DNA, 5139 bp, Artificial Sequence
  Description of Artificial Sequence: Synthetic coding sequence
atggccagcggcagcagatggagacccacccccccccccctgctgctgctgctgctgctggccctggccgccagagccgacggcctggagttcggcggcggccccggccagtgggccagatacgccagatgggccggcgccgccagcagcggcgagctgagcttcagcctgagaaccaacgccaccagagccctgctgctgtacctggacgacggcggcgactgcgacttcctggagctgctgctggtggacggcagactgagactgagattcaccctgagctgcgccgagcccgccaccctgcagctggacacccccgtggccgacgacagatggcacatggtgctgctgaccagagacgccagaagaaccgccctggccgtggacggcgaggccagagccgccgaggtgagaagcaagagaagagagatgcaggtggccagcgacctgttcgtgggcggcatcccccccgacgtgagactgagcgccctgaccctgagcaccgtgaagtacgagccccccttcagaggcctgctggccaacctgaagctgggcgagagaccccccgccctgctgggcagccagggcctgagaggcgccaccgccgaccccctgtgcgcccccgccagaaacccctgcgccaacggcggcctgtgcaccgtgctggcccccggcgaggtgggctgcgactgcagccacaccggcttcggcggcaagttctgcagcgaggaggagcaccccatggagggccccgcccacctgaccctgaacagcgaggtgggcagcctgctgttcagcgagggcggcgccggcagaggcggcgccggcgacgtgcaccagcccaccaagggcaaggaggagttcgtggccaccttcaagggcaacgagttcttctgctacgacctgagccacaaccccatccagagcagcaccgacgagatcaccctggccttcagaaccctgcagagaaacggcctgatgctgcacaccggcaagagcgccgactacgtgaacctgagcctgaagagcggcgccgtgtggctggtgatcaacctgggcagcggcgccttcgaggccctggtggagcccgtgaacggcaagttcaacgacaacgcctggcacgacgtgagagtgaccagaaacctgagacagcacgccggcatcggccacgccatggtgaacaagctgcactacctggtgaccatcagcgtggacggcatcctgaccaccaccggctacacccaggaggactacaccatgctgggcagcgacgacttcttctacatcggcggcagccccaacaccgccgacctgcccggcagccccgtgagcaacaacttcatgggctgcctgaaggacgtggtgtacaagaacaacgacttcaagctggagctgagcagactggccaaggagggcgaccccaagatgaagctgcagggcgacctgagcttcagatgcgaggacgtggccgccctggaccccgtgaccttcgagagccccgaggccttcgtggccctgcccagatggagcgccaagagaaccggcagcatcagcctggacttcagaaccaccgagcccaacggcctgctgctgttcagccagggcagaagagccggcggcggcgccggcagccacagcagcgcccagagagccgactacttcgccatggagctgctggacggccacctgtacctgctgctggacatgggcagcggcggcatcaagctgagagccagcagcagaaaggtgaacgacggcgagtggtgccacgtggacttccagagagacggcagaaagggcagcatcagcgtgaacagcagaagcacccccttcctggccaccggcgacagcgagatcctggacctggagagcgagctgtacctgggcggcctgcccgagggcggcagagtggacctgcccctgccccccgaggtgtggaccgccgccctgagagccggctacgtgggctgcgtgagagacctgttcatcgacggcagaagcagagacctgagaggcctggccgaggcccagggcgccgtgggcgtggcccccttctgcagcagagagaccctgaagcagtgcgccagcgccccctgcagaaacggcggcgtgtgcagagagggctggaacagattcatctgcgactgcatcggcaccggcttcctgggcagagtgtgcgagagagaggccaccgtgctgagctacgacggcagcatgtacatgaagatcatgctgcccaacgccatgcacaccgaggccgaggacgtgagcctgagattcatgagccagagagcctacggcctgatgatggccaccaccagcagagagagcgccgacaccctgagactggagctggacggcggccagatgaagctgaccgtgaacctggactgcctgagagtgggctgcgcccccagcaagggccccgagaccctgttcgccggccacaagctgaacgacaacgagtggcacaccgtgagagtggtgagaagaggcaagagcctgcagctgagcgtggacaacgtgaccgtggagggccagatggccggcgcccacatgagactggagttccacaacatcgagaccggcatcatgaccgagagaagattcatcagcgtggtgcccagcaacttcatcggccacctgagcggcctggtgttcaacggccagccctacatggaccagtgcaaggacggcgacatcacctactgcgagctgaacgccagattcggcctgagagccatcgtggccgaccccgtgaccttcaagagcagaagcagctacctggccctggccaccctgcaggcctacgccagcatgcacctgttcttccagttcaagaccaccgcccccgacggcctgctgctgttcaacagcggcaacggcaacgacttcatcgtgatcgagctggtgaagggctacatccactacgtgttcgacctgggcaacggccccagcctgatgaagggcaacagcgacaagcccgtgaacgacaaccagtggcacaacgtggtggtgagcagagaccccggcaacgtgcacaccctgaagatcgacagcagaaccgtgacccagcacagcaacggcgccagaaacctggacctgaagggcgagctgtacatcggcggcctgagcaagaacatgttcagcaacctgcccaagctggtggccagcagagacggcttccagggctgcctggccagcgtggacctgaacggcagactgcccgacctgatcgccgacgccctgcacagaatcggccaggtggagagaggctgcgacggccccagcaccacctgcaccgaggagagctgcgccaaccagggcgtgtgcctgcagcagtgggacggcttcacctgcgactgcaccatgaccagctacggcggccccgtgtgcaacgaccccggcaccacctacatcttcggcaagggcggcgccctgatcacctacacctggccccccaacgacagacccagcaccagaatggacagactggccgtgggcttcagcacccaccagagaagcgccgtgctggtgagagtggacagcgccagcggcctgggcgactacctgcagctgcacatcgaccagggcaccgtgggcgtgatcttcaacgtgggcaccgacgacatcaccatcgacgagcccaacgccatcgtgagcgacggcaagtaccacgtggtgagattcaccagaagcggcggcaacgccaccctgcaggtggacagctggcccgtgaacgagagataccccgccggcaacttcgacaacgagagactggccatcgccagacagagaatcccctacagactgggcagagtggtggacgagtggctgctggacaagggcagacagctgaccatcttcaacagccaggccgccatcaagatcggcggcagagaccagggcagacccttccagggccaggtgagcggcctgtactacaacggcctgaaggtgctggccctggccgccgagagcgaccccaacgtgagaaccgagggccacctgagactggtgggcgagggccccagcgtgctgctgagcgccgagaccaccgccaccaccctgctggccgacatggccaccaccatcatggagaccaccaccaccatggccaccaccaccaccagaagaggcagaagccccaccctgagagacagcaccacccagaacaccgacgacctgctggtggccagcgccgagtgccccagcgacgacgaggacctggaggagtgcgagcccagcaccggcggcgagctgatcctgcccatcatcaccgaggacagcctggaccccccccccgtggccaccagaagccccttcgtgccccccccccccaccttctaccccttcctgaccggcgtgggcgccacccaggacaccctgcccccccccgccgccagaagaccccccagcggcggcccctgccaggccgagagagacgacagcgactgcgaggagcccatcgaggccagcggcttcgccagcggcgaggtgttcgacagcagcctgccccccaccgacgacgaggacttctacaccaccttccccctggtgaccgacagaaccaccctgctgagccccagaaagcccgcccccagacccaacctgagaaccgacggcgccaccggcgcccccggcgtgctgttcgcccccagcgcccccgcccccaacctgcccgccggcaagatgaaccacagagaccccctgcagcccctgctggagaacccccccctgggccccggcgcccccaccagcttcgagcccagaagacccccccccctgagacccggcgtgaccagcgcccccggcttcccccacctgcccaccgccaaccccaccggccccggcgagagaggcccccccggcgccgtggaggtgatcagagagagcagcagcaccaccggcatggtggtgggcatcgtggccgccgccgccctgtgcatcctgatcctgctgtacgccatgtacaagtacagaaacagagacgagggcagctaccaggtggaccagagcagaaactacatcagcaacagcgcccagagcaacggcgccgtggtgaaggagaaggcccccgccgcccccaagacccccagcaaggccaagaagaacaaggacaaggagtactacgtgtag

SEQ ID NO: 90707 - DNA, 4929 bp, Artificial Sequence
  Description of Artificial Sequence: Synthetic coding sequence
atggccagcggcagcagatggagacccacccccccccccctgctgctgctgctgctgctggccctggccgccagagccgacggcctggagttcggcggcggccccggccagtgggccagatacgccagatgggccggcgccgccagcagcggcgagctgagcttcagcctgagaaccaacgccaccagagccctgctgctgtacctggacgacggcggcgactgcgacttcctggagctgctgctggtggacggcagactgagactgagattcaccctgagctgcgccgagcccgccaccctgcagctggacacccccgtggccgacgacagatggcacatggtgctgctgaccagagacgccagaagaaccgccctggccgtggacggcgaggccagagccgccgaggtgagaagcaagagaagagagatgcaggtggccagcgacctgttcgtgggcggcatcccccccgacgtgagactgagcgccctgaccctgagcaccgtgaagtacgagccccccttcagaggcctgctggccaacctgaagctgggcgagagaccccccgccctgctgggcagccagggcctgagaggcgccaccgccgaccccctgtgcgcccccgccagaaacccctgcgccaacggcggcctgtgcaccgtgctggcccccggcgaggtgggctgcgactgcagccacaccggcttcggcggcaagttctgcagcgaggcccccagccccttccagggccccgcccacctgaccctgaacagcgagggcaaggaggagttcgtggccaccttcaagggcaacgagttcttctgctacgacctgagccacaaccccatccagagcagcaccgacgagatcaccctggccttcagaaccctgcagagaaacggcctgatgctgcacaccggcaagagcgccgactacgtgaacctgagcctgaagagcggcgccgtgtggctggtgatcaacctgggcagcggcgccttcgaggccctggtggagcccgtgaacggcaagttcaacgacaacgcctggcacgacgtgagagtgaccagaaacctgagacagcacgccggcatcggccacgccatggtgaccatcagcgtggacggcatcctgaccaccaccggctacacccaggaggactacaccatgctgggcagcgacgacttcttctacatcggcggcagccccaacaccgccgacctgcccggcagccccgtgagcaacaacttcatgggctgcctgaaggacgtggtgtacaagaacaacgacttcaagctggagctgagcagactggccaaggagggcgaccccaagatgaagctgcagggcgacctgagcttcagatgcgaggacgtggccgccctggaccccgtgaccttcgagagccccgaggccttcgtggccctgcccagatggagcgccaagagaaccggcagcatcagcctggacttcagaaccaccgagcccaacggcctgctgctgttcagccagggcagaagagccggcggcggcgccggcagccacagcagcgcccagagagccgactacttcgccatggagctgctggacggccacctgtacctgctgctggacatgggcagcggcggcatcaagctgagagccagcagcagaaaggtgaacgacggcgagtggtgccacgtggacttccagagagacggcagaaagggcagcatcagcgtgaacagcagaagcacccccttcctggccaccggcgacagcgagatcctggacctggagagcgagctgtacctgggcggcctgcccgagggcggcagagtggacctgcccctgccccccgaggtgtggaccgccgccctgagagccggctacgtgggctgcgtgagagacctgttcatcgacggcagaagcagagacctgagaggcctggccgaggcccagggcgccgtgggcgtggcccccttctgcagcagagagaccctgaagcagtgcgccagcgccccctgcagaaacggcggcgtgtgcagagagggctggaacagattcatctgcgactgcatcggcaccggcttcctgggcagagtgtgcgagagagaggccaccgtgctgagctacgacggcagcatgtacatgaagatcatgctgcccaacgccatgcacaccgaggccgaggacgtgagcctgagattcatgagccagagagcctacggcctgatgatggccaccaccagcagagagagcgccgacaccctgagactggagctggacggcggccagatgaagctgaccgtgaacctgggcaagggccccgagaccctgttcgccggccacaagctgaacgacaacgagtggcacaccgtgagagtggtgagaagaggcaagagcctgcagctgagcgtggacaacgtgaccgtggagggccagatggccggcgcccacatgagactggagttccacaacatcgagaccggcatcatgaccgagagaagattcatcagcgtggtgcccagcaacttcatcggccacctgagcggcctggtgttcaacggccagccctacatggaccagtgcaaggacggcgacatcacctactgcgagctgaacgccagattcggcctgagagccatcgtggccgaccccgtgaccttcaagagcagaagcagctacctggccctggccaccctgcaggcctacgccagcatgcacctgttcttccagttcaagaccaccgcccccgacggcctgctgctgttcaacagcggcaacggcaacgacttcatcgtgatcgagctggtgaagggctacatccactacgtgttcgacctgggcaacggccccagcctgatgaagggcaacagcgacaagcccgtgaacgacaaccagtggcacaacgtggtggtgagcagagaccccggcaacgtgcacaccctgaagatcgacagcagaaccgtgacccagcacagcaacggcgccagaaacctggacctgaagggcgagctgtacatcggcggcctgagcaagaacatgttcagcaacctgcccaagctggtggccagcagagacggcttccagggctgcctggccagcgtggacctgaacggcagactgcccgacctgatcgccgacgccctgcacagaatcggccaggtggagagaggctgcgacggccccagcaccacctgcaccgaggagagctgcgccaaccagggcgtgtgcctgcagcagtgggacggcttcacctgcgactgcaccatgaccagctacggcggccccgtgtgcaacgaccccggcaccacctacatcttcggcaagggcggcgccctgatcacctacacctggccccccaacgacagacccagcaccagaatggacagactggccgtgggcttcagcacccaccagagaagcgccgtgctggtgagagtggacagcgccagcggcctgggcgactacctgcagctgcacatcgaccagggcaccgtgggcgtgatcttcaacgtgggcaccgacgacatcaccatcgacgagcccaacgccatcgtgagcgacggcaagtaccacgtggtgagattcaccagaagcggcggcaacgccaccctgcaggtggacagctggcccgtgaacgagagataccccgccggcagacagctgaccatcttcaacagccaggccgccatcaagatcggcggcagagaccagggcagacccttccagggccaggtgagcggcctgtactacaacggcctgaaggtgctggccctggccgccgagagcgaccccaacgtgagaaccgagggccacctgagactggtgggcgagggccccagcgtgctgctgagcgccgagaccaccgccaccaccctgctggccgacatggccaccaccatcatggagaccaccaccaccatggccaccaccaccaccagaagaggcagaagccccaccctgagagacagcaccacccagaacaccgacgacctgctggtggccagcgccgagtgccccagcgacgacgaggacctggaggagtgcgagcccagcaccggcggcgagctgatcctgcccatcatcaccgaggacagcctggaccccccccccgtggccaccagaagccccttcgtgccccccccccccaccttctaccccttcctgaccggcgtgggcgccacccaggacaccctgcccccccccgccgccagaagaccccccagcggcggcccctgccaggccgagagagacgacagcgactgcgaggagcccatcgaggccagcggcttcgccagcggcgaggtgttcgacagcagcctgccccccaccgacgacgaggacttctacaccaccttccccctggtgaccgacagaaccaccctgctgagccccagaaagcccgcccccagacccaacctgagaaccgacggcgccaccggcgcccccggcgtgctgttcgcccccagcgcccccgcccccaacctgcccgccggcaagatgaaccacagagaccccctgcagcccctgctggagaacccccccctgggccccggcgcccccaccagcttcgagcccagaagacccccccccctgagacccggcgtgaccagcgcccccggcttcccccacctgcccaccgccaaccccaccggccccggcgagagaggcccccccggcgccgtggaggtgatcagagagagcagcagcaccaccggcatggtggtgggcatcgtggccgccgccgccctgtgcatcctgatcctgctgtacgccatgtacaagtacagaaacagagacgagggcagctaccaggtggaccagagcagaaactacatcagcaacagcgcccagagcaacggcgccgtggtgaaggagaaggcccccgccgcccccaagacccccagcaaggccaagaagaacaaggacaaggagtactacgtgtag

SEQ ID NO: 90708 - DNA, 5139 bp, Artificial Sequence; identical to SEQ ID NO: 90706
  Description of Artificial Sequence: Synthetic coding sequence

SEQ ID NO: 90709 - DNA, 4929 bp, Artificial Sequence
  Description of Artificial Sequence: Synthetic coding sequence
atggccagcggcagcagatggagacccacccccccccccctgctgctgctgctgctgctggccctggccgccagagccgacggcctggagttcggcggcggccccggccagtgggccagatacgccagatgggccggcgccgccagcagcggcgagctgagcttcagcctgagaaccaacgccaccagagccctgctgctgtacctggacgacggcggcgactgcgacttcctggagctgctgctggtggacggcagactgagactgagattcaccctgagctgcgccgagcccgccaccctgcagctggacacccccgtggccgacgacagatggcacatggtgctgctgaccagagacgccagaagaaccgccctggccgtggacggcgaggccagagccgccgaggtgagaagcaagagaagagagatgcaggtggccagcgacctgttcgtgggcggcatcccccccgacgtgagactgagcgccctgaccctgagcaccgtgaagtacgagccccccttcagaggcctgctggccaacctgaagctgggcgagagaccccccgccctgctgggcagccagggcctgagaggcgccaccgccgaccccctgtgcgcccccgccagaaacccctgcgccaacggcggcctgtgcaccgtgctggcccccggcgaggtgggctgcgactgcagccacaccggcttcggcggcaagttctgcagcgaggaggagcaccccatggagggccccgcccacctgaccctgaacagcgagggcaaggaggagttcgtggccaccttcaagggcaacgagttcttctgctacgacctgagccacaaccccatccagagcagcaccgacgagatcaccctggccttcagaaccctgcagagaaacggcctgatgctgcacaccggcaagagcgccgactacgtgaacctgagcctgaagagcggcgccgtgtggctggtgatcaacctgggcagcggcgccttcgaggccctggtggagcccgtgaacggcaagttcaacgacaacgcctggcacgacgtgagagtgaccagaaacctgagacagcacgccggcatcggccacgccatggtgaccatcagcgtggacggcatcctgaccaccaccggctacacccaggaggactacaccatgctgggcagcgacgacttcttctacatcggcggcagccccaacaccgccgacctgcccggcagccccgtgagcaacaacttcatgggctgcctgaaggacgtggtgtacaagaacaacgacttcaagctggagctgagcagactggccaaggagggcgaccccaagatgaagctgcagggcgacctgagcttcagatgcgaggacgtggccgccctggaccccgtgaccttcgagagccccgaggccttcgtggccctgcccagatggagcgccaagagaaccggcagcatcagcctggacttcagaaccaccgagcccaacggcctgctgctgttcagccagggcagaagagccggcggcggcgccggcagccacagcagcgcccagagagccgactacttcgccatggagctgctggacggccacctgtacctgctgctggacatgggcagcggcggcatcaagctgagagccagcagcagaaaggtgaacgacggcgagtggtgccacgtggacttccagagagacggcagaaagggcagcatcagcgtgaacagcagaagcacccccttcctggccaccggcgacagcgagatcctggacctggagagcgagctgtacctgggcggcctgcccgagggcggcagagtggacctgcccctgccccccgaggtgtggaccgccgccctgagagccggctacgtgggctgcgtgagagacctgttcatcgacggcagaagcagagacctgagaggcctggccgaggcccagggcgccgtgggcgtggcccccttctgcagcagagagaccctgaagcagtgcgccagcgccccctgcagaaacggcggcgtgtgcagagagggctggaacagattcatctgcgactgcatcggcaccggcttcctgggcagagtgtgcgagagagaggccaccgtgctgagctacgacggcagcatgtacatgaagatcatgctgcccaacgccatgcacaccgaggccgaggacgtgagcctgagattcatgagccagagagcctacggcctgatgatggccaccaccagcagagagagcgccgacaccctgagactggagctggacggcggccagatgaagctgaccgtgaacctgggcaagggccccgagaccctgttcgccggccacaagctgaacgacaacgagtggcacaccgtgagagtggtgagaagaggcaagagcctgcagctgagcgtggacaacgtgaccgtggagggccagatggccggcgcccacatgagactggagttccacaacatcgagaccggcatcatgaccgagagaagattcatcagcgtggtgcccagcaacttcatcggccacctgagcggcctggtgttcaacggccagccctacatggaccagtgcaaggacggcgacatcacctactgcgagctgaacgccagattcggcctgagagccatcgtggccgaccccgtgaccttcaagagcagaagcagctacctggccctggccaccctgcaggcctacgccagcatgcacctgttcttccagttcaagaccaccgcccccgacggcctgctgctgttcaacagcggcaacggcaacgacttcatcgtgatcgagctggtgaagggctacatccactacgtgttcgacctgggcaacggccccagcctgatgaagggcaacagcgacaagcccgtgaacgacaaccagtggcacaacgtggtggtgagcagagaccccggcaacgtgcacaccctgaagatcgacagcagaaccgtgacccagcacagcaacggcgccagaaacctggacctgaagggcgagctgtacatcggcggcctgagcaagaacatgttcagcaacctgcccaagctggtggccagcagagacggcttccagggctgcctggccagcgtggacctgaacggcagactgcccgacctgatcgccgacgccctgcacagaatcggccaggtggagagaggctgcgacggccccagcaccacctgcaccgaggagagctgcgccaaccagggcgtgtgcctgcagcagtgggacggcttcacctgcgactgcaccatgaccagctacggcggccccgtgtgcaacgaccccggcaccacctacatcttcggcaagggcggcgccctgatcacctacacctggccccccaacgacagacccagcaccagaatggacagactggccgtgggcttcagcacccaccagagaagcgccgtgctggtgagagtggacagcgccagcggcctgggcgactacctgcagctgcacatcgaccagggcaccgtgggcgtgatcttcaacgtgggcaccgacgacatcaccatcgacgagcccaacgccatcgtgagcgacggcaagtaccacgtggtgagattcaccagaagcggcggcaacgccaccctgcaggtggacagctggcccgtgaacgagagataccccgccggcagacagctgaccatcttcaacagccaggccgccatcaagatcggcggcagagaccagggcagacccttccagggccaggtgagcggcctgtactacaacggcctgaaggtgctggccctggccgccgagagcgaccccaacgtgagaaccgagggccacctgagactggtgggcgagggccccagcgtgctgctgagcgccgagaccaccgccaccaccctgctggccgacatggccaccaccatcatggagaccaccaccaccatggccaccaccaccaccagaagaggcagaagccccaccctgagagacagcaccacccagaacaccgacgacctgctggtggccagcgccgagtgccccagcgacgacgaggacctggaggagtgcgagcccagcaccggcggcgagctgatcctgcccatcatcaccgaggacagcctggaccccccccccgtggccaccagaagccccttcgtgccccccccccccaccttctaccccttcctgaccggcgtgggcgccacccaggacaccctgcccccccccgccgccagaagaccccccagcggcggcccctgccaggccgagagagacgacagcgactgcgaggagcccatcgaggccagcggcttcgccagcggcgaggtgttcgacagcagcctgccccccaccgacgacgaggacttctacaccaccttccccctggtgaccgacagaaccaccctgctgagccccagaaagcccgcccccagacccaacctgagaaccgacggcgccaccggcgcccccggcgtgctgttcgcccccagcgcccccgcccccaacctgcccgccggcaagatgaaccacagagaccccctgcagcccctgctggagaacccccccctgggccccggcgcccccaccagcttcgagcccagaagacccccccccctgagacccggcgtgaccagcgcccccggcttcccccacctgcccaccgccaaccccaccggccccggcgagagaggcccccccggcgccgtggaggtgatcagagagagcagcagcaccaccggcatggtggtgggcatcgtggccgccgccgccctgtgcatcctgatcctgctgtacgccatgtacaagtacagaaacagagacgagggcagctaccaggtggaccagagcagaaactacatcagcaacagcgcccagagcaacggcgccgtggtgaaggagaaggcccccgccgcccccaagacccccagcaaggccaagaagaacaaggacaaggagtactacgtgtag

SEQ ID NO: 90710 - DNA, 5118 bp, Artificial Sequence
  Description of Artificial Sequence: Synthetic coding sequence
atggccagcggcagcagatggagacccacccccccccccctgctgctgctgctgctgctggccctggccgccagagccgacggcctggagttcggcggcggccccggccagtgggccagatacgccagatgggccggcgccgccagcagcggcgagctgagcttcagcctgagaaccaacgccaccagagccctgctgctgtacctggacgacggcggcgactgcgacttcctggagctgctgctggtggacggcagactgagactgagattcaccctgagctgcgccgagcccgccaccctgcagctggacacccccgtggccgacgacagatggcacatggtgctgctgaccagagacgccagaagaaccgccctggccgtggacggcgaggccagagccgccgaggtgagaagcaagagaagagagatgcaggtggccagcgacctgttcgtgggcggcatcccccccgacgtgagactgagcgccctgaccctgagcaccgtgaagtacgagccccccttcagaggcctgctggccaacctgaagctgggcgagagaccccccgccctgctgggcagccagggcctgagaggcgccaccgccgaccccctgtgcgcccccgccagaaacccctgcgccaacggcggcctgtgcaccgtgctggcccccggcgaggtgggctgcgactgcagccacaccggcttcggcggcaagttctgcagcgaggaggagcaccccatggagggccccgcccacctgaccctgaacagcgaggtgggcagcctgctgttcagcgagggcggcgccggcagaggcggcgccggcgacgtgcaccagcccaccaagggcaaggaggagttcgtggccaccttcaagggcaacgagttcttctgctacgacctgagccacaaccccatccagagcagcaccgacgagatcaccctggccttcagaaccctgcagagaaacggcctgatgctgcacaccggcaagagcgccgactacgtgaacctgagcctgaagagcggcgccgtgtggctggtgatcaacctgggcagcggcgccttcgaggccctggtggagcccgtgaacggcaagttcaacgacaacgcctggcacgacgtgagagtgaccagaaacctgagacagcacgccggcatcggccacgccatggtgaccatcagcgtggacggcatcctgaccaccaccggctacacccaggaggactacaccatgctgggcagcgacgacttcttctacatcggcggcagccccaacaccgccgacctgcccggcagccccgtgagcaacaacttcatgggctgcctgaaggacgtggtgtacaagaacaacgacttcaagctggagctgagcagactggccaaggagggcgaccccaagatgaagctgcagggcgacctgagcttcagatgcgaggacgtggccgccctggaccccgtgaccttcgagagccccgaggccttcgtggccctgcccagatggagcgccaagagaaccggcagcatcagcctggacttcagaaccaccgagcccaacggcctgctgctgttcagccagggcagaagagccggcggcggcgccggcagccacagcagcgcccagagagccgactacttcgccatggagctgctggacggccacctgtacctgctgctggacatgggcagcggcggcatcaagctgagagccagcagcagaaaggtgaacgacggcgagtggtgccacgtggacttccagagagacggcagaaagggcagcatcagcgtgaacagcagaagcacccccttcctggccaccggcgacagcgagatcctggacctggagagcgagctgtacctgggcggcctgcccgagggcggcagagtggacctgcccctgccccccgaggtgtggaccgccgccctgagagccggctacgtgggctgcgtgagagacctgttcatcgacggcagaagcagagacctgagaggcctggccgaggcccagggcgccgtgggcgtggcccccttctgcagcagagagaccctgaagcagtgcgccagcgccccctgcagaaacggcggcgtgtgcagagagggctggaacagattcatctgcgactgcatcggcaccggcttcctgggcagagtgtgcgagagagaggccaccgtgctgagctacgacggcagcatgtacatgaagatcatgctgcccaacgccatgcacaccgaggccgaggacgtgagcctgagattcatgagccagagagcctacggcctgatgatggccaccaccagcagagagagcgccgacaccctgagactggagctggacggcggccagatgaagctgaccgtgaacctggactgcctgagagtgggctgcgcccccagcaagggccccgagaccctgttcgccggccacaagctgaacgacaacgagtggcacaccgtgagagtggtgagaagaggcaagagcctgcagctgagcgtggacaacgtgaccgtggagggccagatggccggcgcccacatgagactggagttccacaacatcgagaccggcatcatgaccgagagaagattcatcagcgtggtgcccagcaacttcatcggccacctgagcggcctggtgttcaacggccagccctacatggaccagtgcaaggacggcgacatcacctactgcgagctgaacgccagattcggcctgagagccatcgtggccgaccccgtgaccttcaagagcagaagcagctacctggccctggccaccctgcaggcctacgccagcatgcacctgttcttccagttcaagaccaccgcccccgacggcctgctgctgttcaacagcggcaacggcaacgacttcatcgtgatcgagctggtgaagggctacatccactacgtgttcgacctgggcaacggccccagcctgatgaagggcaacagcgacaagcccgtgaacgacaaccagtggcacaacgtggtggtgagcagagaccccggcaacgtgcacaccctgaagatcgacagcagaaccgtgacccagcacagcaacggcgccagaaacctggacctgaagggcgagctgtacatcggcggcctgagcaagaacatgttcagcaacctgcccaagctggtggccagcagagacggcttccagggctgcctggccagcgtggacctgaacggcagactgcccgacctgatcgccgacgccctgcacagaatcggccaggtggagagaggctgcgacggccccagcaccacctgcaccgaggagagctgcgccaaccagggcgtgtgcctgcagcagtgggacggcttcacctgcgactgcaccatgaccagctacggcggccccgtgtgcaacgaccccggcaccacctacatcttcggcaagggcggcgccctgatcacctacacctggccccccaacgacagacccagcaccagaatggacagactggccgtgggcttcagcacccaccagagaagcgccgtgctggtgagagtggacagcgccagcggcctgggcgactacctgcagctgcacatcgaccagggcaccgtgggcgtgatcttcaacgtgggcaccgacgacatcaccatcgacgagcccaacgccatcgtgagcgacggcaagtaccacgtggtgagattcaccagaagcggcggcaacgccaccctgcaggtggacagctggcccgtgaacgagagataccccgccggcaacttcgacaacgagagactggccatcgccagacagagaatcccctacagactgggcagagtggtggacgagtggctgctggacaagggcagacagctgaccatcttcaacagccaggccgccatcaagatcggcggcagagaccagggcagacccttccagggccaggtgagcggcctgtactacaacggcctgaaggtgctggccctggccgccgagagcgaccccaacgtgagaaccgagggccacctgagactggtgggcgagggccccagcgtgctgctgagcgccgagaccaccgccaccaccctgctggccgacatggccaccaccatcatggagaccaccaccaccatggccaccaccaccaccagaagaggcagaagccccaccctgagagacagcaccacccagaacaccgacgacctgctggtggccagcgccgagtgccccagcgacgacgaggacctggaggagtgcgagcccagcaccggcggcgagctgatcctgcccatcatcaccgaggacagcctggaccccccccccgtggccaccagaagccccttcgtgccccccccccccaccttctaccccttcctgaccggcgtgggcgccacccaggacaccctgcccccccccgccgccagaagaccccccagcggcggcccctgccaggccgagagagacgacagcgactgcgaggagcccatcgaggccagcggcttcgccagcggcgaggtgttcgacagcagcctgccccccaccgacgacgaggacttctacaccaccttccccctggtgaccgacagaaccaccctgctgagccccagaaagcccgcccccagacccaacctgagaaccgacggcgccaccggcgcccccggcgtgctgttcgcccccagcgcccccgcccccaacctgcccgccggcaagatgaaccacagagaccccctgcagcccctgctggagaacccccccctgggccccggcgcccccaccagcttcgagcccagaagacccccccccctgagacccggcgtgaccagcgcccccggcttcccccacctgcccaccgccaaccccaccggccccggcgagagaggcccccccggcgccgtggaggtgatcagagagagcagcagcaccaccggcatggtggtgggcatcgtggccgccgccgccctgtgcatcctgatcctgctgtacgccatgtacaagtacagaaacagagacgagggcagctaccaggtggaccagagcagaaactacatcagcaacagcgcccagagcaacggcgccgtggtgaaggagaaggcccccgccgcccccaagacccccagcaaggccaagaagaacaaggacaaggagtactacgtgtag

SEQ ID NO: 90711 - DNA, 2001 bp, Artificial Sequence
  Description of Artificial Sequence: Synthetic coding sequence
atgccccccggcggcagcggccccggcggctgccccagaagaccccccgccctggccggccccctgccccccccccccccccccccccccccccccctgctgcccctgctgcccctgctgctgctgctgctgctgggcgccgccgagggcgccagagtgagcagcagcctgagcaccacccaccacgtgcaccacttccacagcaagcacggcaccgtgcccatcgccatcaacagaatgcccttcctgaccagaggcggccacgccggcaccacctacatcttcggcaagggcggcgccctgatcacctacacctggccccccaacgacagacccagcaccagaatggacagactggccgtgggcttcagcacccaccagagaagcgccgtgctggtgagagtggacagcgccagcggcctgggcgactacctgcagctgcacatcgaccagggcaccgtgggcgtgatcttcaacgtgggcaccgacgacatcaccatcgacgagcccaacgccatcgtgagcgacggcaagtaccacgtggtgagattcaccagaagcggcggcaacgccaccctgcaggtggacagctggcccgtgaacgagagataccccgccggcaacttcgacaacgagagactggccatcgccagacagagaatcccctacagactgggcagagtggtggacgagtggctgctggacaagggcagacagctgaccatcttcaacagccaggccgccatcaagatcggcggcagagaccagggcagacccttccagggccaggtgagcggcctgtactacaacggcctgaaggtgctggccctggccgccgagagcgaccccaacgtgagaaccgagggccacctgagactggtgggcgagggccccagcgtgctgctgagcgccgagaccaccgccaccaccctgctggccgacatggccaccaccatcatggagaccaccaccaccatggccaccaccaccaccagaagaggcagaagccccaccctgagagacagcaccacccagaacaccgacgacctgctggtggccagcgccgagtgccccagcgacgacgaggacctggaggagtgcgagcccagcaccggcggcgagctgatcctgcccatcatcaccgaggacagcctggaccccccccccgtggccaccagaagccccttcgtgccccccccccccaccttctaccccttcctgaccggcgtgggcgccacccaggacaccctgcccccccccgccgccagaagaccccccagcggcggcccctgccaggccgagagagacgacagcgactgcgaggagcccatcgaggccagcggcttcgccagcggcgaggtgttcgacagcagcctgccccccaccgacgacgaggacttctacaccaccttccccctggtgaccgacagaaccaccctgctgagccccagaaagcccgcccccagacccaacctgagaaccgacggcgccaccggcgcccccggcgtgctgttcgcccccagcgcccccgcccccaacctgcccgccggcaagatgaaccacagagaccccctgcagcccctgctggagaacccccccctgggccccggcgcccccaccagcttcgagcccagaagacccccccccctgagacccggcgtgaccagcgcccccggcttcccccacctgcccaccgccaaccccaccggccccggcgagagaggcccccccggcgccgtggaggtgatcagagagagcagcagcaccaccggcatggtggtgggcatcgtggccgccgccgccctgtgcatcctgatcctgctgtacgccatgtacaagtacagaaacagagacgagggcagctaccaggtggaccagagcagaaactacatcagcaacagcgcccagagcaacggcgccgtggtgaaggagaaggcccccgccgcccccaagacccccagcaaggccaagaagaacaaggacaaggagtactacgtgtag

SEQ ID NO: 90712 - DNA, 1299 bp, Artificial Sequence
  Description of Artificial Sequence: Synthetic coding sequence
atgcacctgagaatccacgccagaagaagcccccccagaagacccgcctggaccctgggcatctggttcctgttctggggctgcatcgtgagcagcgtgtggagcagcagcaacgtggccagcagcagcagcaccagcagcagccccggcagccacagccagcacgagcaccacttccacggcagcaagcaccacagcgtgcccatcagcatctacagaagccccgtgagcctgagaggcggccacgccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccggcagaagcgccaaccccaccgagcccggcatcagaagagtgcccggcgccagcgaggtgatcagagagagcagcagcaccaccggcatggtggtgggcatcgtggccgccgccgccctgtgcatcctgatcctgctgtacgccatgtacaagtacagaaacagagacgagggcagctaccaggtggacgagaccagaaactacatcagcaacagcgcccagagcaacggcaccctgatgaaggagaagcagcagagcagcaagagcggccacaagaagcagaagaacaaggacagagagtactacgtgtag

SEQ ID NO: 90713 - DNA, 4932 bp, Artificial Sequence
  Description of Artificial Sequence: Synthetic coding sequence
atgagcagcaccctgcacagcgtgttcttcaccctgaaggtgagcatcctgctgggcagcctgctgggcctgtgcctgggcctggagttcatgggcctgcccaaccagtgggccagatacctgagatgggacgccagcaccagaagcgacctgagcttccagttcaagaccaacgtgagcaccggcctgctgctgtacctggacgacggcggcgtgtgcgacttcctgtgcctgagcctggtggacggcagagtgcagctgagattcagcatggactgcgccgagaccgccgtgctgagcaacaagcaggtgaacgacagcagctggcacttcctgatggtgagcagagacagactgagaaccgtgctgatgctggacggcgagggccagagcggcgagctgcagccccagagaccctacatggacgtggtgagcgacctgttcctgggcggcgtgcccaccgacatcagacccagcgccctgaccctggacggcgtgcaggccatgcccggcttcaagggcctgatcctggacctgaagtacggcaacagcgagcccagactgctgggcagcagaggcgtgcagatggacgccgagggcccctgcggcgagagaccctgcgagaacggcggcatctgcttcctgctggacggccaccccacctgcgactgcagcaccaccggctacggcggcaagctgtgcagcgagggcagcagcggcgacccctgcctgagccacctgatgatgagcgagcaggccagagaggagaacgtggccaccttcagaggcagcgagtacctgtgctacgacctgagccagaaccccatccagagcagcagcgacgagatcaccctgagcttcaagacctggcagagaaacggcctgatcctgcacaccggcaagagcgccgactacgtgaacctggccctgaaggacggcgccgtgagcctggtgatcaacctgggcagcggcgccttcgaggccatcgtggagcccgtgaacggcaagttcaacgacaacgcctggcacgacgtgaaggtgaccagaaacctgagacaggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacatcagactggagctgagcagactggccagaatcgccgacaccaagatgaagatctacggcgaggtggtgttcaagtgcgagaacgtggccaccctggaccccatcaacttcgagacccccgaggcctacatcagcctgcccaagtggaacaccaagagaatgggcagcatcagcttcgacttcagaaccaccgagcccaacggcctgatcctgttcacccacggcaagccccaggagagaaaggacgccagaagccagaagaacaccaaggtggacttcttcgccgtggagctgctggacggcaacctgtacctgctgctggacatgggcagcggcaccatcaaggtgaaggccacccagaagaaggccaacgacggcgagtggtaccacgtggacatccagagagacggcagaagcggcaccatcagcgtgaacagcagaagaacccccttcaccgccagcggcgagagcgagatcctggacctggagggcgacatgtacctgggcggcctgcccgagaacagagccggcctgatcctgcccaccgagctgtggaccgccatgctgaactacggctacgtgggctgcatcagagacctgttcatcgacggcagaagcaagaacatcagacagctggccgagatgcagaacgccgccggcgtgaagagcagctgcagcagaatgagcgccaagcagtgcgacagctacccctgcaagaacaacgccgtgtgcaaggacggctggaacagattcatctgcgactgcaccggcaccggctactggggcagaacctgcgagagagaggccagcatcctgagctacgacggcagcatgtacatgaagatcatcatgcccatggtgatgcacaccgaggccgaggacgtgagcttcagattcatgagccagagagcctacggcctgctggtggccaccaccagcagagacagcgccgacaccctgagactggagctggacggcggcagagtgaagctgatggtgaacctggactgcatcagaatcaactgcaacagcagcaagggccccgagaccctgtacgccggccagaagctgaacgacaacgagtggcacaccgtgagagtggtgagaagaggcaagagcctgaagctgaccgtggacgacgacgtggccgagggcaccatggtgggcgaccacaccagactggagttccacaacatcgagaccggcatcatgaccgagaagagatacatcagcgtggtgcccagcagcttcatcggccacctgcagagcctgatgttcaacggcctgctgtacatcgacctgtgcaagaacggcgacatcgactactgcgagctgaaggccagattcggcctgagaaacatcatcgccgaccccgtgaccttcaagaccaagagcagctacctgagcctggccaccctgcaggcctacaccagcatgcacctgttcttccagttcaagaccaccagccccgacggcttcatcctgttcaacagcggcgacggcaacgacttcatcgccgtggagctggtgaagggctacatccactacgtgttcgacctgggcaacggccccaacgtgatcaagggcaacagcgacagacccctgaacgacaaccagtggcacaacgtggtgatcaccagagacaacagcaacacccacagcctgaaggtggacaccaaggtggtgacccaggtgatcaacggcgccaagaacctggacctgaagggcgacctgtacatggccggcctggcccagggcatgtacagcaacctgcccaagctggtggccagcagagacggcttccagggctgcctggccagcgtggacctgaacggcagactgcccgacctgatcaacgacgccctgcacagaagcggccagatcgagagaggctgcgagggccccagcaccacctgccaggaggacagctgcgccaaccagggcgtgtgcatgcagcagtgggagggcttcacctgcgactgcagcatgaccagctacagcggcaaccagtgcaacgaccccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccgccagaggcgagctggtgatccccctgctggtggaggaccccctggccaccccccccatcgccaccagagcccccagcatcaccctgccccccaccttcagacccctgctgaccatcatcgagaccaccaaggacagcctgagcatgaccagcgaggccggcctgccctgcctgagcgaccagggcagcgacggctgcgacgacgacggcctggtgatcagcggctacggcagcggcgagaccttcgacagcaacctgccccccaccgacgacgaggacttctacaccaccttcagcctggtgaccgacaagagcctgagcaccagcatcttcgagggcggctacaaggcccacgcccccaagtgggagagcaaggacttcagacccaacaaggtgagcgagaccagcagaaccaccaccaccagcctgagccccgagctgatcagattcaccgccagcagcagcagcggcatggtgcccaagctgcccgccggcaagatgaacaacagagacctgaagccccagcccgacatcgtgctgctgcccctgcccaccgcctacgagctggacagcaccaagctgaagagccccctgatcaccagccccatgttcagaaacgtgcccaccgccaaccccaccgagcccggcatcagaagagtgcccggcgccagcgaggtgatcagagagagcagcagcaccaccggcatggtggtgggcatcgtggccgccgccgccctgtgcatcctgatcctgctgtacgccatgtacaagtacagaaacagagacgagggcagctaccaggtggacgagaccagaaactacatcagcaacagcgcccagagcaacggcaccctgatgaaggagaagcagcagagcagcaagagcggccacaagaagcagaagaacaaggacagagagtactacgtgtag

SEQ ID NO: 90714 - DNA, 4179 bp, Artificial Sequence
  Description of Artificial Sequence: Synthetic coding sequence
atgagcagcaccctgcacagcgtgttcttcaccctgaaggtgagcatcctgctgggcagcctgctgggcctgtgcctgggcctggagttcatgggcctgcccaaccagtgggccagatacctgagatgggacgccagcaccagaagcgacctgagcttccagttcaagaccaacgtgagcaccggcctgctgctgtacctggacgacggcggcgtgtgcgacttcctgtgcctgagcctggtggacggcagagtgcagctgagattcagcatggactgcgccgagaccgccgtgctgagcaacaagcaggtgaacgacagcagctggcacttcctgatggtgagcagagacagactgagaaccgtgctgatgctggacggcgagggccagagcggcgagctgcagccccagagaccctacatggacgtggtgagcgacctgttcctgggcggcgtgcccaccgacatcagacccagcgccctgaccctggacggcgtgcaggccatgcccggcttcaagggcctgatcctggacctgaagtacggcaacagcgagcccagactgctgggcagcagaggcgtgcagatggacgccgagggcccctgcggcgagagaccctgcgagaacggcggcatctgcttcctgctggacggccaccccacctgcgactgcagcaccaccggctacggcggcaagctgtgcagcgagggcctgagccacctgatgatgagcgagcagggcagatggaaggccagagaggagaacgtggccaccttcagaggcagcgagtacctgtgctacgacctgagccagaaccccatccagagcagcagcgacgagatcaccctgagcttcaagacctggcagagaaacggcctgatcctgcacaccggcaagagcgccgactacgtgaacctggccctgaaggacggcgccgtgagcctggtgatcaacctgggcagcggcgccttcgaggccatcgtggagcccgtgaacggcaagttcaacgacaacgcctggcacgacgtgaaggtgaccagaaacctgagacaggtgaccatcagcgtggacggcatcctgaccaccaccggctacacccaggaggactacaccatgctgggcagcgacgacttcttctacgtgggcggcagccccagcaccgccgacctgcccggcagccccgtgagcaacaacttcatgggctgcctgaaggaggtggtgtacaagaacaacgacatcagactggagctgagcagactggccagaatcgccgacaccaagatgaagatctacggcgaggtggtgttcaagtgcgagaacgtggccaccctggaccccatcaacttcgagacccccgaggcctacatcagcctgcccaagtggaacaccaagagaatgggcagcatcagcttcgacttcagaaccaccgagcccaacggcctgatcctgttcacccacggcaagccccaggagagaaaggacgccagaagccagaagaacaccaaggtggacttcttcgccgtggagctgctggacggcaacctgtacctgctgctggacatgggcagcggcaccatcaaggtgaaggccacccagaagaaggccaacgacggcgagtggtaccacgtggacatccagagagacggcagaagcggcaccatcagcgtgaacagcagaagaacccccttcaccgccagcggcgagagcgagatcctggacctggagggcgacatgtacctgggcggcctgcccgagaacagagccggcctgatcctgcccaccgagctgtggaccgccatgctgaactacggctacgtgggctgcatcagagacctgttcatcgacggcagaagcaagaacatcagacagctggccgagatgcagaacgccgccggcgtgaagagcagctgcagcagaatgagcgccaagcagtgcgacagctacccctgcaagaacaacgccgtgtgcaaggacggctggaacagattcatctgcgactgcaccggcaccggctactggggcagaacctgcgagagagaggccagcatcctgagctacgacggcagcatgtacatgaagatcatcatgcccatggtgatgcacaccgaggccgaggacgtgagcttcagattcatgagccagagagcctacggcctgctggtggccaccaccagcagagacagcgccgacaccctgagactggagctggacggcggcagagtgaagctgatggtgaacctgggcaagggccccgagaccctgtacgccggccagaagctgaacgacaacgagtggcacaccgtgagagtggtgagaagaggcaagagcctgaagctgaccgtggacgacgacgtggccgagggcaccatggtgggcgaccacaccagactggagttccacaacatcgagaccggcatcatgaccgagaagagatacatcagcgtggtgcccagcagcttcatcggccacctgcagagcctgatgttcaacggcctgctgtacatcgacctgtgcaagaacggcgacatcgactactgcgagctgaaggccagattcggcctgagaaacatcatcgccgaccccgtgaccttcaagaccaagagcagctacctgagcctggccaccctgcaggcctacaccagcatgcacctgttcttccagttcaagaccaccagccccgacggcttcatcctgttcaacagcggcgacggcaacgacttcatcgccgtggagctggtgaagggctacatccactacgtgttcgacctgggcaacggccccaacgtgatcaagggcaacagcgacagacccctgaacgacaaccagtggcacaacgtggtgatcaccagagacaacagcaacacccacagcctgaaggtggacaccaaggtggtgacccaggtgatcaacggcgccaagaacctggacctgaagggcgacctgtacatggccggcctggcccagggcatgtacagcaacctgcccaagctggtggccagcagagacggcttccagggctgcctggccagcgtggacctgaacggcagactgcccgacctgatcaacgacgccctgcacagaagcggccagatcgagagaggctgcgagggccccagcaccacctgccaggaggacagctgcgccaaccagggcgtgtgcatgcagcagtgggagggcttcacctgcgactgcagcatgaccagctacagcggcaaccagtgcaacgaccccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcaacaccgacaacgagagattccagatggtgaagcagaagatccccttcaagtacaacagacccgtggaggagtggctgcaggagaagggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccggcagaagcgccagaagcagcaacgccgccagaagcctgagagccgccctgacctggacctggagactgacctacaccttcacccccatcatcttcatcagctgcgtggtgcacagctag

SEQ ID NO: 90715 - DNA, 3186 bp, Artificial Sequence
  Description of Artificial Sequence: Synthetic coding sequence
atgctgggcagcgacgacttcttctacgtgggcggcagccccagcaccgccgacctgcccggcagccccgtgagcaacaacttcatgggctgcctgaaggaggtggtgtacaagaacaacgacatcagactggagctgagcagactggccagaatcgccgacaccaagatgaagatctacggcgaggtggtgttcaagtgcgagaacgtggccaccctggaccccatcaacttcgagacccccgaggcctacatcagcctgcccaagtggaacaccaagagaatgggcagcatcagcttcgacttcagaaccaccgagcccaacggcctgatcctgttcacccacggcaagccccaggagagaaaggacgccagaagccagaagaacaccaaggtggacttcttcgccgtggagctgctggacggcaacctgtacctgctgctggacatgggcagcggcaccatcaaggtgaaggccacccagaagaaggccaacgacggcgagtggtaccacgtggacatccagagagacggcagaagcggcaccatcagcgtgaacagcagaagaacccccttcaccgccagcggcgagagcgagatcctggacctggagggcgacatgtacctgggcggcctgcccgagaacagagccggcctgatcctgcccaccgagctgtggaccgccatgctgaactacggctacgtgggctgcatcagagacctgttcatcgacggcagaagcaagaacatcagacagctggccgagatgcagaacgccgccggcgtgaagagcagctgcagcagaatgagcgccaagcagtgcgacagctacccctgcaagaacaacgccgtgtgcaaggacggctggaacagattcatctgcgactgcaccggcaccggctactggggcagaacctgcgagagagaggccagcatcctgagctacgacggcagcatgtacatgaagatcatcatgcccatggtgatgcacaccgaggccgaggacgtgagcttcagattcatgagccagagagcctacggcctgctggtggccaccaccagcagagacagcgccgacaccctgagactggagctggacggcggcagagtgaagctgatggtgaacctggactgcatcagaatcaactgcaacagcagcaagggccccgagaccctgtacgccggccagaagctgaacgacaacgagtggcacaccgtgagagtggtgagaagaggcaagagcctgaagctgaccgtggacgacgacgtggccgagggcaccatggtgggcgaccacaccagactggagttccacaacatcgagaccggcatcatgaccgagaagagatacatcagcgtggtgcccagcagcttcatcggccacctgcagagcctgatgttcaacggcctgctgtacatcgacctgtgcaagaacggcgacatcgactactgcgagctgaaggccagattcggcctgagaaacatcatcgccgaccccgtgaccttcaagaccaagagcagctacctgagcctggccaccctgcaggcctacaccagcatgcacctgttcttccagttcaagaccaccagccccgacggcttcatcctgttcaacagcggcgacggcaacgacttcatcgccgtggagctggtgaagggctacatccactacgtgttcgacctgggcaacggccccaacgtgatcaagggcaacagcgacagacccctgaacgacaaccagtggcacaacgtggtgatcaccagagacaacagcaacacccacagcctgaaggtggacaccaaggtggtgacccaggtgatcaacggcgccaagaacctggacctgaagggcgacctgtacatggccggcctggcccagggcatgtacagcaacctgcccaagctggtggccagcagagacggcttccagggctgcctggccagcgtggacctgaacggcagactgcccgacctgatcaacgacgccctgcacagaagcggccagatcgagagaggctgcgagggccccagcaccacctgccaggaggacagctgcgccaaccagggcgtgtgcatgcagcagtgggagggcttcacctgcgactgcagcatgaccagctacagcggcaaccagtgcaacgaccccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccgccaaccccaccgagcccggcatcagaagagtgcccggcgccagcgaggtgatcagagagagcagcagcaccaccggcatggtggtgggcatcgtggccgccgccgccctgtgcatcctgatcctgctgtacgccatgtacaagtacagaaacagagacgagggcagctaccaggtggacgagaccagaaactacatcagcaacagcgcccagagcaacggcaccctgatgaaggagaagcagcagagcagcaagagcggccacaagaagcagaagaacaaggacagagagtactacgtgtag

SEQ ID NO: 90716 - DNA, 1380 bp, Artificial Sequence
  Description of Artificial Sequence: Synthetic coding sequence
atgcacctgagaatccacgccagaagaagcccccccagaagacccgcctggaccctgggcatctggttcctgttctggggctgcatcgtgagcagcgtgtggagcagcagcaacgtggccagcagcagcagcaccagcagcagccccggcagccacagccagcacgagcaccacttccacggcagcaagcaccacagcgtgcccatcagcatctacagaagccccgtgagcctgagaggcggccacgccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcaacaccgacaacgagagattccagatggtgaagcagaagatccccttcaagtacaacagacccgtggaggagtggctgcaggagaagggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccgccaaccccaccgagcccggcatcagaagagtgcccggcgccagcgaggtgatcagagagagcagcagcaccaccggcatggtggtgggcatcgtggccgccgccgccctgtgcatcctgatcctgctgtacgccatgtacaagtacagaaacagagacgagggcagctaccaggtggacgagaccagaaactacatcagcaacagcgcccagagcaacggcaccctgatgaaggagaagcagcagagcagcaagagcggccacaagaagcagaagaacaaggacagagagtactacgtgtag

SEQ ID NO: 90717 - DNA, 3186 bp, Artificial Sequence; identical to SEQ ID NO: 90715
  Description of Artificial Sequence: Synthetic coding sequence

SEQ ID NO: 90718 - DNA, 1914 bp, Artificial Sequence
  Description of Artificial Sequence: Synthetic coding sequence
atgcacctgagaatccacgccagaagaagcccccccagaagacccgcctggaccctgggcatctggttcctgttctggggctgcatcgtgagcagcgtgtggagcagcagcaacgtggccagcagcagcagcaccagcagcagccccggcagccacagccagcacgagcaccacttccacggcagcaagcaccacagcgtgcccatcagcatctacagaagccccgtgagcctgagaggcggccacgccggcgccacctacatcttcggcaagagcggcggcctgatcctgtacacctggcccgccaacgacagacccagcaccagaagcgacagactggccgtgggcttcagcaccaccgtgaaggacggcatcctggtgagaatcgacagcgcccccggcctgggcgacttcctgcagctgcacatcgagcagggcaagatcggcgtggtgttcaacatcggcaccgtggacatcagcatcaaggaggagagaacccccgtgaacgacggcaagtaccacgtggtgagattcaccagaaacggcggcaacgccaccctgcaggtggacaactggcccgtgaacgagcactaccccaccggcagacagctgaccatcttcaacacccaggcccagatcgccatcggcggcaaggacaagggcagactgttccagggccagctgagcggcctgtactacgacggcctgaaggtgctgaacatggccgccgagaacaaccccaacatcaagatcaacggcagcgtgagactggtgggcgaggtgcccagcatcctgggcaccacccagaccaccagcatgccccccgagatgagcaccaccgtgatggagaccaccaccaccatggccaccaccaccaccagaaagaacagaagcaccgccagcatccagcccaccagcgacgacctggtgagcagcgccgagtgcagcagcgacgacgaggacttcgtggagtgcgagcccagcaccggcggcgagctggtgatccccctgctggtggaggaccccctggccaccccccccatcgccaccagagcccccagcatcaccctgccccccaccttcagacccctgctgaccatcatcgagaccaccaaggacagcctgagcatgaccagcgaggccggcctgccctgcctgagcgaccagggcagcgacggctgcgacgacgacggcctggtgatcagcggctacggcagcggcgagaccttcgacagcaacctgccccccaccgacgacgaggacttctacaccaccttcagcctggtgaccgacaagagcctgagcaccagcatcttcgagggcggctacaaggcccacgcccccaagtgggagagcaaggacttcagacccaacaaggtgagcgagaccagcagaaccaccaccaccagcctgagccccgagctgatcagattcaccgccagcagcagcagcggcatggtgcccaagctgcccgccggcaagatgaacaacagagacctgaagccccagcccgacatcgtgctgctgcccctgcccaccgcctacgagctggacagcaccaagctgaagagccccctgatcaccagccccatgttcagaaacgtgcccaccgccaaccccaccgagcccggcatcagaagagtgcccggcgccagcgaggtgatcagagagagcagcagcaccaccggcatggtggtgggcatcgtggccgccgccgccctgtgcatcctgatcctgctgtacgccatgtacaagtacagaaacagagacgagggcagctaccaggtggacgagaccagaaactacatcagcaacagcgcccagagcaacggcaccctgatgaaggagaagcagcagagcagcaagagcggccacaagaagcagaagaacaaggacagagagtactacgtgtag

SEQ ID NO: 90719 - DNA, 429 bp, Artificial Sequence
  Description of Artificial Sequence: Synthetic coding sequence
atgggcctgaagctgaacggcagatacatcagcctgatcctggccgtgcagatcgcctacctggtgcaggccgtgagagccgccggcaagtgcgacgccgtgttcaagggcttcagcgactgcctgctgaagctgggcgacagcatggccaactacccccagggcctggacgacaagaccaacatcaagaccgtgtgcacctactgggaggacttccacagctgcaccgtgaccgccctgaccgactgccaggagggcgccaaggacatgtgggacaagctgagaaaggagagcaagaacctgaacatccagggcagcctgttcgagctgtgcggcagcggcaacggcgccgccggcagcctgctgcccgccttccccgtgctgctggtgagcctgagcgccgccctggccacctggctgagcttctag

SEQ ID NO: 90720 - DNA, 8841 bp, Artificial Sequence
  Description of Artificial Sequence: Synthetic coding sequence
atggccagcgagaagcccggccccggccccggcctggagccccagcccgtgggcctgatcgccgtgggcgccgccggcggcggcggcggcggcagcggcggcggcggcaccggcggcagcggcatgggcgagctgagaggcgccagcggcagcggcagcgtgatgctgcccgccggcatgatcaaccccagcgtgcccatcagaaacatcagaatgaagttcgccgtgctgatcggcctgatccaggtgggcgaggtgagcaacagagacatcgtggagaccgtgctgaacctgctggtgggcggcgagttcgacctggagatgaacttcatcatccaggacgccgagagcatcacctgcatgaccgagctgctggagcactgcgacgtgacctgccaggccgagatctggagcatgttcaccgccatcctgagaaagagcgtgagaaacctgcagaccagcaccgaggtgggcctgatcgagcaggtgctgctgaagatgagcgccgtggacgacatgatcgccgacctgctggtggacatgctgggcgtgctggccagctacagcatcaccgtgaaggagctgaagctgctgttcagcatgctgagaggcgagagcggcatctggcccagacacgccgtgaagctgctgagcgtgctgaaccagatgccccagagacacggccccgacaccttcttcaacttccccggctgcagcgccgccgccatcgccctgccccccatcgccaagtggccctaccagaacggcttcaccctgaacacctggttcagaatggaccccctgaacaacatcaacgtggacaaggacaagccctacctgtactgcttcagaaccagcaagggcgtgggctacagcgcccacttcgtgggcaactgcctgatcgtgaccagcctgaagagcaagggcaagggcttccagcactgcgtgaagtacgacttccagcccagaaagtggtacatgatcagcatcgtgcacatctacaacagatggagaaacagcgagatcagatgctacgtgaacggccagctggtgagctacggcgacatggcctggcacgtgaacaccaacgacagctacgacaagtgcttcctgggcagcagcgagaccgccgacgccaacagagtgttctgcggccagctgggcgccgtgtacgtgttcagcgaggccctgaaccccgcccagatcttcgccatccaccagctgggccccggctacaagagcaccttcaagttcaagagcgagagcgacatccacctggccgagcaccacaagcaggtgctgtacgacggcaagctggccagcagcatcgccttcacctacaacgccaaggccaccgacgcccagctgtgcctggagagcagccccaaggagaacgccagcatcttcgtgcacagcccccacgccctgatgctgcaggacgtgaaggccatcgtgacccacagcatccacagcgccatccacagcatcggcggcatccaggtgctgttccccctgttcgcccagctggacaacagacagctgaacgacagccaggtggagaccaccgtgtgcgccaccctgctggccttcctggtggagctgctgaagagcagcgtggccatgcaggagcagatgctgggcggcaagggcttcctggtgatcggctacctgctggagaagagcagcagagtgcacatcaccagagccgtgctggagcagttcctgagcttcgccaagtacctggacggcctgagccacggcgcccccctgctgaagcagctgtgcgaccacatcctgttcaaccccgccatctggatccacacccccgccaaggtgcagctgagcctgtacacctacctgagcgccgagttcatcggcaccgccaccatctacaccaccatcagaagagtgggcaccgtgctgcagctgatgcacaccctgaagtactactactgggtgatcaaccccgccgacagcagcggcatcacccccaagggcctggacggccccagacccagccagaaggagatcatcagcctgagagccttcatgctgctgttcctgaagcagctgatcctgaaggacagaggcgtgaaggaggacgagctgcagagcatcctgaactacctgctgaccatgcacgaggacgagaacatccacgacgtgctgcagctgctggtggccctgatgagcgagcaccccgccagcatgatccccgccttcgaccagagaaacggcatcagagtgatctacaagctgctggccagcaagagcgagagcatctgggtgcaggccctgaaggtgctgggctacttcctgaagcacctgggccacaagagaaaggtggagatcatgcacacccacagcctgttcaccctgctgggcgagagactgatgctgcacaccaacaccgtgaccgtgaccacctacaacaccctgtacgagatcctgaccgagcaggtgtgcacccaggtggtgcacaagccccaccccgagcccgacagcaccgtgaagatccagaaccccatgatcctgaaggtggtggccaccctgctgaagaacagcacccccagcgccgagctgatggaggtgagaagactgttcctgagcgacatgatcaagctgttcagcaacagcagagagaacagaagatgcctgctgcagtgcagcgtgtggcaggactggatgttcagcctgggctacatcaaccccaagaacagcgaggagcagaagatcaccgagatggtgtacaacatcttcagaatcctgctgtaccacgccatcaagtacgagtggggcggctggagagtgtgggtggacaccctgagcatcgcccacagcaaggtgacctacgaggcccacaaggagtacctggccaagatgtacgaggagtaccagagacaggaggaggagaacatcaagaagggcaagaagggcaacgtgagcaccatcagcggcctgagcagccagaccaccggcgccaagggcggcatggagatcagagagatcgaggacctgagccagagccagagccccgagagcgagaccgactaccccgtgagcaccgacaccagagacctgctgatgagcaccaaggtgagcgacgacatcctgggcaacagcgacagacccggcagcggcgtgcacgtggaggtgcacgacctgctggtggacatcaaggccgagaaggtggaggccaccgaggtgaagctggacgacatggacctgagccccgagaccctggtgggcggcgagaacggcgccctggtggaggtggagagcctgctggacaacgtgtacagcgccgccgtggagaagctgcagaacaacgtgcacggcagcgtgggcatcatcaagaagaacgaggagaaggacaacggccccctgatcaccctggccgacgagaaggaggacctgcccaacagcagcaccagcttcctgttcgacaagatccccaagcaggaggagaagctgctgcccgagctgagcagcaaccacatcatccccaacatccaggacacccaggtgcacctgggcgtgagcgacgacctgggcctgctggcccacatgaccggcagcgtggacctgacctgcaccagcagcatcatcgaggagaaggagttcaagatccacaccaccagcgacggcatgagcagcatcagcgagagagacctggccagcagcaccaagggcctggagtacgccgagatgaccgccaccaccctggagaccgagagcagcagcagcaagatcgtgcccaacatcgacgccggcagcatcatcagcgacaccgagagaagcgacgacggcaaggagagcggcaaggagatcagaaagatccagaccaccaccaccacccaggccgtgcagggcagaagcatcacccagcaggacagagacctgagagtggacctgggcttcagaggcatgcccatgaccgaggagcagagaagacagttcagccccggccccagaaccaccatgttcagaatccccgagttcaagtggagccccatgcaccagagactgctgaccgacctgctgttcgccctggagaccgacgtgcacgtgtggagaagccacagcaccaagagcgtgatggacttcgtgaacagcaacgagaacatcatcttcgtgcacaacaccatccacctgatcagccagatggtggacaacatcatcatcgcctgcggcggcatcctgcccctgctgagcgccgccaccagccccaccgtgagcaagaccgagctggagaacatcgaggtgacccagggcatgagcgccgagaccgccgtgaccttcctgagcagactgatggccatggtggacgtgctggtgttcgccagcagcctgaacttcagcgagatcgaggccgagaagaacatgagcagcggcggcctgatgagacagtgcctgagactggtgtgctgcgtggccgtgagaaactgcctggagtgcagacagagacagagagacagaggcaacaagagcagccacggcagcagcaagccccaggaggtgccccagagcgtgaccgccaccgccgccagcaagacccccctggagaacgtgcccggcaacctgagccccatcaaggaccccgacagactgctgcaggacgtggacatcaacagactgagagccgtggtgttcagagacgtggacgacagcaagcaggcccagttcctggccctggccgtggtgtacttcatcagcgtgctgatggtgagcaagtacagagacatcctggagccccagagagagaccaccagaaccggcagccagcccggcagaaacatcagacaggagatcaacagccccaccagcaccgtggtggtgatccccagcatcccccaccccagcctgaaccacggcttcctggccaagctgatccccgagcagagcttcggccacagcttctacaaggagacccccgccgccttccccgacaccatcaaggagaaggagacccccacccccggcgaggacatccaggtggagagcagcatcccccacaccgacagcggcatcggcgaggagcaggtggccagcatcctgaacggcgccgagctggagaccagcaccggccccgacgccatgagcgagctgctgagcaccctgagcagcgaggtgaagaagagccaggagagcctgaccgagaaccccagcgagaccctgaagcccgccaccagcatcagcagcatcagccagaccaagggcatcaacgtgaaggagatcctgaagagcctggtggccgcccccgtggagatcgccgagtgcggccccgagcccatcccctaccccgaccccgccctgaagagagagacccaggccatcctgcccatgcagttccacagcttcgacagaagcgtggtggtgcccgtgaagaagcccccccccggcagcctggccgtgaccaccgtgggcgccaccaccgccggcagcggcctgcccaccggcagcaccagcaacatcttcgccgccaccggcgccacccccaagagcatgatcaacaccaccggcgccgtggacagcggcagcagcagcagcagcagcagcagcagcttcgtgaacggcgccaccagcaagaacctgcccgccgtgcagaccgtggcccccatgcccgaggacagcgccgagaacatgagcatcaccgccaagctggagagagccctggagaaggtggcccccctgctgagagagatcttcgtggacttcgcccccttcctgagcagaaccctgctgggcagccacggccaggagctgctgatcgagggcctggtgtgcatgaagagcagcaccagcgtggtggagctggtgatgctgctgtgcagccaggagtggcagaacagcatccagaagaacgccggcctggccttcatcgagctgatcaacgagggcagactgctgtgccacgccatgaaggaccacatcgtgagagtggccaacgaggccgagttcatcctgaacagacagagagccgaggacgtgcacaagcacgccgagttcgagagccagtgcgcccagtacgccgccgacagaagagaggaggagaagatgtgcgaccacctgatcagcgccgccaagcacagagaccacgtgaccgccaaccagctgaagcagaagatcctgaacatcctgaccaacaagcacggcgcctggggcgccgtgagccacagccagctgcacgacttctggagactggactactgggaggacgacctgagaagaagaagaagattcgtgagaaacgccttcggcagcacccacgccgaggccctgctgaaggccgccatcgagtacggcaccgaggaggacgtggtgaagagcaagaagaccttcagaagccaggccatcgtgaaccagaacgccgagaccgagctgatgctggagggcgacgacgacgccgtgagcctgctgcaggagaaggagatcgacaacctggccggccccgtggtgctgagcacccccgcccagctgatcgcccccgtggtggtggccaagggcaccctgagcatcaccaccaccgagatctacttcgaggtggacgaggacgacagcgccttcaagaagatcgacaccaaggtgctggcctacaccgagggcctgcacggcaagtggatgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90721 - DNA, 1575 bp, Artificial Sequence
  Description of Artificial Sequence: Synthetic coding sequence
atgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagagatccccgaggcctacttcatcagagacccccacaccttcctgctgaccaaggacttcatcaaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90722 - DNA, 8832 bp, Artificial Sequence
  Description of Artificial Sequence: Synthetic coding sequence
atggccagcgagaagcccggccccggccccggcctggagccccagcccgtgggcctgatcgccgtgggcgccgccggcggcggcggcggcggcagcggcggcggcggcaccggcggcagcggcatgggcgagctgagaggcgccagcggcagcggcagcgtgatgctgcccgccggcatgatcaaccccagcgtgcccatcagaaacatcagaatgaagttcgccgtgctgatcggcctgatccaggtgggcgaggtgagcaacagagacatcgtggagaccgtgctgaacctgctggtgggcggcgagttcgacctggagatgaacttcatcatccaggacgccgagagcatcacctgcatgaccgagctgctggagcactgcgacgtgacctgccaggccgagatctggagcatgttcaccgccatcctgagaaagagcgtgagaaacctgcagaccagcaccgaggtgggcctgatcgagcaggtgctgctgaagatgagcgccgtggacgacatgatcgccgacctgctggtggacatgctgggcgtgctggccagctacagcatcaccgtgaaggagctgaagctgctgttcagcatgctgagaggcgagagcggcatctggcccagacacgccgtgaagctgctgagcgtgctgaaccagatgccccagagacacggccccgacaccttcttcaacttccccggctgcagcgccgccgccatcgccctgccccccatcgccaagtggccctaccagaacggcttcaccctgaacacctggttcagaatggaccccctgaacaacatcaacgtggacaaggacaagccctacctgtactgcttcagaaccagcaagggcgtgggctacagcgcccacttcgtgggcaactgcctgatcgtgaccagcctgaagagcaagggcaagggcttccagcactgcgtgaagtacgacttccagcccagaaagtggtacatgatcagcatcgtgcacatctacaacagatggagaaacagcgagatcagatgctacgtgaacggccagctggtgagctacggcgacatggcctggcacgtgaacaccaacgacagctacgacaagtgcttcctgggcagcagcgagaccgccgacgccaacagagtgttctgcggccagctgggcgccgtgtacgtgttcagcgaggccctgaaccccgcccagatcttcgccatccaccagctgggccccggctacaagagcaccttcaagttcaagagcgagagcgacatccacctggccgagcaccacaagcaggtgctgtacgacggcaagctggccagcagcatcgccttcacctacaacgccaaggccaccgacgcccagctgtgcctggagagcagccccaaggagaacgccagcatcttcgtgcacagcccccacgccctgatgctgcaggacgtgaaggccatcgtgacccacagcatccacagcgccatccacagcatcggcggcatccaggtgctgttccccctgttcgcccagctggacaacagacagctgaacgacagccaggtggagaccaccgtgtgcgccaccctgctggccttcctggtggagctgctgaagagcagcgtggccatgcaggagcagatgctgggcggcaagggcttcctggtgatcggctacctgctggagaagagcagcagagtgcacatcaccagagccgtgctggagcagttcctgagcttcgccaagtacctggacggcctgagccacggcgcccccctgctgaagcagctgtgcgaccacatcctgttcaaccccgccatctggatccacacccccgccaaggtgcagctgagcctgtacacctacctgagcgccgagttcatcggcaccgccaccatctacaccaccatcagaagagtgggcaccgtgctgcagctgatgcacaccctgaagtactactactgggtgatcaaccccgccgacagcagcggcatcacccccaagggcctggacggccccagacccagccagaaggagatcatcagcctgagagccttcatgctgctgttcctgaagcagctgatcctgaaggacagaggcgtgaaggaggacgagctgcagagcatcctgaactacctgctgaccatgcacgaggacgagaacatccacgacgtgctgcagctgctggtggccctgatgagcgagcaccccgccagcatgatccccgccttcgaccagagaaacggcatcagagtgatctacaagctgctggccagcaagagcgagagcatctgggtgcaggccctgaaggtgctgggctacttcctgaagcacctgggccacaagagaaaggtggagatcatgcacacccacagcctgttcaccctgctgggcgagagactgatgctgcacaccaacaccgtgaccgtgaccacctacaacaccctgtacgagatcctgaccgagcaggtgtgcacccaggtggtgcacaagccccaccccgagcccgacagcaccgtgaagatccagaaccccatgatcctgaaggtggtggccaccctgctgaagaacagcacccccagcgccgagctgatggaggtgagaagactgttcctgagcgacatgatcaagctgttcagcaacagcagagagaacagaagatgcctgctgcagtgcagcgtgtggcaggactggatgttcagcctgggctacatcaaccccaagaacagcgaggagcagaagatcaccgagatggtgtacaacatcttcagaatcctgctgtaccacgccatcaagtacgagtggggcggctggagagtgtgggtggacaccctgagcatcgcccacagcaaggtgacctacgaggcccacaaggagtacctggccaagatgtacgaggagtaccagagacaggaggaggagaacatcaagaagggcaagaagggcaacgtgagcaccatcagcggcctgagcagccagaccaccggcgccaagggcggcatggagatcagagagatcgaggacctgagccagagccagagccccgagagcgagaccgactaccccgtgagcaccgacaccagagacctgctgatgagcaccaaggtgagcgacgacatcctgggcaacagcgacagacccggcagcggcgtgcacgtggaggtgcacgacctgctggtggacatcaaggccgagaaggtggaggccaccgaggtgaagctggacgacatggacctgagccccgagaccctggtgggcggcgagaacggcgccctggtggaggtggagagcctgctggacaacgtgtacagcgccgccgtggagaagctgcagaacaacgtgcacggcagcgtgggcatcatcaagaagaacgaggagaaggacaacggccccctgatcaccctggccgacgagaaggaggacctgcccaacagcagcaccagcttcctgttcgacaagatccccaagcaggaggagaagctgctgcccgagctgagcagcaaccacatcatccccaacatccaggacacccaggtgcacctgggcgtgagcgacgacctgggcctgctggcccacatgaccggcagcgtggacctgacctgcaccagcagcatcatcgaggagaaggagttcaagatccacaccaccagcgacggcatgagcagcatcagcgagagagacctggccagcagcaccaagggcctggagtacgccgagatgaccgccaccaccctggagaccgagagcagcagcagcaagatcgtgcccaacatcgacgccggcagcatcatcagcgacaccgagagaagcgacgacggcaaggagagcggcaaggagatcagaaagatccagaccaccaccaccacccaggccgtgcagggcagaagcatcacccagcaggacagagacctgagagtggacctgggcttcagaggcatgcccatgaccgaggagcagagaagacagttcagccccggccccagaaccaccatgttcagaatccccgagttcaagtggagccccatgcaccagagactgctgaccgacctgctgttcgccctggagaccgacgtgcacgtgtggagaagccacagcaccaagagcgtgatggacttcgtgaacagcaacgagaacatcatcttcgtgcacaacaccatccacctgatcagccagatggtggacaacatcatcatcgcctgcggcggcatcctgcccctgctgagcgccgccaccagccccaccaccgagctggagaacatcgaggtgacccagggcatgagcgccgagaccgccgtgaccttcctgagcagactgatggccatggtggacgtgctggtgttcgccagcagcctgaacttcagcgagatcgaggccgagaagaacatgagcagcggcggcctgatgagacagtgcctgagactggtgtgctgcgtggccgtgagaaactgcctggagtgcagacagagacagagagacagaggcaacaagagcagccacggcagcagcaagccccaggaggtgccccagagcgtgaccgccaccgccgccagcaagacccccctggagaacgtgcccggcaacctgagccccatcaaggaccccgacagactgctgcaggacgtggacatcaacagactgagagccgtggtgttcagagacgtggacgacagcaagcaggcccagttcctggccctggccgtggtgtacttcatcagcgtgctgatggtgagcaagtacagagacatcctggagccccagagagagaccaccagaaccggcagccagcccggcagaaacatcagacaggagatcaacagccccaccagcaccgtggtggtgatccccagcatcccccaccccagcctgaaccacggcttcctggccaagctgatccccgagcagagcttcggccacagcttctacaaggagacccccgccgccttccccgacaccatcaaggagaaggagacccccacccccggcgaggacatccaggtggagagcagcatcccccacaccgacagcggcatcggcgaggagcaggtggccagcatcctgaacggcgccgagctggagaccagcaccggccccgacgccatgagcgagctgctgagcaccctgagcagcgaggtgaagaagagccaggagagcctgaccgagaaccccagcgagaccctgaagcccgccaccagcatcagcagcatcagccagaccaagggcatcaacgtgaaggagatcctgaagagcctggtggccgcccccgtggagatcgccgagtgcggccccgagcccatcccctaccccgaccccgccctgaagagagagacccaggccatcctgcccatgcagttccacagcttcgacagaagcgtggtggtgcccgtgaagaagcccccccccggcagcctggccgtgaccaccgtgggcgccaccaccgccggcagcggcctgcccaccggcagcaccagcaacatcttcgccgccaccggcgccacccccaagagcatgatcaacaccaccggcgccgtggacagcggcagcagcagcagcagcagcagcagcagcttcgtgaacggcgccaccagcaagaacctgcccgccgtgcagaccgtggcccccatgcccgaggacagcgccgagaacatgagcatcaccgccaagctggagagagccctggagaaggtggcccccctgctgagagagatcttcgtggacttcgcccccttcctgagcagaaccctgctgggcagccacggccaggagctgctgatcgagggcctggtgtgcatgaagagcagcaccagcgtggtggagctggtgatgctgctgtgcagccaggagtggcagaacagcatccagaagaacgccggcctggccttcatcgagctgatcaacgagggcagactgctgtgccacgccatgaaggaccacatcgtgagagtggccaacgaggccgagttcatcctgaacagacagagagccgaggacgtgcacaagcacgccgagttcgagagccagtgcgcccagtacgccgccgacagaagagaggaggagaagatgtgcgaccacctgatcagcgccgccaagcacagagaccacgtgaccgccaaccagctgaagcagaagatcctgaacatcctgaccaacaagcacggcgcctggggcgccgtgagccacagccagctgcacgacttctggagactggactactgggaggacgacctgagaagaagaagaagattcgtgagaaacgccttcggcagcacccacgccgaggccctgctgaaggccgccatcgagtacggcaccgaggaggacgtggtgaagagcaagaagaccttcagaagccaggccatcgtgaaccagaacgccgagaccgagctgatgctggagggcgacgacgacgccgtgagcctgctgcaggagaaggagatcgacaacctggccggccccgtggtgctgagcacccccgcccagctgatcgcccccgtggtggtggccaagggcaccctgagcatcaccaccaccgagatctacttcgaggtggacgaggacgacagcgccttcaagaagatcgacaccaaggtgctggcctacaccgagggcctgcacggcaagtggatgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90723 - DNA, 8841 bp, Artificial Sequence
  Description of Artificial Sequence: Synthetic coding sequence
atggccagcgagaagcccggccccggccccggcctggagccccagcccgtgggcctgatcgccgtgggcgccgccggcggcggcggcggcggcagcggcggcggcggcaccggcggcagcggcatgggcgagctgagaggcgccagcggcagcggcagcgtgatgctgcccgccggcatgatcaaccccagcgtgcccatcagaaacatcagaatgaagttcgccgtgctgatcggcctgatccaggtgggcgaggtgagcaacagagacatcgtggagaccgtgctgaacctgctggtgggcggcgagttcgacctggagatgaacttcatcatccaggacgccgagagcatcacctgcatgaccgagctgctggagcactgcgacgtgacctgccaggccgagatctggagcatgttcaccgccatcctgagaaagagcgtgagaaacctgcagaccagcaccgaggtgggcctgatcgagcaggtgctgctgaagatgagcgccgtggacgacatgatcgccgacctgctggtggacatgctgggcgtgctggccagctacagcatcaccgtgaaggagctgaagctgctgttcagcatgctgagaggcgagagcggcatctggcccagacacgccgtgaagctgctgagcgtgctgaaccagatgccccagagacacggccccgacaccttcttcaacttccccggctgcagcgccgccgccatcgccctgccccccatcgccaagtggccctaccagaacggcttcaccctgaacacctggttcagaatggaccccctgaacaacatcaacgtggacaaggacaagccctacctgtactgcttcagaaccagcaagggcgtgggctacagcgcccacttcgtgggcaactgcctgatcgtgaccagcctgaagagcaagggcaagggcttccagcactgcgtgaagtacgacttccagcccagaaagtggtacatgatcagcatcgtgcacatctacaacagatggagaaacagcgagatcagatgctacgtgaacggccagctggtgagctacggcgacatggcctggcacgtgaacaccaacgacagctacgacaagtgcttcctgggcagcagcgagaccgccgacgccaacagagtgttctgcggccagctgggcgccgtgtacgtgttcagcgaggccctgaaccccgcccagatcttcgccatccaccagctgggccccggctacaagagcaccttcaagttcaagagcgagagcgacatccacctggccgagcaccacaagcaggtgctgtacgacggcaagctggccagcagcatcgccttcacctacaacgccaaggccaccgacgcccagctgtgcctggagagcagccccaaggagaacgccagcatcttcgtgcacagcccccacgccctgatgctgcaggacgtgaaggccatcgtgacccacagcatccacagcgccatccacagcatcggcggcatccaggtgctgttccccctgttcgcccagctggacaacagacagctgaacgacagccaggtggagaccaccgtgtgcgccaccctgctggccttcctggtggagctgctgaagagcagcgtggccatgcaggagcagatgctgggcggcaagggcttcctggtgatcggctacctgctggagaagagcagcagagtgcacatcaccagagccgtgctggagcagttcctgagcttcgccaagtacctggacggcctgagccacggcgcccccctgctgaagcagctgtgcgaccacatcctgttcaaccccgccatctggatccacacccccgccaaggtgcagctgagcctgtacacctacctgagcgccgagttcatcggcaccgccaccatctacaccaccatcagaagagtgggcaccgtgctgcagctgatgcacaccctgaagtactactactgggtgatcaaccccgccgacagcagcggcatcacccccaagggcctggacggccccagacccagccagaaggagatcatcagcctgagagccttcatgctgctgttcctgaagcagctgatcctgaaggacagaggcgtgaaggaggacgagctgcagagcatcctgaactacctgctgaccatgcacgaggacgagaacatccacgacgtgctgcagctgctggtggccctgatgagcgagcaccccgccagcatgatccccgccttcgaccagagaaacggcatcagagtgatctacaagctgctggccagcaagagcgagagcatctgggtgcaggccctgaaggtgctgggctacttcctgaagcacctgggccacaagagaaaggtggagatcatgcacacccacagcctgttcaccctgctgggcgagagactgatgctgcacaccaacaccgtgaccgtgaccacctacaacaccctgtacgagatcctgaccgagcaggtgtgcacccaggtggtgcacaagccccaccccgagcccgacagcaccgtgaagatccagaaccccatgatcctgaaggtggtggccaccctgctgaagaacagcacccccagcgccgagctgatggaggtgagaagactgttcctgagcgacatgatcaagctgttcagcaacagcagagagaacagaagatgcctgctgcagtgcagcgtgtggcaggactggatgttcagcctgggctacatcaaccccaagaacagcgaggagcagaagatcaccgagatggtgtacaacatcttcagaatcctgctgtaccacgccatcaagtacgagtggggcggctggagagtgtgggtggacaccctgagcatcgcccacagcaaggtgacctacgaggcccacaaggagtacctggccaagatgtacgaggagtaccagagacaggaggaggagaacatcaagaagggcaagaagggcaacgtgagcaccatcagcggcctgagcagccagaccaccggcgccaagggcggcatggagatcagagagatcgaggacctgagccagagccagagccccgagagcgagaccgactaccccgtgagcaccgacaccagagacctgctgatgagcaccaaggtgagcgacgacatcctgggcaacagcgacagacccggcagcggcgtgcacgtggaggtgcacgacctgctggtggacatcaaggccgagaaggtggaggccaccgaggtgaagctggacgacatggacctgagccccgagaccctggtgggcggcgagaacggcgccctggtggaggtggagagcctgctggacaacgtgtacagcgccgccgtggagaagctgcagaacaacgtgcacggcagcgtgggcatcatcaagaagaacgaggagaaggacaacggccccctgatcaccctggccgacgagaaggaggacctgcccaacagcagcaccagcttcctgttcgacaagatccccaagcaggaggagaagctgctgcccgagctgagcagcaaccacatcatccccaacatccaggacacccaggtgcacctgggcgtgagcgacgacctgggcctgctggcccacatgaccggcagcgtggacctgacctgcaccagcagcatcatcgaggagaaggagttcaagatccacaccaccagcgacggcatgagcagcatcagcgagagagacctggccagcagcaccaagggcctggagtacgccgagatgaccgccaccaccctggagaccgagagcagcagcagcaagatcgtgcccaacatcgacgccggcagcatcatcagcgacaccgagagaagcgacgacggcaaggagagcggcaaggagatcagaaagatccagaccaccaccaccacccaggccgtgcagggcagaagcatcacccagcaggacagagacctgagagtggacctgggcttcagaggcatgcccatgaccgaggagcagagaagacagttcagccccggccccagaaccaccatgttcagaatccccgagttcaagtggagccccatgcaccagagactgctgaccgacctgctgttcgccctggagaccgacgtgcacgtgtggagaagccacagcaccaagagcgtgatggacttcgtgaacagcaacgagaacatcatcttcgtgcacaacaccatccacctgatcagccagatggtggacaacatcatcatcgcctgcggcggcatcctgcccctgctgagcgccgccaccagccccaccggcagcaagaccgagctggagaacatcgaggtgacccagggcatgagcgccgagaccgccgtgaccttcctgagcagactgatggccatggtggacgtgctggtgttcgccagcagcctgaacttcagcgagatcgaggccgagaagaacatgagcagcggcggcctgatgagacagtgcctgagactggtgtgctgcgtggccgtgagaaactgcctggagtgcagacagagacagagagacagaggcaacaagagcagccacggcagcagcaagccccaggaggtgccccagagcgtgaccgccaccgccgccagcaagacccccctggagaacgtgcccggcaacctgagccccatcaaggaccccgacagactgctgcaggacgtggacatcaacagactgagagccgtggtgttcagagacgtggacgacagcaagcaggcccagttcctggccctggccgtggtgtacttcatcagcgtgctgatggtgagcaagtacagagacatcctggagccccagagagagaccaccagaaccggcagccagcccggcagaaacatcagacaggagatcaacagccccaccagcaccgtggtggtgatccccagcatcccccaccccagcctgaaccacggcttcctggccaagctgatccccgagcagagcttcggccacagcttctacaaggagacccccgccgccttccccgacaccatcaaggagaaggagacccccacccccggcgaggacatccaggtggagagcagcatcccccacaccgacagcggcatcggcgaggagcaggtggccagcatcctgaacggcgccgagctggagaccagcaccggccccgacgccatgagcgagctgctgagcaccctgagcagcgaggtgaagaagagccaggagagcctgaccgagaaccccagcgagaccctgaagcccgccaccagcatcagcagcatcagccagaccaagggcatcaacgtgaaggagatcctgaagagcctggtggccgcccccgtggagatcgccgagtgcggccccgagcccatcccctaccccgaccccgccctgaagagagagacccaggccatcctgcccatgcagttccacagcttcgacagaagcgtggtggtgcccgtgaagaagcccccccccggcagcctggccgtgaccaccgtgggcgccaccaccgccggcagcggcctgcccaccggcagcaccagcaacatcttcgccgccaccggcgccacccccaagagcatgatcaacaccaccggcgccgtggacagcggcagcagcagcagcagcagcagcagcagcttcgtgaacggcgccaccagcaagaacctgcccgccgtgcagaccgtggcccccatgcccgaggacagcgccgagaacatgagcatcaccgccaagctggagagagccctggagaaggtggcccccctgctgagagagatcttcgtggacttcgcccccttcctgagcagaaccctgctgggcagccacggccaggagctgctgatcgagggcctggtgtgcatgaagagcagcaccagcgtggtggagctggtgatgctgctgtgcagccaggagtggcagaacagcatccagaagaacgccggcctggccttcatcgagctgatcaacgagggcagactgctgtgccacgccatgaaggaccacatcgtgagagtggccaacgaggccgagttcatcctgaacagacagagagccgaggacgtgcacaagcacgccgagttcgagagccagtgcgcccagtacgccgccgacagaagagaggaggagaagatgtgcgaccacctgatcagcgccgccaagcacagagaccacgtgaccgccaaccagctgaagcagaagatcctgaacatcctgaccaacaagcacggcgcctggggcgccgtgagccacagccagctgcacgacttctggagactggactactgggaggacgacctgagaagaagaagaagattcgtgagaaacgccttcggcagcacccacgccgaggccctgctgaaggccgccatcgagtacggcaccgaggaggacgtggtgaagagcaagaagaccttcagaagccaggccatcgtgaaccagaacgccgagaccgagctgatgctggagggcgacgacgacgccgtgagcctgctgcaggagaaggagatcgacaacctggccggccccgtggtgctgagcacccccgcccagctgatcgcccccgtggtggtggccaagggcaccctgagcatcaccaccaccgagatctacttcgaggtggacgaggacgacagcgccttcaagaagatcgacaccaaggtgctggcctacaccgagggcctgcacggcaagtggatgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90724 - DNA, 1575 bp, Artificial Sequence; identical to SEQ ID NO: 90721
  Description of Artificial Sequence: Synthetic coding sequence

SEQ ID NO: 90725 - DNA, 4728 bp, Artificial Sequence
  Description of Artificial Sequence: Synthetic coding sequence
atgcaccagagactgctgaccgacctgctgttcgccctggagaccgacgtgcacgtgtggagaagccacagcaccaagagcgtgatggacttcgtgaacagcaacgagaacatcatcttcgtgcacaacaccatccacctgatcagccagatggtggacaacatcatcatcgcctgcggcggcatcctgcccctgctgagcgccgccaccagccccaccaccgagctggagaacatcgaggtgacccagggcatgagcgccgagaccgccgtgaccttcctgagcagactgatggccatggtggacgtgctggtgttcgccagcagcctgaacttcagcgagatcgaggccgagaagaacatgagcagcggcggcctgatgagacagtgcctgagactggtgtgctgcgtggccgtgagaaactgcctggagtgcagacagagacagagagacagaggcaacaagagcagccacggcagcagcaagccccaggaggtgccccagagcgtgaccgccaccgccgccagcaagacccccctggagaacgtgcccggcaacctgagccccatcaaggaccccgacagactgctgcaggacgtggacatcaacagactgagagccgtggtgttcagagacgtggacgacagcaagcaggcccagttcctggccctggccgtggtgtacttcatcagcgtgctgatggtgagcaagtacagagacatcctggagccccagagagagaccaccagaaccggcagccagcccggcagaaacatcagacaggagatcaacagccccaccagcaccgagacccccgccgccttccccgacaccatcaaggagaaggagacccccacccccggcgaggacatccaggtggagagcagcatcccccacaccgacagcggcatcggcgaggagcaggtggccagcatcctgaacggcgccgagctggagaccagcaccggccccgacgccatgagcgagctgctgagcaccctgagcagcgaggtgaagaagagccaggagagcctgaccgagaaccccagcgagaccctgaagcccgccaccagcatcagcagcatcagccagaccaagggcatcaacgtgaaggagatcctgaagagcctggtggccgcccccgtggagatcgccgagtgcggccccgagcccatcccctaccccgaccccgccctgaagagagagacccaggccatcctgcccatgcagttccacagcttcgacagaagcgtggtggtgcccgtgaagaagcccccccccggcagcctggccgtgaccaccgtgggcgccaccaccgccggcagcggcctgcccaccggcagcaccagcaacatcttcgccgccaccggcgccacccccaagagcatgatcaacaccaccggcgccgtggacagcggcagcagcagcagcagcagcagcagcagcttcgtgaacggcgccaccagcaagaacctgcccgccgtgcagaccgtggcccccatgcccgaggacagcgccgagaacatgagcatcaccgccaagctggagagagccctggagaaggtggcccccctgctgagagagatcttcgtggacttcgcccccttcctgagcagaaccctgctgggcagccacggccaggagctgctgatcgagggcctggtgtgcatgaagagcagcaccagcgtggtggagctggtgatgctgctgtgcagccaggagtggcagaacagcatccagaagaacgccggcctggccttcatcgagctgatcaacgagggcagactgctgtgccacgccatgaaggaccacatcgtgagagtggccaacgaggccgagttcatcctgaacagacagagagccgaggacgtgcacaagcacgccgagttcgagagccagtgcgcccagtacgccgccgacagaagagaggaggagaagatgtgcgaccacctgatcagcgccgccaagcacagagaccacgtgaccgccaaccagctgaagcagaagatcctgaacatcctgaccaacaagcacggcgcctggggcgccgtgagccacagccagctgcacgacttctggagactggactactgggaggacgacctgagaagaagaagaagattcgtgagaaacgccttcggcagcacccacgccgaggccctgctgaaggccgccatcgagtacggcaccgaggaggacgtggtgaagagcaagaagaccttcagaagccaggccatcgtgaaccagaacgccgagaccgagctgatgctggagggcgacgacgacgccgtgagcctgctgcaggagaaggagatcgacaacctggccggccccgtggtgctgagcacccccgcccagctgatcgcccccgtggtggtggccaagggcaccctgagcatcaccaccaccgagatctacttcgaggtggacgaggacgacagcgccttcaagaagatcgacaccaaggtgctggcctacaccgagggcctgcacggcaagtggatgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgagtgcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90726 - DNA, 2220 bp, Artificial Sequence
  Description of Artificial Sequence: Synthetic coding sequence
atgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaagcccgaggacttcgtgagaatcaacagaatggccctggagagcgagttcgtgagctgccagctgcaccagtggatcgacctgatcttcggctacaagcagagaggccccgaggccgtgagagccctgaacgtgttccactacctgacctacgagggcagcgtgaacctggacagcatcaccgaccccgtgctgagagaggccatggaggcccagatccagaacttcggccagacccccagccagctgctgatcgagccccacccccccagaagcagcgccatgcacctgtgcttcctgccccagagccccctgatgttcaaggaccagatgcagcaggacgtgatcatggtgctgaagttccccagcaacagccccgtgacccacgtggccgccaacaccctgccccacctgaccatccccgccgtggtgaccgtgacctgcagcagactgttcgccgtgaacagatggcacaacaccgtgggcctgagaggcgcccccggctacagcctggaccaggcccaccacctgcccatcgagatggaccccctgatcgccaacaacagcggcgtgaacaagagacagatcaccgacctggtggaccagagcatccagatcaacgcccactgcttcgtggtgaccgccgacaacagatacatcctgatctgcggcttctgggacaagagcttcagagtgtacagcaccgagaccggcaagctgacccagatcgtgttcggccactgggacgtggtgacctgcctggccagaagcgagagctacatcggcggcgactgctacatcgtgagcggcagcagagacgccaccctgctgctgtggtactggagcggcagacaccacatcatcggcgacaaccccaacagcagcgactaccccgcccccagagccgtgctgaccggccacgaccacgaggtggtgtgcgtgagcgtgtgcgccgagctgggcctggtgatcagcggcgccaaggagggcccctgcctggtgcacaccatcaccggcgacctgctgagagccctggagggccccgagaactgcctgttccccagactgatcagcgtgagcagcgagggccactgcatcatctactacgagagaggcagattcagcaacttcagcatcaacggcaagctgctggcccagatggagatcaacgacagcaccagagccatcctgctgagcagcgacggccagaacctggtgaccggcggcgacaacggcgtggtggaggtgtggcaggcctgcgacttcaagcagctgtacatctaccccggctgcgacgccggcatcagagccatggacctgagccacgaccagagaaccctgatcaccggcatggccagcggcagcatcgtggccttcaacatcgacttcaacagatggcactacgagcaccagaacagatactag

SEQ ID NO: 90727 - DNA, 8841 bp, Artificial Sequence; identical to SEQ ID NO: 90720
  Description of Artificial Sequence: Synthetic coding sequence

SEQ ID NO: 90728 - DNA, 834 bp, Artificial Sequence
  Description of Artificial Sequence: Synthetic coding sequence
atgttcagcgagatcagagccgtgttcagcagaagatacctgctgcagaacaccgccctggaggtgttcatggccaacagaaccagcgtgatgttcaacttccccgaccaggccaccgtgaagaaggtggtgtacagcctgcccagagtgggcgtgggcaccagctacggcctgccccaggccagaagaatcagcctggccacccccagacagctgtacaagagcagcaacatgacccagagatggcagagaagagagatcagcaacttcgagtacctgatgttcctgaacaccatcgccggcagaacctacaacgacctgaaccagtaccccgtgttcccctgggtgctgaccaactacgagagcgaggagctggacctgaccctgcccggcaacttcagagacctgagcaagcccatcggcgccctgaaccccaagagagccgtgttctacgccgagagatacgagacctgggaggacgaccagagccccccctaccactacaacacccactacagcaccgccaccagcaccctgagctggctggtgagaatcgagcccttcaccaccttcttcctgaacgccaacgacggcaagttcgaccaccccgacagaaccttcagcagcgtggccagaagctggagaaccagccagagagacaccagcgacgtgaaggagctgatccccgagttctactacctgcccgagatgttcgtgaacagcaacggctacaacctgggcgtgagagaggacgaggtggtggtgaacgacgtggacctgcccccctgggccaagaacctgaagaccctgtgcggcagcaccggctggccctag

SEQ ID NO: 90729 - DNA, 7815 bp, Artificial Sequence
  Description of Artificial Sequence: Synthetic coding sequence
atggccagcagagagagactgttcgagctgtggatgctgtactgcaccaagaaggaccccgactacctgaagctgtggctggacaccttcgtgagcagctacgagcagttcctggacgtggacttcgagaagctgcccaccagagtggacgacatgccccccggcatcagcctgctgcccgacaacatcctgcaggtgctgagaatccagctgctgcagtgcgtgcagaagatggccgacggcctggaggagcagcagcaggccctgagcatcctgctggtgaagttcttcatcatcctgtgcagaaacctgagcaacgtggaggagatcggcacctgcagctacatcaactacgtgatcaccatgaccaccctgtacatccagcagctgaagagcaagaagaaggagaaggagatggccgaccagacctgcatcgaggagttcgtgatccacgccctggccttctgcgagagcctgtacgacccctacagaaactggagacacagaatcagcggcagaatcctgagcaccgtggagaagagcagacagaagtacaagcccgccagcctgaccgtggagttcgtgcccttcttctaccagtgcttccaggagagcgagcacctgaaggagagcctgaagtgctgcctgctgcacctgttcggcgccatcgtggccggcggccagagaaacgccctgcaggccatcagccccgccaccatggaggtgctgatgagagtgctggccgactgcgacagctgggaggacggcgaccccgaggaggtgggcagaaaggccgagctgaccctgaagtgcctgaccgaggtggtgcacatcctgctgagcagcaacagcgaccagagacaggtggagaccagcaccatcctggagaactacttcaagctgctgaacagcgaccacagcgccctgcccaaccagagaagaagcagacagtgggagaacagattcatcgccctgcagatcaagatgctgaacaccatcaccgccatgctggactgcaccgacagacccgtgctgcaggccatcttcctgaacagcaactgcttcgagcacctgatcagactgctgcagaactgcaaggtgttccagggccagctggactgcctggccatcagcaccatccaggccctgaccgccgtgatgaacaagagccccgccgccaaggaggtgttcaaggagagaatcggctacacccacatgctggaggtgctgaagagcctgggccagccccccctggagctgctgaaggagctgatgaacatggccgtggagggcgaccacaccagcgtgggcatcctgggcatcagcaacgtgcagcccctgctgctgctgatccagtggctgcccgagctgcagagccacgacctgcagatcttcatcagcgactggctgaagagaatctgctgcatcaacagacagagcagaaccacctgcgtgaacgccaacatgggcatcagaatcatcgagaccctggacctgcacagcagcctgcaccagacctgcgccgagaacctgatcgccatccacggcagcctgggcagccagagcgtgagcagcgaggagatcagaagactgctgagactgctgagagtggacgagagcgagagcgtgcacccctacgtgacccccgtgaccagagccatcctgaccatggccagaaagctgagcctggagagcgccctgcagtacttcaacctgagccacagcatggccggcatcagcgtgccccccatccagaagtggcccggcagcgccttcagcttcagcgcctggttctgcctggaccaggaccagctgaccctgggcatcgccaacaagggcggcaagagaaagcagctgtacagcttcttcaccggcagcggcatgggcttcgaggccttcatcacccacagcggcatgctggtggtggccgtgtgcaccaagagagagtacgccaccgtgatgctgcccgaccacagcttctgcgacagcctgtggcacaacatcaccgtggtgcacatgcccggcaagagacccttcggccagagcttcgtgtacatctacgacaacggccagcagaaggtgagcgcccccctgagattccccgccatgaacgagcccttcaccagctgctgcatcggcagcgccggccagagaaccaccacccccccccccagccagatccccgacccccccttcagcagccccatcaccccccacagaaccagcttcggcggcatcctgagcagcgccagctggggcggcaccatcgagaagagcaagctgatcaccaagctgatcagcgccggcacccaggacagcgagtggggctgccccaccagcctggagggccagctgggcagcgtgatcatcttctacgagcccctgcagcccccccaggtgaaggccctgtacctggccggccccaactgcctgagcccctggaagtgccaggagagcgacatggccgacctgcccggcaacatcctgctgtactacaccgccaaggcctgcaagaacagcatctgcctggacctgagcaccaactgcctgcacggcagactgaccggcaacaaggtggtgaactgggacatcaaggacatcatcaactgcatcggcggcctgaacgtgctgttccccctgctggagcagatcagccacttcagcgagggccagatccccgaggagaagaacgagagcaccgtgcccgagagcgtgacccccgtggagggcgactggctggtgtggaccagcaccaaggccagcgagagcagactggagagaaacctggtggccaccttcatcctgatcgtgaagcacttcatccagagacaccccatcaaccagggcaacctgatccacagccacggcgtggccaccctgggcgccctgctgcagaaggtgcccagcaccctgatggacgtgaacgtgctgatggccgtgcagctgctgatcgagcaggtgagcctggagaagaacatgcagctgctgcagcagatgtaccagtacctgctgttcgacttcagaatctggaacagaggcgacttccccttcagaatcggccacatccagtacctgagcaccatcatcaaggacagcagaagagtgttcagaaagaagtacggcgtgcagttcctgctggacaccctgagaatctactacggcaacggctgcaagtacaacgagctgagcctggacgacatcagaaccatcagaaccagcctgtacggcctgatcaagtacttcctgtgcaagggcggcagccacgaggagatccagagcatcatgggctacatcgccgccaccaacgaggaggagcagctgttcggcatcctggacgtgctgttcagcctgctgagaaccagccccaccagaggccagctgttcctgctgctgttcgagcccggcaacgccgacatcctgtacgccctgctgctgaaccagaagtacagcgacagactgagagagatcatcttcaagatcatggagcagatgctgaagtgcaccaacgtgtacgagagaagcaagcagcacatcagactgagagaggtgggctacagcggcctgggcctgctgctgaacgaggccctggtgaacaccagcctgatcaagaacctgacccaccagatcatcaacaccgaccccgtgatcaacttcaaggacctgctgagcgtggtgtacatcagccacagagcccacatcaacgtgagagtggccatctgcagaaaggtgctgcagatcctgcagttccagcccgacgccgcccaccagatcagccagcaggtgggctggcaggacaccctggtgagactgttcctgaaggccaagttcgagaacggcaacaccctgcacaagcacagcagagccgtgctgatgaaggacaacgacaagaacatgagcaccgaggacaccaagaagaacagcgacgagaagaccgacgaggagaagatcaccagcttcgccagcgccaacgtgagcagcgaccagtggagcctggaggacagacacagcctggacagcaacacccccctgttccccgaggacagcagcgtgggcgagctgagcttcaagagcgagaaccaggaggagttctggcacagcaaccccagccacctgagcctggacctgagcggcatcgacagctgcgagatgagcgacagcggcagccaggtgcccgacagcctgcccagcacccccagccccgtggagagcaccaagagcttcagcgtgcacagcgacagagagagcagcatcaccaacgacatgggcttcagcgacgacttcagcctgctggagagccaggagagatgcgaggaggagctgctgcagctgctgacccacatcctgaactacgtgatgtgcaagggcctggagaagagcgacgacgacacctggatcgagagaggccaggtgttcagcgccctgagcaagcccggcatcagcagcgagctgctgagacccagcgacgagatcaagctgaccctgctgcagaagatgctggagtgggccatcagcgagaacagagaggccaagaccaaccccgtgaccgccgagaacgccttcagactggtgctgatcatccaggacttcctgcagagcgagggcctggtgaacagcaacatgtggaccgagaagctgctggaggacatgatgctgctgttcgactgcctgagcgtgtgctacagcgagagccccgtgtgggtgaagctgagccagatccagatccagctgctgctgggcttcatcggcagaggcaacctgcaggtgtgcgccatggccagcgccaagctgaacaccctgctgcagaccaaggtgatcgagaaccaggacgaggcctgctacatcctgggcaagctggagcacgtgctgagccagagcatcaaggagcagaccgagatctacagcttcctgatccccctggtgagaaccctggtgagcaagatctacgagctgctgttcatgaacctgcacctgcccagcctgcccttcaccaacggcagcagcagcttcttcgaggacttccaggagtactgcaacagcaacgagtggcaggtgtacatcgagaagtacatcgtgccctacatgaagcagtacgaggcccacaccttctacgacggccacgagaacatggccctgtactggaaggactgctacgaggccctgatggtgaacatgcacaagagagacagagagggcggcgagagcaagctgaagttccaggagctgttcgtggagcccttcaacagaaaggccagacaggagaacctgagatacaacaacatgctgaagcagctgagcagccagcagctggccaccctgagaagatggaaggccatccagctgtacctgacctgcgagagaggcccctgggccaagagaaagcagaaccccatccactggaagctggccaacgtggagaactacagcagaatgagactgaagctggtgcccaactacaacttcaagacccacgaggaggccagcgccctgagagacaacctgggcatccagcacagccagcccagcagcgacaccctgctgctggaggtggtgaagcaggtgaaggtgagcgacatggtggaggacaagctggacctgcccgaggaggacatcaccgccagagtgaacgtggacgagaaggaggagcaggaccagaaggagaagctggtgctgatggaggactgcgagctgatcaccatcatcgacgtgatccccggcagactggagatcaccacccagcacatctacttctacgacggcagcatcgagaaggaggacggcgtgggcttcgacttcaagtggccccacagccagatcagagagatccacctgagaagatacaacctgagaagaagcgccctggagatcttccacgtggaccagagcaactacttcctgaacttcaagaaggaggtgagaaacaagatctacagcagactgctgagcctgcacagccccaacagctactacggcagcagaagcccccaggagctgttcaaggccagcggcctgacccagaagtgggtgaacagagagatcagcaacttcgactacctgatccagatcaacaccatggccggcagaacctacaacgacctggcccagtaccccgtgttcccctggatcctgcaggactacaccagcgaggagctggacctgaacaaccccgccgtgttcagagacctgagcaagcccatcggcgtggtgaacgagaagaacgccaaggccatgagagagaagtacgagaacttcgaggaccccatgggcaccatcgacaagttccactacggcacccactacagcaacagcgccggcgtgatgcactacctgatcagagtggagcccttcaccaccctgcacatccagctgcagagcggcagattcgactgcgccgacagacagttccacagcatccccgccacctggcaggccctgatggacaacccctacgacgtgaaggagctgatccccgagttcttctacttccccgagttcctggagaaccagaaccagttcaacctgggcagactgcagatcagcaaggagctggtgaacgacgtgatcctgcccaagtgggccaagagcgccgaggacttcatctacaagcacagaaaggccctggagagcgagtacgtgagcgcccacctgcacgagtggatcgacctgatcttcggctacaagcagagaggccccgccgccgtggaggccctgaacgtgttctactactgcagctacgagggcgccgtggacctggacgccctgaccgacgagaaggagagaaaggccctggagggcatgatcaacaacttcggccagaccccctgccagctgctgaagatcaccatcagcatgaactacgtgatcggcacccacggctggctgccctacgacagaaacatcagcaactacttcaccttcatcaaggaccagaccgtgaccaaccccaagacccagagaagcatcaacggcagcttcgcccccggcctggagatcaccagcaagctgttcgtggtgagccacgacgccaagctgctgttcagcgccggctactgggacaacagcatccaggtgatgagcctgaccaagggcaagatcatcagccacatcatcagacacatggacatcgtgacctgcctggccaccgactactgcggcatccacctgatcagcggcagcagagacaccacctgcatgatctggcagatcacccagcagggcggcgtgcccgtgggcctggccagcaagcccttccagatcctgtacggccacaccaacgaggtgctgagcgtgggcatcagcaccgagctggacatggccgtgagcggcagcagagacggcaccgtgatcatccacaccatccccaacctggccatcagctgggagggccacatcgtggtgtacagcagcaccgaggagaagaccaccctgaaggacaagaacgccctgcacctgttcagcatcaacggcaagtacctgggcagccagatcctgaaggagcaggtgagcgacatctgcatcatcggcgagcacatcgtgaccggcagcatccagggcttcctgagcatcagagacctgcacagcctgaacctgagcatcaaccccctggccatgagactgcccatccactgcgtgtgcgtgaccaaggagtacagccacatcctggtgggcctggaggacggcaagctgatcgtggtgggcgtgggcaagcccgccgagatgagaagcggccagctgagcagaaagttctggggcagcagcaagagactgagccagatcagcgccggcgagaccgagtacaacacccaggacagcaagtag

SEQ ID NO: 90730 - DNA, 8085 bp, Artificial Sequence
  Description of Artificial Sequence: Synthetic coding sequence
atggccagcagagagagactgttcgagctgtggatgctgtactgcaccaagaaggaccccgactacctgaagctgtggctggacaccttcgtgagcagctacgagcagttcctggacgtggacttcgagaagctgcccaccagagtggacgacatgccccccggcatcagcctgctgcccgacaacatcctgcaggtgctgagaatccagctgctgcagtgcgtgcagaagatggccgacggcctggaggagcagcagcaggccctgagcatcctgctggtgaagttcttcatcatcctgtgcagaaacctgagcaacgtggaggagatcggcacctgcagctacatcaactacgtgatcaccatgaccaccctgtacatccagcagctgaagagcaagaagaaggagaaggagatggccgaccagacctgcatcgaggagttcgtgatccacgccctggccttctgcgagagcctgtacgacccctacagaaactggagacacagaatcagcggcagaatcctgagcaccgtggagaagagcagacagaagtacaagcccgccagcctgaccgtggagttcgtgcccttcttctaccagtgcttccaggagagcgagcacctgaaggagagcctgaagtgctgcctgctgcacctgttcggcgccatcgtggccggcggccagagaaacgccctgcaggccatcagccccgccaccatggaggtgctgatgagagtgctggccgactgcgacagctgggaggacggcgaccccgaggaggtgggcagaaaggccgagctgaccctgaagtgcctgaccgaggtggtgcacatcctgctgagcagcaacagcgaccagagacaggtggagaccagcaccatcctggagaactacttcaagctgctgaacagcgaccacagcgccctgcccaaccagagaagaagcagacagtgggagaacagattcatcgccctgcagatcaagatgctgaacaccatcaccgccatgctggactgcaccgacagacccgtgctgcaggccatcttcctgaacagcaactgcttcgagcacctgatcagactgctgcagaactgcaaggtgttccagggccagctggactgcctggccatcagcaccatccaggccctgaccgccgtgatgaacaagagccccgccgccaaggaggtgttcaaggagagaatcggctacacccacatgctggaggtgctgaagagcctgggccagccccccctggagctgctgaaggagctgatgaacatggccgtggagggcgaccacaccagcgtgggcatcctgggcatcagcaacgtgcagcccctgctgctgctgatccagtggctgcccgagctgcagagccacgacctgcagatcttcatcagcgactggctgaagagaatctgctgcatcaacagacagagcagaaccacctgcgtgaacgccaacatgggcatcagaatcatcgagaccctggacctgcacagcagcctgcaccagacctgcgccgagaacctgatcgccatccacggcagcctgggcagccagagcgtgagcagcgaggagatcagaagactgctgagactgctgagagtggacgagagcgagagcgtgcacccctacgtgacccccgtgaccagagccatcctgaccatggccagaaagctgagcctggagagcgccctgcagtacttcaacctgagccacagcatggccggcatcagcgtgccccccatccagaagtggcccggcagcgccttcagcttcagcgcctggttctgcctggaccaggaccagctgaccctgggcatcgccaacaagggcggcaagagaaagcagctgtacagcttcttcaccggcagcggcatgggcttcgaggccttcatcacccacagcggcatgctggtggtggccgtgtgcaccaagagagagtacgccaccgtgatgctgcccgaccacagcttctgcgacagcctgtggcacaacatcaccgtggtgcacatgcccggcaagagacccttcggccagagcttcgtgtacatctacgacaacggccagcagaaggtgagcgcccccctgagattccccgccatgaacgagcccttcaccagctgctgcatcggcagcgccggccagagaaccaccacccccccccccagccagatccccgacccccccttcagcagccccatcaccccccacagaaccagcttcggcggcatcctgagcagcgccagctggggcggcaccatcgagaagagcaagctgatcaccaagctgatcagcgccggcacccaggacagcgagtggggctgccccaccagcctggagggccagctgggcagcgtgatcatcttctacgagcccctgcagcccccccaggtgaaggccctgtacctggccggccccaactgcctgagcccctggaagtgccaggagagcgacatggccgacctgcccggcaacatcctgctgtactacaccgccaaggcctgcaagaacagcatctgcctggacctgagcaccaactgcctgcacggcagactgaccggcaacaaggtggtgaactgggacatcaaggacatcatcaactgcatcggcggcctgaacgtgctgttccccctgctggagcagatcagccacttcagcgagggccagatccccgaggagaagaacgagagcaccgtgcccgagagcgtgacccccgtggagggcgactggctggtgtggaccagcaccaaggccagcgagagcagactggagagaaacctggtggccaccttcatcctgatcgtgaagcacttcatccagagacaccccatcaaccagggcaacctgatccacagccacggcgtggccaccctgggcgccctgctgcagaaggtgcccagcaccctgatggacgtgaacgtgctgatggccgtgcagctgctgatcgagcaggtgagcctggagaagaacatgcagctgctgcagcagatgtaccagtacctgctgttcgacttcagaatctggaacagaggcgacttccccttcagaatcggccacatccagtacctgagcaccatcatcaaggacagcagaagagtgttcagaaagaagtacggcgtgcagttcctgctggacaccctgagaatctactacggcaacggctgcaagtacaacgagctgagcctggacgacatcagaaccatcagaaccagcctgtacggcctgatcaagtacttcctgtgcaagggcggcagccacgaggagatccagagcatcatgggctacatcgccgccaccaacgaggaggagcagctgttcggcatcctggacgtgctgttcagcctgctgagaaccagccccaccagaggccagctgttcctgctgctgttcgagcccggcaacgccgacatcctgtacgccctgctgctgaaccagaagtacagcgacagactgagagagatcatcttcaagatcatggagcagatgctgaagtgcaccaacgtgtacgagagaagcaagcagcacatcagactgagagaggtgggctacagcggcctgggcctgctgctgaacgaggccctggtgaacaccagcctgatcaagaacctgacccaccagatcatcaacaccgaccccgtgatcaacttcaaggacctgctgagcgtggtgtacatcagccacagagcccacatcaacgtgagagtggccatctgcagaaaggtgctgcagatcctgcagttccagcccgacgccgcccaccagatcagccagcaggtgggctggcaggacaccctggtgagactgttcctgaaggccaagttcgagaacggcaacaccctgcacaagcacagcagagccgtgctgatgaaggacaacgacaagaacatgagcaccgaggacaccaagaagaacagcgacgagaagaccgacgaggagaagatcaccagcttcgccagcgccaacgtgagcagcgaccagtggagcctggaggacagacacagcctggacagcaacacccccctgttccccgaggacagcagcgtgggcgagctgagcttcaagagcgagaaccaggaggagttctggcacagcaaccccagccacctgagcctggacctgagcggcatcgacagctgcgagatgagcgacagcggcagccaggtgcccgacagcctgcccagcacccccagccccgtggagagcaccaagagcttcagcgtgcacagcgacagagagagcagcatcaccaacgacatgggcttcagcgacgacttcagcctgctggagagccaggagagatgcgaggaggagctgctgcagctgctgacccacatcctgaactacgtgatgtgcaagggcctggagaagagcgacgacgacacctggatcgagagaggccaggtgttcagcgccctgagcaagcccggcatcagcagcgagctgctgagacccagcgacgagatcaagctgaccctgctgcagaagatgctggagtgggccatcagcgagaacagagaggccaagaccaaccccgtgaccgccgagaacgccttcagactggtgctgatcatccaggacttcctgcagagcgagggcctggtgaacagcaacatgtggaccgagaagctgctggaggacatgatgctgctgttcgactgcctgagcgtgtgctacagcgagagccccgtgtgggtgaagctgagccagatccagatccagctgctgctgggcttcatcggcagaggcaacctgcaggtgtgcgccatggccagcgccaagctgaacaccctgctgcagaccaaggtgatcgagaaccaggacgaggcctgctacatcctgggcaagctggagcacgtgctgagccagagcatcaaggagcagaccgagatctacagcttcctgatccccctggtgagaaccctggtgagcaagatctacgagctgctgttcatgaacctgcacctgcccagcctgcccttcaccaacggcagcagcagcttcttcgaggacttccaggagtactgcaacagcaacgagtggcaggtgtacatcgagaagtacatcgtgccctacatgaagcagtacgaggcccacaccttctacgacggccacgagaacatggccctgtactggaaggactgctacgaggccctgatggtgaacatgcacaagagagacagagagggcggcgagagcaagctgaagttccaggagctgttcgtggagcccttcaacagaaaggccagacaggagaacctgagatacaacaacatgctgaagcagctgagcagccagcagctggccaccctgagaagatggaaggccatccagctgtacctgacctgcgagagaggcccctgggccaagagaaagcagaaccccatccactggaagctggccaacgtggagaactacagcagaatgagactgaagctggtgcccaactacaacttcaagacccacgaggaggccagcgccctgagagacaacctgggcatccagcacagccagcccagcagcgacaccctgctgctggaggtggtgaagcaggtgaaggtgagcgacatggtggaggacaagctggacctgcccgaggaggacatcaccgccagagtgaacgtggacgagaaggaggagcaggaccagaaggagaagctggtgctgatggaggactgcgagctgatcaccatcatcgacgtgatccccggcagactggagatcaccacccagcacatctacttctacgacggcagcatcgagaaggaggacggcgtgggcttcgacttcaagtggccccacagccagatcagagagatccacctgagaagatacaacctgagaagaagcgccctggagatcttccacgtggaccagagcaactacttcctgaacttcaagaaggaggtgagaaacaagatctacagcagactgctgagcctgcacagccccaacagctactacggcagcagaagcccccaggagctgttcaaggccagcggcctgacccagaagtgggtgaacagagagatcagcaacttcgactacctgatccagatcaacaccatggccggcagaacctacaacgacctggcccagtaccccgtgttcccctggatcctgcaggactacaccagcgaggagctggacctgaacaaccccgccgtgttcagagacctgagcaagcccatcggcgtggtgaacgagaagaacgccaaggccatgagagagaagtacgagaacttcgaggaccccatgggcaccatcgacaagttccactacggcacccactacagcaacagcgccggcgtgatgcactacctgatcagagtggagcccttcaccaccctgcacatccagctgcagagcggcagattcgactgcgccgacagacagttccacagcatccccgccacctggcaggccctgatggacaacccctacgacgtgaaggagctgatccccgagttcttctacttccccgagttcctggagaaccagaaccagttcaacctgggcagactgcagatcagcaaggagctggtgaacgacgtgatcctgcccaagtgggccaagagcgccgaggacttcatctacaagcacagaaaggccctggagagcgagtacgtgagcgcccacctgcacgagtggatcgacctgatcttcggctacaagcagagaggccccgccgccgtggaggccctgaacgtgttctactactgcagctacgagggcgccgtggacctggacgccctgaccgacgagaaggagagaaaggccctggagggcatgatcaacaacttcggccagaccccctgccagctgctgaaggagccccacccccccagactgagcgccgaggaggccgtgcagaagcccaccaagatcgacaccagcaccctgaacctgttccagcacctgcccgagctgaagagcttcttcatcgagggcatcagcgacggcatccccctgctgaaggccaccatccccaagaaccagtacagaagcttcatgagccagggcagccccgagctgctgatcaccatcagcatgaactacgtgatcggcacccacggctggctgccctacgacagaaacatcagcaactacttcaccttcatcaaggaccagaccgtgaccaaccccaagacccagagaagcatcaacggcagcttcgcccccggcctggagatcaccagcaagctgttcgtggtgagccacgacgccaagctgctgttcagcgccggctactgggacaacagcatccaggtgatgagcctgaccaagggcaagatcatcagccacatcatcagacacatggacatcgtgacctgcctggccaccgactactgcggcatccacctgatcagcggcagcagagacaccacctgcatgatctggcagatcacccagcagggcggcgtgcccgtgggcctggccagcaagcccttccagatcctgtacggccacaccaacgaggtgctgagcgtgggcatcagcaccgagctggacatggccgtgagcggcagcagagacggcaccgtgatcatccacaccatccagaagggccagtacatgagaaccctgagacccccctgcgagagcagcctgttcctgaccatccccaacctggccatcagctgggagggccacatcgtggtgtacagcagcaccgaggagaagaccaccctgaaggacaagaacgccctgcacctgttcagcatcaacggcaagtacctgggcagccagatcctgaaggagcaggtgagcgacatctgcatcatcggcgagcacatcgtgaccggcagcatccagggcttcctgagcatcagagacctgcacagcctgaacctgagcatcaaccccctggccatgagactgcccatccactgcgtgtgcgtgaccaaggagtacagccacatcctggtgggcctggaggacggcaagctgatcgtggtgggcgtgggcaagcccgccgagatgagaagcggccagctgagcagaaagttctggggcagcagcaagagactgagccagatcagcgccggcgagaccgagtacaacacccaggacagcaagtag

SEQ ID NO: 90731 - DNA, 7713 bp, Artificial Sequence
  Description of Artificial Sequence: Synthetic coding sequence
atggccgccagcgagagactgtacgagctgtggctgctgtactacgcccagaaggacctgggctacctgcagcagtggctgaaggccttcgtgggcgccttcaagaagagcatcagcctgagcagcctggagcccagaagacccgaggaggccggcgccgaggtgcccctgctgcccctggacgagctgcacgtgctggccgagcagctgcaccaggccgacctggagcaggccctgctgctgctgaagctgttcatcatcctgtgcagaaacctggagaacatcgaggccggcagaggccaggtgctggtgcccagagtgctggccctgctgaccaagctggtggccgagctgaagggctgcccccccccccagggcagaggcacccagctggagaacgtggccctgcacgccctgctgctgtgcgagggcctgttcgacccctaccagacctggagaagacagagaagcggcgaggtgatcagcagcaaggagaagagcaagtacaagttcccccccgccgccctgccccaggagttcagcgccttcttccaggagagcctgcagaacgccgaccacctgccccccatcctgctgctgagactgatccacctgttctgcgccgtgctggccggcggcaaggagaacggccagatggccgtgagcgacggcagcgtgaagggcctgctgagcgtggtgagaggctggagcagaggccccgcccccgacccctgcctggtgcccctggccctggaggccctggtgggcgccgtgcacgtgctgcacgccagcagagccccccccagaggccccgagctgagagccctgctggagagctacttccacgtgctgaacgccgactggcccgccggcctgagcagcggccccgaggaggccctggtgaccctgagagtgagcatgctggacgccatccccatgatgctggcctgcgaggacagacccgtgctgcaggccaccttcctgagcaacaactgcttcgagcacctgaccagactgatccagaacagcaagctgtacctgcagagcagagccccccccgagggcgacagcgacctggccaccagactgctgaccgagcccgacgtgcagaaggtgctggaccaggacaccgacgccatcgccgtgcacgtggtgagagtgctgacctgcatcatgagcgacagccccagcgccaaggaggtgttcaaggagagaatcggctacccccacctgcaggaggtgctgcagagccacggcccccccacccacagactgctgcaggagctgctgaacatggccgtggagggcgaccacagcatgtgcccccccccccccatcagaaacgagcagcccgtgctggtgctggcccagtggctgcccagcctgcccaccgccgagctgagactgttcctggcccagagactgagatggctgtgcgacagctgccccgccagcagagccacctgcgtgcaggccggcctggtgggctgcctgctggagaccctgagcaccggcctggccctggaggccagatgccaggagcagctgctggccctgctgcaggccctgggcagagtgagcatcagacccatggagctgagacacctgctgagacccagacccggcctggacagcgagcccggcggcgccgaggccggcaaggccagacacgccggcgccgtgatcagaaccctgagcggcatggccagacaccagggccccgccagagccctgagatacttcgacctgacccccagcatggccggcatcatggtgccccccgtgcagagatggcccggccccggcttcaccttccacgcctggctgtgcctgcaccccatggacaccgcccccacccccgcccccaccagacccctgcagagaaagcagctgtacagcttcttcaccagcagcggcagcggcttcgaggccttcttcaccgccgccggcaccctggtggtggccgtgtgcaccagaaaggagtacctgaccatgagcctgcccgaggtgagcttcgccgacagcgcctggcactgcgtggccatcgtgcacgtgcccggcagaagacccttcagccagaacctggtgcacgtgtacaaggacggccacctggtgaagaccgcccccctgagatgccccagcctgagcgagcccttcagcagctgctgcatcggcagcgccggctacagaaccaccaccaccaccaccggcctgcccaccccccccgtgcccgccaccctggcctacacccaccccgccctgaccagaagccagagcgtgcccgccagcaccggcctgggctggggcagcggcctggtggcccccctgcaggagggcagcatcgacagcaccctggccggcacccaggacaccagatggggcagccccaccagcctggagggcgagctgggcgccgtggccatcttccacgaggccctgcaggccaccgccctgagaaccctgtgcaccctgggccccaacgagaccgcccccttcaagcccgagggcgagctgcacgagctgagcaccagactgctgctgcactacagcccccaggcctgcaagaacaacatctgcctggacctgagccccagccacggcctggacggcagactgaccggccacagagtggagacctgggacgtgaaggacgtggtgaactgcgtgggcggcatgggcgccctgctgcccctgctggagagagtggccgcccagcccaaggaggccgaggccggccccgccgagacccacgacctggtgggccccgagctgaccagcggccacaacacccagggcctggtgctgcccctgggcaagagcagcgaggagagaatggagagaaacgccgtggccgccttcctgctgatgctgagaaacttcctgcagggccacatggtgaaccaggagagcctggtgcagtgccagggccccgccatcatcggcgccctgctgagaaaggtgcccagctgggccatggacatgaacgtgctgatgagcgcccagctgctgatggagcaggtggccgccgagggcagcggccccctgctgtacctgctgtaccagcacctgctgttcaacttccacctgtggaccctgagcgacttcgccgtgagactgggccacatccagtacatgagcagcatcgtgagagagcacagacagaagctgagaaagaagtacggcgtgcagttcatcctggacgccctgagaacccactacagcccccagagagagagacccctggccgccgacgacctgagaaccgtgcagaccagcctgctgggcctggccagagagttcctggtgagaagcctgagcgccgacgacgtgcaggtgacccagaccatgctgagcttcctggccgccaccggcgacgacggccagatcctgagaagactgcagcagaacgagagactgcccgagagaagcagacagagactgagactgagagagtgcggcctgcagggcctggtggcctgcctgcccgagggcaccgtgagcccccagctgtgccagggcctgtacaagctgttcctgggcgccggcagcggcaacaccgccggcggcggcggcagcagcggcaccctgacccccgccagccagcccggcacccccagccccctggacggccccagacccttccccgccgcccccggcagacacagcagcagcctgagcaacgtgctggaggacggcagcctgcccgagcccaccatcagcggcgacgacaccagcaacaccagcaacccccagcagaccagcgaggaggagctgtgcaacctgctgaccaacgtgctgttcagcgtgacctggagaggcgtggagggcagcgacgaggccgcctggagagagagaggccaggtgttcagcgtgctgacccagctgggcgccagcgccaccctggtgagaccccccgactgcatcaagagaagcctgctggagatgatgctggagagcgccctgaccgacatcaaggaggcccccgtgggcgtgctggccagcctgacccagcaggccctgtggctgctgagactgctgcaggacttcctgtgcgccgagggccacggcaaccaggagctgtggagcgagaagctgttcgagggcgtgtgcagcctgctggacagactgggcgcctggccccacctggccaacggcaccgccgacctgagagagatggcccagatcggcctgagactggtgctgggctacatcctgctggaggacccccagctgcacgcccaggcctacgtgagactgcacatgctgctgcagaccgccgtgcccgccagaagagaggaggcctgctacgtgctgagcaagctggaggccgccctgggcagagtgctgaacaccagcagcctggagagcgccaccgacgaggccggcagccccctggccgccgccgccgccgccgccgccgccgagagatgcagctggctggtgcccctggtgagaaccctgctggacagagcctacgagcccctgggcctgcagtggggcctgcccagcctgccccccaccaacggcagccccaccttcttcgaggacttccaggccttctgcgccacccccgagtggagacacttcatcgacaagcaggtgcagcccaccatgagccagttcgagatggacacctacgccaagagccacgacctgatgagcggcttctggaacgcctgctacgacatgctgatgagcagcggccagagaagacagtgggagagagcccagagcagaagagccttccaggagctggtgctggagcccgcccagagaagagccagactggagggcctgagatacaccgccgtgctgaagcagcaggccacccagcacagcatggccctgctgcactggggcgccctgtggagacagctggccagcccctgcggcgcctgggccctgagagacacccccatccccagatggaagctgagcagcgccgagacctacagcagaatgagactgaagctggtgcccaaccaccacttcgacccccacctggaggccagcgccctgagagacaacctgggcgaggtgcccctgacccccaccgaggaggccagcctgcccctggccgtgaccaaggaggccaaggtgagcaccccccccgagctgctgcaggaggaccagctgggcgaggacgagctggccgagctggagacccccatggaggccgccgagctggacgagcagagagagaagctggtgctgagcgccgagtgccagctggtgaccgtggtggccgtggtgcccggcctgctggaggtgaccacccagaacgtgtacttctacgacggcagcaccgagagagtggagaccgaggagggcatcggctacgacttcagaagacccctggcccagctgagagaggtgcacctgagaagattcaacctgagaagaagcgccctggagctgttcttcatcgaccaggccaactacttcctgaacttcccctgcaaggtgggcaccacccccgtgagcagccccagccagacccccagaccccagcccggccccatccccccccacacccaggtgagaaaccaggtgtacagctggctgctgagactgagaccccccagccagggctacctgagcagcagaagcccccaggagatgctgagagccagcggcctgacccagaagtgggtgcagagagagatcagcaacttcgagtacctgatgcagctgaacaccatcgccggcagaacctacaacgacctgagccagtaccccgtgttcccctgggtgctgcaggactacgtgagccccaccctggacctgagcaaccccgccgtgttcagagacctgagcaagcccatcggcgtggtgaaccccaagcacgcccagctggtgagagagaagtacgagagcttcgaggaccccgccggcaccatcgacaagttccactacggcacccactacagcaacgccgccggcgtgatgcactacctgatcagagtggagcccttcaccagcctgcacgtgcagctgcagagcggcagattcgactgcagcgacagacagttccacagcgtggccgccgcctggcaggccagactggagagccccgccgacgtgaaggagctgatccccgagttcttctacttccccgacttcctggagaaccagaacggcttcgacctgggctgcctgcagctgaccaacgagaaggtgggcgacgtggtgctgcccccctgggccagcagccccgaggacttcatccagcagcacagacaggccctggagagcgagtacgtgagcgcccacctgcacgagtggatcgacctgatcttcggctacaagcagagaggccccgccgccgaggaggccctgaacgtgttctactactgcacctacgagggcgccgtggacctggaccacgtgaccgacgagagagagagaaaggccctggagggcatcatcagcaacttcggccagaccccctgccagctgctgaaggagccccaccccaccagactgagcgccgaggaggccgcccacagactggccagactggacaccaacagccccagcatcttccagcacctggacgagctgaaggccttcttcgccgaggtggtgagcgacggcgtgcccctggtgctggccctggtgccccacagacagccccacagcttcatcacccagggcagccccgacctgctggtgaccgtgagcgccagcggcctgctgggcacccacagctggctgccctacgacagaaacatcagcaactacttcagcttcagcaaggaccccaccatgggcagccacaagacccagagactgctgagcggcccctgggtgcccggcagcggcgtgagcggccaggccctggccgtggcccccgacggcaagctgctgttcagcggcggccactgggacggcagcctgagagtgaccgccctgcccagaggcaagctgctgagccagctgagctgccacctggacgtggtgacctgcctggccctggacacctgcggcatctacctgatcagcggcagcagagacaccacctgcatggtgtggagactgctgcaccagggcggcctgagcgtgggcctggcccccaagcccgtgcaggtgctgtacggccacggcgccgccgtgagctgcgtggccatcagcaccgagctggacatggccgtgagcggcagcgaggacggcaccgtgatcatccacaccgtgagaagaggccagttcgtggccgccctgagacccctgggcgccaccttccccggccccatcttccacctggccctgggcagcgagggccagatcgtggtgcagagcagcgcctgggagagacccggcgcccaggtgacctacagcctgcacctgtacagcgtgaacggcaagctgagagccagcctgcccctggccgagcagcccaccgccctgaccgtgaccgaggacttcgtgctgctgggcaccgcccagtgcgccctgcacatcctgcagctgaacaccctgctgcccgccgccccccccctgcccatgaaggtggccatcagaagcgtggccgtgaccaaggagagaagccacgtgctggtgggcctggaggacggcaagctgatcgtggtggtggccggccagcccagcgaggtgagaagcagccagttcgccagaaagctgtggagaagcagcagaagaatcagccaggtgagcagcggcgagaccgagtacaaccccaccgaggccagatag

SEQ ID NO: 90732 - DNA, 1848 bp, Artificial Sequence
  Description of Artificial Sequence: Synthetic coding sequence
atggagcccgccctgggccccggcgtgcagaaggacctgggctacctgcagcagtggctgaaggccttcgtgggcgccttcaagaagagcatcagcctgagcagcctggagcccagaagacccgaggaggccggcgccgaggtgcccctgctgcccctggacgagctgcacgtgctggccgagcagctgcaccaggccgacctggagcaggccctgctgctgctgaagctgttcatcatcctgtgcagaaacctggagaacatcgaggccggcagaggccaggtgctggtgcccagagtgctggccctgctgaccaagctggtggccgagctgaagggctgcccccccccccagggcagaggcacccagctggagaacgtggccctgcacgccctgctgctgtgcgagggcctgttcgacccctaccagacctggagaagacagagaagcggcgaggtgatcagcagcaaggagaagagcaagtacaagttcccccccgccgccctgccccaggagttcagcgccttcttccaggagagcctgcagaacgccgaccacctgccccccatcctgctgctgagactgatccacctgttctgcgccgtgctggccggcggcaaggagaacggccagatggccgtgagcgacggcagcgtgaagggcctgctgagcgtggtgagaggctggagcagaggccccgcccccgacccctgcctggtgcccctggccctggaggccctggtgggcgccgtgcacgtgctgcacgccagcagagccccccccagaggccccgagctgagagccctgctggagagctacttccacgtgctgaacgccgactggcccgccggcctgagcagcggccccgaggaggccctggtgaccctgagagtgagcatgctggacgccatccccatgatgctggcctgcgaggacagacccgtgctgcaggccaccttcctgagcaacaactgcttcgagcacctgaccagactgatccagaacagcaaggtgctggaccaggacaccgacgccatcgccgtgcacgtggtgagagtgctgacctgcatcatgagcgacagccccagcgccaaggaggtgttcaaggagagaatcggctacccccacctgcaggaggtgctgcagagccacggcccccccacccacagactgctgcaggagctgctgaacatggccgtggagggcgaccacagcatgtgcccccccccccccatcagaaacgagcagcccgtgctggtgctggcccagtggctgcccagcctgcccaccgccgagctgagactgttcctggcccagagactgagatggctgtgcgacagctgccccgccagcagagccacctgcgtgcaggccggcctggtgggctgcctgctggagaccctgagcaccggcctggccctggaggccagatgccaggagcagctgctggccctgctgcaggccctgggcagagtgagcatcagacccatggagctgagacacctgctgagacccagacccggcctggacagcgagcccggcggcgccgaggccggcaaggccagacacgccggcgccgtgatcagaaccctgagcggcatggccagacaccagggccccgccagagccctgagatacttcgacctgacccccagcatggccggcatcatggtgccccccgtgcagagatggcccggccccggcttcaccttccacgcctggctgtgcctgcaccccatggacaccgcccccacccccgccccccccaccctgcccagcagcggcatcggcggcagatgctaccccctgagagactggagagccgaggtgccccccctggccggctag

SEQ ID NO: 90733 - DNA, 3012 bp, Artificial Sequence
  Description of Artificial Sequence: Synthetic coding sequence
atgagccagttcgagatggacacctacgccaagagccacgacctgatgagcggcttctggaacgcctgctacgacatgctgatgagcagcggccagagaagacagtgggagagagcccagagcagaagagccttccaggagctggtgctggagcccgcccagagaagagccagactggagggcctgagatacaccgccgtgctgaagcagcaggccacccagcacagcatggccctgctgcactggggcgccctgtggagacagctggccagcccctgcggcgcctgggccctgagagacacccccatccccagatggaagctgagcagcgccgagacctacagcagaatgagactgaagctggtgcccaaccaccacttcgacccccacctggaggccagcgccctgagagacaacctgggcgaggtgcccctgacccccaccgaggaggccagcctgcccctggccgtgaccaaggaggccaaggtgagcaccccccccgagctgctgcaggaggaccagctgggcgaggacgagctggccgagctggagacccccatggaggccgccgagctggacgagcagagagagaagctggtgctgagcgccgagtgccagctggtgaccgtggtggccgtggtgcccggcctgctggaggtgaccacccagaacgtgtacttctacgacggcagcaccgagagagtggagaccgaggagggcatcggctacgacttcagaagacccctggcccagctgagagaggtgcacctgagaagattcaacctgagaagaagcgccctggagctgttcttcatcgaccaggccaactacttcctgaacttcccctgcaaggtgggcaccacccccgtgagcagccccagccagacccccagaccccagcccggccccatccccccccacacccaggtgagaaaccaggtgtacagctggctgctgagactgagaccccccagccagggctacctgagcagcagaagcccccaggagatgctgagagccagcggcctgacccagaagtgggtgcagagagagatcagcaacttcgagtacctgatgcagctgaacaccatcgccggcagaacctacaacgacctgagccagtaccccgtgttcccctgggtgctgcaggactacgtgagccccaccctggacctgagcaaccccgccgtgttcagagacctgagcaagcccatcggcgtggtgaaccccaagcacgcccagctggtgagagagaagtacgagagcttcgaggaccccgccggcaccatcgacaagttccactacggcacccactacagcaacgccgccggcgtgatgcactacctgatcagagtggagcccttcaccagcctgcacgtgcagctgcagagcggcagattcgactgcagcgacagacagttccacagcgtggccgccgcctggcaggccagactggagagccccgccgacgtgaaggagctgatccccgagttcttctacttccccgacttcctggagaaccagaacggcttcgacctgggctgcctgcagctgaccaacgagaaggtgggcgacgtggtgctgcccccctgggccagcagccccgaggacttcatccagcagcacagacaggccctggagagcgagtacgtgagcgcccacctgcacgagtggatcgacctgatcttcggctacaagcagagaggccccgccgccgaggaggccctgaacgtgttctactactgcacctacgagggcgccgtggacctggaccacgtgaccgacgagagagagagaaaggccctggagggcatcatcagcaacttcggccagaccccctgccagctgctgaaggagccccaccccaccagactgagcgccgaggaggccgcccacagactggccagactggacaccaacagccccagcatcttccagcacctggacgagctgaaggccttcttcgccgaggtgaccgtgagcgccagcggcctgctgggcacccacagctggctgccctacgacagaaacatcagcaactacttcagcttcagcaaggaccccaccatgggcagccacaagacccagagactgctgagcggcccctgggtgcccggcagcggcgtgagcggccaggccctggccgtggcccccgacggcaagctgctgttcagcggcggccactgggacggcagcctgagagtgaccgccctgcccagaggcaagctgctgagccagctgagctgccacctggacgtggtgacctgcctggccctggacacctgcggcatctacctgatcagcggcagcagagacaccacctgcatggtgtggagactgctgcaccagggcggcctgagcgtgggcctggcccccaagcccgtgcaggtgctgtacggccacggcgccgccgtgagctgcgtggccatcagcaccgagctggacatggccgtgagcggcagcgaggacggcaccgtgatcatccacaccgtgagaagaggccagttcgtggccgccctgagacccctgggcgccaccttccccggccccatcttccacctggccctgggcagcgagggccagatcgtggtgcagagcagcgcctgggagagacccggcgcccaggtgacctacagcctgcacctgtacagcgtgaacggcaagctgagagccagcctgcccctggccgagcagcccaccgccctgaccgtgaccgaggacttcgtgctgctgggcaccgcccagtgcgccctgcacatcctgcagctgaacaccctgctgcccgccgccccccccctgcccatgaaggtggccatcagaagcgtggccgtgaccaaggagagaagccacgtgctggtgggcctggaggacggcaagctgatcgtggtggtggccggccagcccagcgaggtgagaagcagccagttcgccagaaagctgtggagaagcagcagaagaatcagccaggtgagcagcggcgagaccgagtacaaccccaccgaggccagatag

SEQ ID NO: 90734 - DNA, 2094 bp, Artificial Sequence
  Description of Artificial Sequence: Synthetic coding sequence
atgctgagagccagcggcctgacccagaagtgggtgcagagagagatcagcaacttcgagtacctgatgcagctgaacaccatcgccggcagaacctacaacgacctgagccagtaccccgtgttcccctgggtgctgcaggactacgtgagccccaccctggacctgagcaaccccgccgtgttcagagacctgagcaagcccatcggcgtggtgaaccccaagcacgcccagctggtgagagagaagtacgagagcttcgaggaccccgccggcaccatcgacaagttccactacggcacccactacagcaacgccgccggcgtgatgcactacctgatcagagtggagcccttcaccagcctgcacgtgcagctgcagagcggcagattcgactgcagcgacagacagttccacagcgtggccgccgcctggcaggccagactggagagccccgccgacgtgaaggagctgatccccgagttcttctacttccccgacttcctggagaaccagaacggcttcgacctgggctgcctgcagctgaccaacgagaaggtgggcgacgtggtgctgcccccctgggccagcagccccgaggacttcatccagcagcacagacaggccctggagagcgagtacgtgagcgcccacctgcacgagtggatcgacctgatcttcggctacaagcagagaggccccgccgccgaggaggccctgaacgtgttctactactgcacctacgagggcgccgtggacctggaccacgtgaccgacgagagagagagaaaggccctggagggcatcatcagcaacttcggccagaccccctgccagctgctgaaggagccccaccccaccagactgagcgccgaggaggccgcccacagactggccagactggacaccaacagccccagcatcttccagcacctggacgagctgaaggccttcttcgccgaggtggtgagcgacggcgtgcccctggtgctggccctggtgccccacagacagccccacagcttcatcacccagggcagccccgacctgctggtgaccgtgagcgccagcggcctgctgggcacccacagctggctgccctacgacagaaacatcagcaactacttcagcttcagcaaggaccccaccatgggcagccacaagacccagagactgctgagcggcccctgggtgcccggcagcggcgtgagcggccaggccctggccgtggcccccgacggcaagctgctgttcagcggcggccactgggacggcagcctgagagtgaccgccctgcccagaggcaagctgctgagccagctgagctgccacctggacgtggtgacctgcctggccctggacacctgcggcatctacctgatcagcggcagcagagacaccacctgcatggtgtggagactgctgcaccagggcggcctgagcgtgggcctggcccccaagcccgtgcaggtgctgtacggccacggcgccgccgtgagctgcgtggccatcagcaccgagctggacatggccgtgagcggcagcgaggacggcaccgtgatcatccacaccgtgagaagaggccagttcgtggccgccctgagacccctgggcgccaccttccccggccccatcttccacctggccctgggcagcgagggccagatcgtggtgcagagcagcgcctgggagagacccggcgcccaggtgacctacagcctgcacctgtacagcgtgaacggcaagctgagagccagcctgcccctggccgagcagcccaccgccctgaccgtgaccgaggacttcgtgctgctgggcaccgcccagtgcgccctgcacatcctgcagctgaacaccctgctgcccgccgccccccccctgcccatgaaggtggccatcagaagcgtggccgtgaccaaggagagaagccacgtgctggtgggcctggaggacggcaagctgatcgtggtggtggccggccagcccagcgaggtgagaagcagccagttcgccagaaagctgtggagaagcagcagaagaatcagccaggtgagcagcggcgagaccgagtacaaccccaccgaggccagatag

SEQ ID NO: 90735 - DNA, 8265 bp, Artificial Sequence
  Description of Artificial Sequence: Synthetic coding sequence
atggccgccagcgagagactgtacgagctgtggctgctgtactacgcccagaaggacctgggctacctgcagcagtggctgaaggccttcgtgggcgccttcaagaagagcatcagcctgagcagcctggagcccagaagacccgaggaggccggcgccgaggtgcccctgctgcccctggacgagctgcacgtgctggccgagcagctgcaccaggccgacctggagcaggccctgctgctgctgaagctgttcatcatcctgtgcagaaacctggagaacatcgaggccggcagaggccaggtgctggtgcccagagtgctggccctgctgaccaagctggtggccgagctgaagggctgcccccccccccagggcagaggcacccagctggagaacgtggccctgcacgccctgctgctgtgcgagggcctgttcgacccctaccagacctggagaagacagagaagcggcgaggtgatcagcagcaaggagaagagcaagtacaagttcccccccgccgccctgccccaggagttcagcgccttcttccaggagagcctgcagaacgccgaccacctgccccccatcctgctgctgagactgatccacctgttctgcgccgtgctggccggcggcaaggagaacggccagatggccgtgagcgacggcagcgtgaagggcctgctgagcgtggtgagaggctggagcagaggccccgcccccgacccctgcctggtgcccctggccctggaggccctggtgggcgccgtgcacgtgctgcacgccagcagagccccccccagaggccccgagctgagagccctgctggagagctacttccacgtgctgaacgccgactggcccgccggcctgagcagcggccccgaggaggccctggtgaccctgagagtgagcatgctggacgccatccccatgatgctggcctgcgaggacagacccgtgctgcaggccaccttcctgagcaacaactgcttcgagcacctgaccagactgatccagaacagcaagctgtacctgcagagcagagccccccccgagggcgacagcgacctggccaccagactgctgaccgagcccgacgtgcagaaggtgctggaccaggacaccgacgccatcgccgtgcacgtggtgagagtgctgacctgcatcatgagcgacagccccagcgccaaggaggtgttcaaggagagaatcggctacccccacctgcaggaggtgctgcagagccacggcccccccacccacagactgctgcaggagctgctgaacatggccgtggagggcgaccacagcatgtgcccccccccccccatcagaaacgagcagcccgtgctggtgctggcccagtggctgcccagcctgcccaccgccgagctgagactgttcctggcccagagactgagatggctgtgcgacagctgccccgccagcagagccacctgcgtgcaggccggcctggtgggctgcctgctggagaccctgagcaccggcctggccctggaggccagatgccaggagcagctgctggccctgctgcaggccctgggcagagtgagcatcagacccatggagctgagacacctgctgagacccagacccggcctggacagcgagcccggcggcgccgaggccggcaaggccagacacgccggcgccgtgatcagaaccctgagcggcatggccagacaccagggccccgccagagccctgagatacttcgacctgacccccagcatggccggcatcatggtgccccccgtgcagagatggcccggccccggcttcaccttccacgcctggctgtgcctgcaccccatggacaccgcccccacccccgcccccaccagacccctgcagagaaagcagctgtacagcttcttcaccagcagcggcagcggcttcgaggccttcttcaccgccgccggcaccctggtggtggccgtgtgcaccagaaaggagtacctgaccatgagcctgcccgaggtgagcttcgccgacagcgcctggcactgcgtggccatcgtgcacgtgcccggcagaagacccttcagccagaacctggtgcacgtgtacaaggacggccacctggtgaagaccgcccccctgagatgccccagcctgagcgagcccttcagcagctgctgcatcggcagcgccggctacagaaccaccaccaccaccaccggcctgcccaccccccccgtgcccgccaccctggcctacacccaccccgccctgaccagaagccagagcgtgcccgccagcaccggcctgggctggggcagcggcctggtggcccccctgcaggagggcagcatcgacagcaccctggccggcacccaggacaccagatggggcagccccaccagcctggagggcgagctgggcgccgtggccatcttccacgaggccctgcaggccaccgccctgagaaccctgtgcaccctgggccccaacgagaccgcccccttcaagcccgagggcgagctgcacgagctgagcaccagactgctgctgcactacagcccccaggcctgcaagaacaacatctgcctggacctgagccccagccacggcctggacggcagactgaccggccacagagtggagacctgggacgtgaaggacgtggtgaactgcgtgggcggcatgggcgccctgctgcccctgctggagagagtggccgcccagcccaaggaggccgaggccggccccgccgagacccacgacctggtgggccccgagctgaccagcggccacaacacccagggcctggtgctgcccctgggcaagagcagcgaggagagaatggagagaaacgccgtggccgccttcctgctgatgctgagaaacttcctgcagggccacatggtgaaccaggagagcctggtgcagtgccagggccccgccatcatcggcgccctgctgagaaaggtgcccagctgggccatggacatgaacgtgctgatgagcgcccagctgctgatggagcaggtggccgccgagggcagcggccccctgctgtacctgctgtaccagcacctgctgttcaacttccacctgtggaccctgagcgacttcgccgtgagactgggccacatccagtacatgagcagcatcgtgagagagcacagacagaagctgagaaagaagtacggcgtgcagttcatcctggacgccctgagaacccactacagcccccagagagagagacccctggccgccgacgacctgagaaccgtgcagaccagcctgctgggcctggccagagagttcctggtgagaagcctgagcgccgacgacgtgcaggtgacccagaccatgctgagcttcctggccgccaccggcgacgacggccaggccgtgggcgccctggacctgctgctggccctgctgcacggcagcctggtgcaggagagcctggccgtgttcctgctggagcccggcaacctggaggtgctgctggccctgctggtgagacccggcagcctgcccctgctgcccgacagagtgtgcaagatcctgagaagactgcagcagaacgagagactgcccgagagaagcagacagagactgagactgagagagtgcggcctgcagggcctggtggcctgcctgcccgagggcaccgtgagcccccagctgtgccagggcctgtacaagctgttcctgggcgccgactgcctgaacctgagcgacctgctggccgtggtgcagctgagcctgcaggccgacctgagcgtgagactggacatctgcagacagctgttccacctgatctacggccagcccgacgtggtgagactgctggccagacaggccggctggcaggacgtgctgaccagactgtacgtgctggaggccgccaccgccggcagccccccccccagcagccccgagagccccaccagccccaagcccgccccccccaagccccccaccgagagccccgccgagcccagcgacgtgttcctgcccagcgaggccccctgccccgaccccgacggcttctaccacgccctgagccccttctgcacccccttcgacctgggcctggagagaagcagcgtgggcagcggcaacaccgccggcggcggcggcagcagcggcaccctgacccccgccagccagcccggcacccccagccccctggacggccccagacccttccccgccgcccccggcagacacagcagcagcctgagcaacgtgctggaggacggcagcctgcccgagcccaccatcagcggcgacgacaccagcaacaccagcaacccccagcagaccagcgaggaggagctgtgcaacctgctgaccaacgtgctgttcagcgtgacctggagaggcgtggagggcagcgacgaggccgcctggagagagagaggccaggtgttcagcgtgctgacccagctgggcgccagcgccaccctggtgagaccccccgactgcatcaagagaagcctgctggagatgatgctggagagcgccctgaccgacatcaaggaggcccccgtgggcgtgctggccagcctgacccagcaggccctgtggctgctgagactgctgcaggacttcctgtgcgccgagggccacggcaaccaggagctgtggagcgagaagctgttcgagggcgtgtgcagcctgctggacagactgggcgcctggccccacctggccaacggcaccgccgacctgagagagatggcccagatcggcctgagactggtgctgggctacatcctgctggaggacccccagctgcacgcccaggcctacgtgagactgcacatgctgctgcagaccgccgtgcccgccagaagagaggaggcctgctacgtgctgagcaagctggaggccgccctgggcagagtgctgaacaccagcagcctggagagcgccaccgacgaggccggcagccccctggccgccgccgccgccgccgccgccgccgagagatgcagctggctggtgcccctggtgagaaccctgctggacagagcctacgagcccctgggcctgcagtggggcctgcccagcctgccccccaccaacggcagccccaccttcttcgaggacttccaggccttctgcgccacccccgagtggagacacttcatcgacaagcaggtgcagcccaccatgagccagttcgagatggacacctacgccaagagccacgacctgatgagcggcttctggaacgcctgctacgacatgctgatgagcagcggccagagaagacagtgggagagagcccagagcagaagagccttccaggagctggtgctggagcccgcccagagaagagccagactggagggcctgagatacaccgccgtgctgaagcagcaggccacccagcacagcatggccctgctgcactggggcgccctgtggagacagctggccagcccctgcggcgcctgggccctgagagacacccccatccccagatggaagctgagcagcgccgagacctacagcagaatgagactgaagctggtgcccaaccaccacttcgacccccacctggaggccagcgccctgagagacaacctgggcgaggtgcccctgacccccaccgaggaggccagcctgcccctggccgtgaccaaggaggccaaggtgagcaccccccccgagctgctgcaggaggaccagctgggcgaggacgagctggccgagctggagacccccatggaggccgccgagctggacgagcagagagagaagctggtgctgagcgccgagtgccagctggtgaccgtggtggccgtggtgcccggcctgctggaggtgaccacccagaacgtgtacttctacgacggcagcaccgagagagtggagaccgaggagggcatcggctacgacttcagaagacccctggcccagctgagagaggtgcacctgagaagattcaacctgagaagaagcgccctggagctgttcttcatcgaccaggccaactacttcctgaacttcccctgcaaggtgggcaccacccccgtgagcagccccagccagacccccagaccccagcccggccccatccccccccacacccaggtgagaaaccaggtgtacagctggctgctgagactgagaccccccagccagggctacctgagcagcagaagcccccaggagatgctgagagccagcggcctgacccagaagtgggtgcagagagagatcagcaacttcgagtacctgatgcagctgaacaccatcgccggcagaacctacaacgacctgagccagtaccccgtgttcccctgggtgctgcaggactacgtgagccccaccctggacctgagcaaccccgccgtgttcagagacctgagcaagcccatcggcgtggtgaaccccaagcacgcccagctggtgagagagaagtacgagagcttcgaggaccccgccggcaccatcgacaagttccactacggcacccactacagcaacgccgccggcgtgatgcactacctgatcagagtggagcccttcaccagcctgcacgtgcagctgcagagcggcagattcgactgcagcgacagacagttccacagcgtggccgccgcctggcaggccagactggagagccccgccgacgtgaaggagctgatccccgagttcttctacttccccgacttcctggagaaccagaacggcttcgacctgggctgcctgcagctgaccaacgagaaggtgggcgacgtggtgctgcccccctgggccagcagccccgaggacttcatccagcagcacagacaggccctggagagcgagtacgtgagcgcccacctgcacgagtggatcgacctgatcttcggctacaagcagagaggccccgccgccgaggaggccctgaacgtgttctactactgcacctacgagggcgccgtggacctggaccacgtgaccgacgagagagagagaaaggccctggagggcatcatcagcaacttcggccagaccccctgccagctgctgaaggagccccaccccaccagactgagcgccgaggaggccgcccacagactggccagactggacaccaacagccccagcatcttccagcacctggacgagctgaaggccttcttcgccgaggtggtgagcgacggcgtgcccctggtgctggccctggtgccccacagacagccccacagcttcatcacccagggcagccccgacctgctggtgaccgtgagcgccagcggcctgctgggcacccacagctggctgccctacgacagaaacatcagcaactacttcagcttcagcaaggaccccaccatgggcagccacaagacccagagactgctgagcggcccctgggtgcccggcagcggcgtgagcggccaggccctggccgtggcccccgacggcaagctgctgttcagcggcggccactgggacggcagcctgagagtgaccgccctgcccagaggcaagctgctgagccagctgagctgccacctggacgtggtgacctgcctggccctggacacctgcggcatctacctgatcagcggcagcagagacaccacctgcatggtgtggagactgctgcaccagggcggcctgagcgtgggcctggcccccaagcccgtgcaggtgctgtacggccacggcgccgccgtgagctgcgtggccatcagcaccgagctggacatggccgtgagcggcagcgaggacggcaccgtgatcatccacaccgtgagaagaggccagttcgtggccgccctgagacccctgggcgccaccttccccggccccatcttccacctggccctgggcagcgagggccagatcgtggtgcagagcagcgcctgggagagacccggcgcccaggtgacctacagcctgcacctgtacagcgtgaacggcaagctgagagccagcctgcccctggccgagcagcccaccgccctgaccgtgaccgaggacttcgtgctgctgggcaccgcccagtgcgccctgcacatcctgcagctgaacaccctgctgcccgccgccccccccctgcccatgaaggtggccatcagaagcgtggccgtgaccaaggagagaagccacgtgctggtgggcctggaggacggcaagctgatcgtggtggtggccggccagcccagcgaggtgagaagcagccagttcgccagaaagctgtggagaagcagcagaagaatcagccaggtgagcagcggcgagaccgagtacaaccccaccgaggccagatag

SEQ ID NO: 90736 - DNA, 7116 bp, Artificial Sequence
  Description of Artificial Sequence: Synthetic coding sequence
atggccgcccccgagagcggccccgccctgagccccggcaccgccgagggcgaggaggagaccatcctgtacgacctgctggtgaacaccgagtggccccccgagaccgaggtgcagcccagaggcaaccagaagcacggcgccagcttcatcatcaccaaggccatcagagacagactgctgttcctgagacagtacatctggtacagccccgcccccttcctgctgcccgacggcctggtgagactggtgaacaagcagatcaactggcacctggtgctggccagcaacggcaagctgctggccgccgtgcaggaccagtgcgtggagatcagaagcgccaaggacgacttcaccagcatcatcggcaagtgccaggtgcccaaggaccccaagccccagtggagaagagtggcctggagctacgactgcaccctgctggcctacgccgagagcaccggcaccgtgagagtgttcgacctgatgggcagcgagctgttcgtgatcagccccgccagcagcttcatcggcgacctgagctacgccatcgccggcctgatcttcctggagtacaaggccagcgcccagtggagcgccgagctgctggtgatcaactacagaggcgagctgagaagctacctggtgagcgtgggcaccaaccagagctaccaggagagccactgcttcagcttcagcagccactacccccacggcatcaacaccgccatctaccaccccggccacagactgctgctggtgggcggctgcgagaccgccgaggtgggcatgagcaaggccagcagctgcggcctgagcgcctggagagtgctgagcggcagcccctactacaagcaggtgaccaacggcggcgacggcgtgaccgccgtgcccaagaccctgggcctgctgagaatgctgagcgtgaagttctacagcagacagggccaggagcaggacggcatcttcaagatgagcctgagccccgacggcatgctgctggccgccatccacttcagcggcaagctgagcatctgggccatccccagcctgaagcagcagggcgagtggggccagaacgagcagcccggctacgacgacctgaaccccgactggagactgagcaccgagaagagaaagaagatcaaggacaaggagagcttctaccccctgatcgacgtgaactggtgggccgacagcgccgtgaccctggccagatgcagcggcgccctgaccgtgagcagcgtgaagaccctgaagaacctgctgggcaagagctgcgagtggttcgagcccagcccccaggtgaccgccacccacgacggcggcttcctgagcctggagtgcgagatcaagctggcccccaagagaagcagactggagaccagagccggcgaggaggacgagggcgaggaggacagcgacagcgactacgagatcagcgccaaggccagatacttcggctacatcaagcagggcctgtacctggtgaccgagatggagagattcgccccccccagaaagagacccagaaccatcaccaagaactacagactggtgagcctgagaagcaccacccccgaggagctgtaccagagaaagatcgagagcgaggagtacgaggaggccctgagcctggcccacacctacggcctggacaccgacctggtgtaccagagacagtggagaaagagcgccgtgaacgtggccagcatccagaactacctgagcaagatcaagaagagaagctgggtgctgcacgagtgcctggagagagtgcccgagaacgtggacgccgccaaggagctgctgcagtacggcctgaagggcaccgacctggaggccctgctggccatcggcaagggcgccgacgacggcagattcaccctgcccggcgagatcgacatcgacagcatcagctacgaggagctgagcccccccgacgaggagcccgccaagaacaagaaggagaaggagctgaagaagagacaggagctgctgaagctggtgaacttcagcaagctgaccctggagcagaaggagctgtgcagatgcagaagaaagctgctgacctacctggacagactggccacctacgaggagatcctgggcgtgccccacgccagcgagcagagatacgacgccgagttcttcaagaagttcagaaaccagaacatcgtgctgagcgccagaacctacgcccaggagagcaacgtgcaggccctggagatcctgttcacctaccacggcagcgacctgctgccccacagactggccatcctgagcaacttccccgagaccaccagcccccacgagtacagcgtgctgctgcccgaggcctgcttcaacggcgacagcctgatgatcatcccctggcacgagcacaagcacagagccaaggactggtgcgaggagctggcctgcagaatggtggtggagcccaacctgcaggacgagagcgagttcctgtacgccgcccagcccgagctgctgagattcagaatgacccagctgaccgtggagaaggtgatggactggtaccagaccagagccgaggagatcgagcactacgccagacaggtggactgcgccctgagcctgatcagactgggcatggagagaaacatccccggcctgctggtgctgtgcgacaacctggtgaccctggagaccctggtgtacgaggccagatgcgacgtgaccctgaccctgaaggagctgcagcagatgaaggacatcgagaagctgagactgctgatgaacagctgcagcgaggacaagtacgtgaccagcgcctaccagtggatggtgcccttcctgcacagatgcgagaagcagagccccggcgtggccaacgagctgctgaaggagtacctggtgaccctggccaagggcgacctgaagttccccctgaagatcttccagcacagcaagcccgacctgcagcagaagatcatccccgaccaggaccagctgatggccatcgccctggagtgcatctacacctgcgagagaaacgaccagctgtgcctgtgctacgacctgctggagtgcctgcccgagagaggctacggcgacaagaccgaggccaccaccaagctgcacgacatggtggaccagctggagcagatcctgagcgtgagcgagctgctggagaagcacggcctggagaagcccatcagcttcgtgaagaacacccagagcagcagcgaggaggccagaaagctgatggtgagactgaccagacacaccggcagaaagcagccccccgtgagcgagagccactggagaaccctgctgcaggacatgctgaccatgcagcagaacgtgtacacctgcctggacagcgacgcctgctacgagatcttcaccgagagcctgctgtgcagcagcagactggagaacatccacctggccggccagatgatgcactgcagcgcctgcagcgagaacccccccgccggcatcgcccacaagggcaagccccactacagagtgagctacgagaagagcatcgacctggtgctggccgccagcagagagtacttcaacagcagcaccaacctgaccgacagctgcatggacctggccagatgctgcctgcagctgatcaccgacagaccccccgccatccaggaggagctggacctgatccaggccgtgggctgcctggaggagttcggcgtgaagatcctgcccctgcaggtgagactgtgccccgacagaatcagcctgatcaaggagtgcatcagccagagccccacctgctacaagcagagcaccaagctgctgggcctggccgagctgctgagagtggccggcgagaaccccgaggagagaagaggccaggtgctgatcctgctggtggagcaggccctgagattccacgactacaaggccgccagcatgcactgccaggagctgatggccaccggctaccccaagagctgggacgtgtgcagccagctgggccagagcgagggctaccaggacctggccaccagacaggagctgatggccttcgccctgacccactgcccccccagcagcatcgagctgctgctggccgccagcagcagcctgcagaccgagatcctgtaccagagagtgaacttccagatccaccacgagggcggcgagaacatcagcgccagccccctgaccagcaaggccgtgcaggaggacgaggtgggcgtgcccggcagcaacagcgccgacctgctgagatggaccaccgccaccaccatgaaggtgctgagcaacaccaccaccaccaccaaggccgtgctgcaggccgtgagcgacggccagtggtggaagaagagcctgacctacctgagacccctgcagggccagaagtgcggcggcgcctaccagatcggcaccaccgccaacgaggacctggagaagcagggctgccaccccttctacgagagcgtgatcagcaaccccttcgtggccgagagcgagggcacctacgacacctaccagcacgtgcccgtggagagcttcgccgaggtgctgctgagaaccggcaagctggccgaggccaagaacaagggcgaggtgttccccaccaccgaggtgctgctgcagctggccagcgaggccctgcccaacgacatgaccctggccctggcctacctgctggccctgccccaggtgctggacgccaacagatgcttcgagaagcagagccccagcgccctgagcctgcagctggccgcctactactacagcctgcagatctacgccagactggccccctgcttcagagacaagtgccaccccctgtacagagccgaccccaaggagctgatcaagatggtgaccagacacgtgaccagacacgagcacgaggcctggcccgaggacctgatcagcctgaccaagcagctgcactgctacaacgagagactgctggacttcacccaggcccagatcctgcagggcctgagaaagggcgtggacgtgcagagattcaccgccgacgaccagtacaagagagagaccatcctgggcctggccgagaccctggaggagagcgtgtacagcatcgccatcagcctggcccagagatacagcgtgagcagatgggaggtgttcatgacccacctggagttcctgttcaccgacagcggcctgagcaccctggagatcgagaacagagcccaggacctgcacctgttcgagaccctgaagaccgaccccgaggccttccaccagcacatggtgaagtacatctaccccaccatcggcggcttcgaccacgagagactgcagtactacttcaccctgctggagaactgcggctgcgccgacctgggcaactgcgccatcaagcccgagacccacatcagactgctgaagaagttcaaggtggtggccagcggcctgaactacaagaagctgaccgacgagaacatgagccccctggaggccctggagcccgtgctgagcagccagaacatcctgagcatcagcaagctggtgcccaagatccccgagaaggacggccagatgctgagccccagcagcctgtacaccatctggctgcagaagctgttctggaccggcgacccccacctgatcaagcaggtgcccggcagcagccccgagtggctgcacgcctacgacgtgtgcatgaagtacttcgacagactgcaccccggcgacctgatcaccgtggtggacgccgtgaccttcagccccaaggccgtgaccaagctgagcgtggaggccagaaaggagatgaccagaaaggccatcaagaccgtgaagcacttcatcgagaagcccagaaagagaaacagcgaggacgaggcccaggaggccaaggacagcaaggtgacctacgccgacaccctgaaccacctggagaagagcctggcccacctggagaccctgagccacagcttcatcctgagcctgaagaacagcgagcaggagaccctgcagaagtacagccacctgtacgacctgagcagaagcgagaaggagaagctgcacgacgaggccgtggccatctgcctggacggccagcccctggccatgatccagcagctgctggaggtggccgtgggccccctggacatcagccccaaggacatcgtgcagagcgccatcatgaagatcatcagcgccctgagcggcggcagcgccgacctgggcggccccagagaccccctgaaggtgctggagggcgtggtggccgccgtgcacgccagcgtggacaagggcgaggagctggtgagccccgaggacctgctggagtggctgagacccttctgcgccgacgacgcctggcccgtgagacccagaatccacgtgctgcagatcctgggccagagcttccacctgaccgaggaggacagcaagctgctggtgttcttcagaaccgaggccatcctgaaggccagctggccccagagacaggtggacatcgccgacatcgagaacgaggagaacagatactgcctgttcatggagctgctggagagcagccaccacgaggccgagttccagcacctggtgctgctgctgcaggcctggccccccatgaagagcgagtacgtgatcaccaacaacccctgggtgagactggccaccgtgatgctgaccagatgcaccatggagaacaaggagggcctgggcaacgaggtgctgaagatgtgcagaagcctgtacaacaccaagcagatgctgcccgccgagggcgtgaaggagctgtgcctgctgctgctgaaccagagcctgctgctgcccagcctgaagctgctgctggagagcagagacgagcacctgcacgagatggccctggagcagatcaccgccgtgaccaccgtgaacgacagcaactgcgaccaggagctgctgagcctgctgctggacgccaagctgctggtgaagtgcgtgagcacccccttctaccccagaatcgtggaccacctgctggccagcctgcagcagggcagatgggacgccgaggagctgggcagacacctgagagaggccggccacgaggccgaggccggcagcctgctgctggccgtgagaggcacccaccaggccttcagaaccttcagcaccgccctgagagccgcccagcactgggtgtag

SEQ ID NO: 90737 - DNA, 6756 bp, Artificial Sequence
  Description of Artificial Sequence: Synthetic coding sequence
atggccgcccccgagagcggccccgccctgagccccggcaccgccgagggcgaggaggagaccatcctgtacgacctgctggtgaacaccgagtggccccccgagaccgaggtgcagcccagaggcaaccagaagcacggcgccagcttcatcatcaccaaggccatcagagacagactgctgttcctgagacagtacatctggtacagccccgcccccttcctgctgcccgacggcctggtgagactggtgaacaagcagatcaactggcacctggtgctggccagcaacggcaagctgctggccgccgtgcaggaccagtgcgtggagatcagaagcgccaaggacgacttcaccagcatcatcggcaagtgccaggtgcccaaggaccccaagccccagtggagaagagtggcctggagctacgactgcaccctgctggcctacgccgagagcaccggcaccgtgagagtgttcgacctgatgggcagcgagctgttcgtgatcagccccgccagcagcttcatcggcgacctgagctacgccatcgccggcctgatcttcctggagtacaaggccagcgcccagtggagcgccgagctgctggtgatcaactacagaggcgagctgagaagctacctggtgagcgtgggcaccaaccagagctaccaggagagccactgcttcagcttcagcagccactacccccacggcatcaacaccgccatctaccaccccggccacagactgctgctggtgggcggctgcgagaccgccgaggtgggcatgagcaaggccagcagctgcggcctgagcgcctggagagtgctgagcggcagcccctactacaagcaggtgaccaacggcggcgacggcgtgaccgccgtgcccaagaccctgggcctgctgagaatgctgagcgtgaagttctacagcagacagggccaggagcaggacggcatcttcaagatgagcctgagccccgacggcatgctgctggccgccatccacttcagcggcaagctgagcatctgggccatccccagcctgaagcagcagggcgagtggggccagaacgagcagcccggctacgacgacctgaaccccgactggagactgagcaccgagaagagaaagaagatcaaggacaaggagagcttctaccccctgatcgacgtgaactggtgggccgacagcgccgtgaccctggccagatgcagcggcgccctgaccgtgagcagcgtgaagaccctgaagaacctgctgggcaagagctgcgagtggttcgagcccagcccccaggtgaccgccacccacgacggcggcttcctgagcctggagtgcgagatcaagctggcccccaagagaagcagactggagaccagagccggcgaggaggacgagggcgaggaggacagcgacagcgactacgagatcagcgccaaggccagatacttcggctacatcaagcagggcctgtacctggtgaccgagatggagagattcgccccccccagaaagagacccagaaccatcaccaagaactacagactggtgagcctgagaagcaccacccccgaggagctgtaccagagaaagatcgagagcgaggagtacgaggaggccctgagcctggcccacacctacggcctggacaccgacctggtgtaccagagacagtggagaaagagcgccgtgaacgtggccagcatccagaactacctgagcaagatcaagaagagaagctgggtgctgcacgagtgcctggagagagtgcccgagaacgtggacgccgccaaggagctgctgcagtacggcctgaagggcaccgacctggaggccctgctggccatcggcaagggcgccgacgacggcagattcaccctgcccggcgagatcgacatcgacagcatcagctacgaggagctgagcccccccgacgaggagcccgccaagaacaagaaggagaaggagctgaagaagagacaggagctgctgaagctggtgaacttcagcaagctgaccctggagcagaaggagctgtgcagatgcagaagaaagctgctgacctacctggacagactggccacctacgaggagatcctgggcgtgccccacgccagcgagcagagatacgacgccgagttcttcaagaagttcagaaaccagaacatcgtgctgagcgccagaacctacgcccaggagagcaacgtgcaggccctggagatcctgttcacctaccacggcagcgacctgctgccccacagactggccatcctgagcaacttccccgagaccaccagcccccacgagtacagcgtgctgctgcccgaggcctgcttcaacggcgacagcctgatgatcatcccctggcacgagcacaagcacagagccaaggactggtgcgaggagctggcctgcagaatggtggtggagcccaacctgcaggacgagagcgagttcctgtacgccgcccagcccgagctgctgagattcagaatgacccagctgaccgtggagaaggtgatggactggtaccagaccagagccgaggagatcgagcactacgccagacagctgcagcagaagatcatccccgaccaggaccagctgatggccatcgccctggagtgcatctacacctgcgagagaaacgaccagctgtgcctgtgctacgacctgctggagtgcctgcccgagagaggctacggcgacaagaccgaggccaccaccaagctgcacgacatggtggaccagctggagcagatcctgagcgtgagcgagctgctggagaagcacggcctggagaagcccatcagcttcgtgaagaacacccagagcagcagcgaggaggccagaaagctgatggtgagactgaccagacacaccggcagaaagcagccccccgtgagcgagagccactggagaaccctgctgcaggacatgctgaccatgcagcagaacgtgtacacctgcctggacagcgacgcctgctacgagatcttcaccgagagcctgctgtgcagcagcagactggagaacatccacctggccggccagatgatgcactgcagcgcctgcagcgagaacccccccgccggcatcgcccacaagggcaagccccactacagagtgagctacgagaagagcatcgacctggtgctggccgccagcagagagtacttcaacagcagcaccaacctgaccgacagctgcatggacctggccagatgctgcctgcagctgatcaccgacagaccccccgccatccaggaggagctggacctgatccaggccgtgggctgcctggaggagttcggcgtgaagatcctgcccctgcaggtgagactgtgccccgacagaatcagcctgatcaaggagtgcatcagccagagccccacctgctacaagcagagcaccaagctgctgggcctggccgagctgctgagagtggccggcgagaaccccgaggagagaagaggccaggtgctgatcctgctggtggagcaggccctgagattccacgactacaaggccgccagcatgcactgccaggagctgatggccaccggctaccccaagagctgggacgtgtgcagccagctgggccagagcgagggctaccaggacctggccaccagacaggagctgatggccttcgccctgacccactgcccccccagcagcatcgagctgctgctggccgccagcagcagcctgcagaccgagatcctgtaccagagagtgaacttccagatccaccacgagggcggcgagaacatcagcgccagccccctgaccagcaaggccgtgcaggaggacgaggtgggcgtgcccggcagcaacagcgccgacctgctgagatggaccaccgccaccaccatgaaggtgctgagcaacaccaccaccaccaccaaggccgtgctgcaggccgtgagcgacggccagtggtggaagaagagcctgacctacctgagacccctgcagggccagaagtgcggcggcgcctaccagatcggcaccaccgccaacgaggacctggagaagcagggctgccaccccttctacgagagcgtgatcagcaaccccttcgtggccgagagcgagggcacctacgacacctaccagcacgtgcccgtggagagcttcgccgaggtgctgctgagaaccggcaagctggccgaggccaagaacaagggcgaggtgttccccaccaccgaggtgctgctgcagctggccagcgaggccctgcccaacgacatgaccctggccctggcctacctgctggccctgccccaggtgctggacgccaacagatgcttcgagaagcagagccccagcgccctgagcctgcagctggccgcctactactacagcctgcagatctacgccagactggccccctgcttcagagacaagtgccaccccctgtacagagccgaccccaaggagctgatcaagatggtgaccagacacgtgaccagacacgagcacgaggcctggcccgaggacctgatcagcctgaccaagcagctgcactgctacaacgagagactgctggacttcacccaggcccagatcctgcagggcctgagaaagggcgtggacgtgcagagattcaccgccgacgaccagtacaagagagagaccatcctgggcctggccgagaccctggaggagagcgtgtacagcatcgccatcagcctggcccagagatacagcgtgagcagatgggaggtgttcatgacccacctggagttcctgttcaccgacagcggcctgagcaccctggagatcgagaacagagcccaggacctgcacctgttcgagaccctgaagaccgaccccgaggccttccaccagcacatggtgaagtacatctaccccaccatcggcggcttcgaccacgagagactgcagtactacttcaccctgctggagaactgcggctgcgccgacctgggcaactgcgccatcaagcccgagacccacatcagactgctgaagaagttcaaggtggtggccagcggcctgaactacaagaagctgaccgacgagaacatgagccccctggaggccctggagcccgtgctgagcagccagaacatcctgagcatcagcaagctggtgcccaagatccccgagaaggacggccagatgctgagccccagcagcctgtacaccatctggctgcagaagctgttctggaccggcgacccccacctgatcaagcaggtgcccggcagcagccccgagtggctgcacgcctacgacgtgtgcatgaagtacttcgacagactgcaccccggcgacctgatcaccgtggtggacgccgtgaccttcagccccaaggccgtgaccaagctgagcgtggaggccagaaaggagatgaccagaaaggccatcaagaccgtgaagcacttcatcgagaagcccagaaagagaaacagcgaggacgaggcccaggaggccaaggacagcaaggtgacctacgccgacaccctgaaccacctggagaagagcctggcccacctggagaccctgagccacagcttcatcctgagcctgaagaacagcgagcaggagaccctgcagaagtacagccacctgtacgacctgagcagaagcgagaaggagaagctgcacgacgaggccgtggccatctgcctggacggccagcccctggccatgatccagcagctgctggaggtggccgtgggccccctggacatcagccccaaggacatcgtgcagagcgccatcatgaagatcatcagcgccctgagcggcggcagcgccgacctgggcggccccagagaccccctgaaggtgctggagggcgtggtggccgccgtgcacgccagcgtggacaagggcgaggagctggtgagccccgaggacctgctggagtggctgagacccttctgcgccgacgacgcctggcccgtgagacccagaatccacgtgctgcagatcctgggccagagcttccacctgaccgaggaggacagcaagctgctggtgttcttcagaaccgaggccatcctgaaggccagctggccccagagacaggtggacatcgccgacatcgagaacgaggagaacagatactgcctgttcatggagctgctggagagcagccaccacgaggccgagttccagcacctggtgctgctgctgcaggcctggccccccatgaagagcgagtacgtgatcaccaacaacccctgggtgagactggccaccgtgatgctgaccagatgcaccatggagaacaaggagggcctgggcaacgaggtgctgaagatgtgcagaagcctgtacaacaccaagcagatgctgcccgccgagggcgtgaaggagctgtgcctgctgctgctgaaccagagcctgctgctgcccagcctgaagctgctgctggagagcagagacgagcacctgcacgagatggccctggagcagatcaccgccgtgaccaccgtgaacgacagcaactgcgaccaggagctgctgagcctgctgctggacgccaagctgctggtgaagtgcgtgagcacccccttctaccccagaatcgtggaccacctgctggccagcctgcagcagggcagatgggacgccgaggagctgggcagacacctgagagaggccggccacgaggccgaggccggcagcctgctgctggccgtgagaggcacccaccaggccttcagaaccttcagcaccgccctgagagccgcccagcactgggtgtag

SEQ ID NO: 90738 - DNA, 10662 bp, Artificial Sequence
  Description of Artificial Sequence: Synthetic coding sequence
atggtggtgagcgccggcccctggagcagcgagaaggccgagatgaacatcctggagatcaacgagaccctgagaccccagctggccgagaagaagcagcagttcagaaacctgaaggagaagtgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgtacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgaaggagaagctgagagagggcagagacgccagcagaagcctgaacgagcacctgcaggccctgctgaccccctacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcagctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcttcgccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcttcgccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggacgaggaggaggaggaggaccaggaccccccctgccccagactgagcagagagctgctggaggtggtggcccccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcatggccgtggacatggacgagatcgagaagtaccaggaggtggaggaggaccaggaccccagctgccccagactgagcagagagctgctggacgagaaggagcccgaggtgctgcaggacagcctgaacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggacgaggaccaggaccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaaccacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaaccacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaaccacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaaccacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaaccacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccaaggtgctgcaggacagcctggacagatgctacagcacccccagcggctgcctggagctgtgcgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaagggccccgaggtgctgcaggacagcctggacagatgctacagcacccccagcggctgcctggagctgtgcgacagctgccagccctacagaagcgccttctacatcctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgtgcgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacaagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagagagaggtgctgcaggacagcctggacagatgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90739 - DNA, 900 bp, Artificial Sequence
  Description of Artificial Sequence: Synthetic coding sequence
atggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgaaggagaagctgagagagggcagagacgccagcagaagcctgaacgagcacctgcaggccctgctgaccccctacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcagctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaccagcgtgggcagcagcgagaagggcggccccagaggcaacagaagccaggcccagcagggcgccgccggctag

SEQ ID NO: 90740 - DNA, 2010 bp, Artificial Sequence
  Description of Artificial Sequence: Synthetic coding sequence
atggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgaaggagaagctgagagagggcagagacgccagcagaagcctgaacgagcacctgcaggccctgctgaccccctacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcagctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagcagagagctgctggacgagaagggccccgaggtgttccaggacagccaggacagatgctacagcacccccagcggctgcctggagctgaccgacagctgccagccctacagaagcgccttctacatcctggagcagcagagagtgggcctggccatcgacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagagagaggtgctgcaggacagcctggacagatgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90741 - DNA, 2022 bp, Artificial Sequence
  Description of Artificial Sequence: Synthetic coding sequence
atggtggtgagcgccggcccctggagcagcgagaaggccgagatgaacatcctggagatcaacgagaccctgagaccccagctggccgagaagaagcagcagttcagaaacctgaaggagaagtgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgtacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcttcgccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagagagaggtgctgcaggacagcctggacagatgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90742 - DNA, 519 bp, Artificial Sequence
  Description of Artificial Sequence: Synthetic coding sequence
atggccgtggacatcggcagacacagatgggaccaggtgaagaaggaggaccaggaggccaccggccccagcagagagctgctggacgagaagggccccgaggtgttccaggacagccaggacagatgctacagcacccccagcggctgcctggagctgaccgacagctgccagccctacagaagcgccttctacatcctggagcagcagagagtgggcctggccatcgacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagatag

SEQ ID NO: 90743 - DNA, 2295 bp, Artificial Sequence
  Description of Artificial Sequence: Synthetic coding sequence
atgttcagcaacagcaccggcagactgcccggccagcccaccgaggagatccagcagtacaaggtgctggtgcacagccaggagagagagctgacccagctgagagagaagctgagagagggcagagacgccagcagaagcctgtacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgaaggagaagctgagagagggcagagacgccagcagaagcctgaacgagcacctgcaggccctgctgaccccctacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcagctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagcacgtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagatag

SEQ ID NO: 90744 - DNA, 105 bp, Artificial Sequence
  Description of Artificial Sequence: Synthetic coding sequence
atcggcagcagcagccacgtggagtgggaggacgccgtgcacatcatccccgagaacgagagcgacgacgaggaggaggaggagaagggccccgtgagcccctag

SEQ ID NO: 90745 - DNA, 2517 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagcccaagagccacctgagaaagaccaagagcacccagctgagcctggcccaccccctgatgctgaacggcagaatgctgtacaccctgagccagaagatgaaggtgatgatgagaaagagaaagaagaagggccagtgcctgcccggcatctgcagaagcctgaagagaagaaagagccccagaagccccggcatgaaggtgatcagactgagccagttcctgctgaagggccacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 90746 - DNA, 2373 bp, Artificial Sequence
  Description of Artificial Sequence: Synthetic coding sequence
atgttcagcaacagcaccggcagactgcccggccagcccaccgaggagatccagcagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 90747 - DNA, 258 bp, Artificial Sequence
  Description of Artificial Sequence: Synthetic coding sequence
gagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagcccctag

SEQ ID NO: 90748 - DNA, 1101 bp, Artificial Sequence
  Description of Artificial Sequence: Synthetic coding sequence
ctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctgtgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagcgtgctgatggaggtggaggtgcccgaggtgctgcaggacagcctggacagatactacagcacccccagcatgtacttcgagctgcccgacagcttccagcactacagaagcgtgttctacagcttcgaggagcagcacatcagcttcgccctggacatggacaacagattcttcaccctgaccgtgagaagcctgcacctggtgttccagatgggcgtgatcttcccccagtag

SEQ ID NO: 90749 - DNA, 2598 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcatccagccccacaagaacatcaagatcaccttcgaggaggacaaggtgaacagcagcctggtggtggacagagagagcagccacgacggctgccaggacgccctgaacatcctgcccgtgcccggccccaccagcagcgccaccaacgtgagcatggtggtgagcgccggccccctgagcagcgagaaggccgagatgaacatcctggagatcaacgagaagctgtgcccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcgtgtacctgggcctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcgccgcctgctag

SEQ ID NO: 90750 - DNA, 2373 bp, Artificial Sequence
  Description of Artificial Sequence: Synthetic coding sequence
atgttcagcaacagcaccggcagactgcccggccagcccaccgaggagatccagcagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcagctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacaaggtgaacagcagcctggtggtggacagagagtacagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagctgcagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggccgagaaggagcccgaggtgctgcaggacagcctggacagatgctacagcacccccagcgtgtacctgggcctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcaccgcctgctag

SEQ ID NO: 90751 - DNA, 234 bp, Artificial Sequence
  Description of Artificial Sequence: Synthetic coding sequence
atggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggactag

SEQ ID NO: 90752 - DNA, 234 bp, Artificial Sequence
  Description of Artificial Sequence: Synthetic coding sequence
atggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggactag

SEQ ID NO: 90753 - DNA, 234 bp, Artificial Sequence; identical to SEQ ID NO: 90751
  Description of Artificial Sequence: Synthetic coding sequence

SEQ ID NO: 90754 - DNA, 207 bp, Artificial Sequence
  Description of Artificial Sequence: Synthetic coding sequence
gagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatcccctag

SEQ ID NO: 90755 - DNA, 9996 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcagctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacaaggtgaacagcaccgtggtggtggacagaaagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaagcctgaaggagaagtgcttcgtgacccagctggccggcttcctggccaagcagcagaacaagtacaagtacgaggagtgcaaggacctgatcaagagcatgctgagaaacgagctgcagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacgaggacgaggacgaggacgtgcaggtggaggaggacgagaaggtgctggagagcagcagccccagagagatgcagaaggccgaggagagcaaggtgcccgaggacagcctggaggagtgcgccatcacctgcagcaacagccacggcccctgcgacagcaaccagccccacaagaacatcaagatcaccttcgaggaggacaaggtgaacagcagcctggtggtggacagagagtacagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagctgcagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagagactggccagctaccagagctacagcagcaccttccacagcctggaggagcagcaggtgtgcatggccgtggacatcggcagcgagtacagcatcgtgaaggtgatcaagctgcagttcatggcccagagccaggccatgcccgtgcccacctggaccgactgccacgacatcgagctgaaggccggccacagatgggaccaggtgaagaaggaggaccaggaggccaccggccccagactgagcagagagctgctggccgagaaggagcccgaggtgctgcaggacagcctggacagatgctacagcacccccagcgtgtacctgggcctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacaagatcgagaagtaccaggaggtggaggaggaccaggaccccagctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagtaccaggaggtggaggaggaccaggaccccagctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgagcagagagctgctggccgagaaggagcccgaggtgctgcaggacagcctggacagatggtacagcacccccagcgtgtacctgggcctgaccgacccctgccagccctgcagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacagaagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgaacagcgtgctgatggaggtggaggagcccgaggtgctgcaggacagcctggacagatgctacagcacccccagcatgtacttcgagctgcccgacagcttccagcactacagaagcgtgttctacagcttcgaggagcagcacatcaccttcgccctggacatggacaacagcttcttcaccctgaccgtgaccagcctgcacctggtgttccagatgggcgtgatcttcccccagtag

SEQ ID NO: 90756 - DNA, 234 bp, Artificial Sequence; identical to SEQ ID NO: 90751
  Description of Artificial Sequence: Synthetic coding sequence

SEQ ID NO: 90757 - DNA, 2517 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcagaaacctgaaggagagatgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcagctggtgcagaagctgagccccgagaacgacgaggacgaggacgaggacgtgcaggtggaggaggacgagaaggtgctggagagcagcgcccccagagaggtgcagaaggccgaggagagcaaggtgcccgaggacagcctggaggagtgcgccatcacctgcagcaacagccacggcccctgcgacagcaaccagccccacaagaacatcaagatcaccttcgaggaggacaaggtgaacagcagcctggtggtggacagagagtacagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaagcctgaaggagaagtgcttcgtgacccaggtggcctgcttcctggccaagcagcagaacaagtacaagtacgaggagtgcaaggacctgatcaagagcatgctgagaaacgagctgcagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcagccccagagagatgcagaaggccgaggagaaggaggtgcccgaggacagcctggaggagtgcgccatcacctgcagcaacagccacggcccctacgacagcaaccagccccacagaaagcccaagagccacctgagaaagaccaagagcacccagctgagcctggcccaccccctgatgctgaacggcagaatgctgtacaccctgagccagaagatgaaggtgatgatgagaaagagaaagaagaagggccagtgcctgcccggcatctgcagaagcctgaagagaagaaagagccccagaagccccggcatgaaggtgatcagactgagccagttcctgctgaagggccacagatgggaccaggtgaagaaggaggaccaggaggccaccggccccagactgagcagagagctgctggccgagaaggagcccgaggtgctgcaggacagcctggacagatgctacagcacccccagcgtgtacctgggcctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggccgagaaggagcccgaggtgctgcaggacagcctggacagatgctacagcacccccagcggctacctggagctgcccgacctgggccagccctacagaagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccaccgaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcaccgcctgctag

SEQ ID NO: 90758 - DNA, 288 bp, Artificial Sequence
  Description of Artificial Sequence: Synthetic coding sequence
atcgccgagatcgagaagtaccaggaggtggaggaggaccaggaccccagctgccccagactgagcagagagctgctggccgagaaggagcccgaggtgctgcaggacagcctggacagatggtacagcacccccagcggctacctggagctgcccgacctgggccagccctacagaagcgccgtgtacagcctggaggagcagtacctgggcctggccctggacgtggacaagatcgagaagtaccaggaggtggaggaggaccaggaccccagctgccccagatag

SEQ ID NO: 90759 - DNA, 234 bp, Artificial Sequence; identical to SEQ ID NO: 90751
  Description of Artificial Sequence: Synthetic coding sequence

SEQ ID NO: 90760 - DNA, 2784 bp, Artificial Sequence
  Description of Artificial Sequence: Synthetic coding sequence
tgagacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctacaagagctacagcagcaccttccacagcctggaggagcagcaggtgtgcatggccgtggacatcggcagacacagatgggaccaggtgaagaaggaggaccacgaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtgaacatggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacatcctggagcagcagagagtgggcctggccgtggacatggacgagatcgagaagtaccaggaggtggaggaggaccaggaccccagctgccccagactgagcggcgagctgctggacgagaaggagcccgaggtgctgcaggagagcctggacagatgctacagcacccccagcggctgcctggagctgaccgacagctgccagccctacagaagcgccttctacatcctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacagcatgctgatggaggtggaggagcccgaggtgctgcaggacagcctggacatctgctacagcacccccagcatgtacttcgagctgcccgacagcttccagcactacagaagcgtgttctacagcttcgaggaggagcacatcagcttcgccctgtacgtggacaacagattcttcaccctgaccgtgaccagcctgcacctggtgttccagatgggcgtgatcttcccccagtag

SEQ ID NO: 90761 - DNA, 2766 bp, Artificial Sequence
  Description of Artificial Sequence: Synthetic coding sequence
atgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctacaagagctacagcagcaccttccacagcctggaggagcagcaggtgtgcatggccgtggacatcggcagacacagatgggaccaggtgaagaaggaggaccacgaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtgaacatggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacatcctggagcagcagagagtgggcctggccgtggacatggacgagatcgagaagtaccaggaggtggaggaggaccaggaccccagctgccccagactgagcggcgagctgctggacgagaaggagcccgaggtgctgcaggagagcctggacagatgctacagcacccccagcggctgcctggagctgaccgacagctgccagccctacagaagcgccttctacatcctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacagcatgctgatggaggtggaggagcccgaggtgctgcaggacagcctggacatctgctacagcacccccagcatgtacttcgagctgcccgacagcttccagcactacagaagcgtgttctacagcttcgaggaggagcacatcagcttcgccctgtacgtggacaacagattcttcaccctgaccgtgaccagcctgcacctggtgttccagatgggcgtgatcttcccccagtag

SEQ ID NO: 90762 - DNA, 810 bp, Artificial Sequence
  Description of Artificial Sequence: Synthetic coding sequence
atggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacagcatgctgatggaggtggaggagcccgaggtgctgcaggacagcctggacatctgctacagcacccccagcatgtacttcgagctgcccgacagcttccagcactacagaagcgtgttctacagcttcgaggaggagcacatcagcttcgccctgtacgtggacaacagattcttcaccctgaccgtgaccagcctgcacctggtgttccagatgggcgtgatcttcccccagtag

SEQ ID NO: 90763 - DNA, 1539 bp, Artificial Sequence
  Description of Artificial Sequence: Synthetic coding sequence
tgatacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctgcagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctacaagagctacagcagcaccttccacagcctggaggagcagcaggtgtgcatggccgtggacatcggcagacacagatgggaccaggtgaagaaggaggaccacgaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtgaacatggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagctag

SEQ ID NO: 90764 - DNA, 567 bp, Artificial Sequence
  Description of Artificial Sequence: Synthetic coding sequence
atggacgagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgcccctag

SEQ ID NO: 90765 - DNA, 1539 bp, Artificial Sequence; identical to SEQ ID NO: 90763
  Description of Artificial Sequence: Synthetic coding sequence

SEQ ID NO: 90766 - DNA, 1539 bp, Artificial Sequence; identical to SEQ ID NO: 90763
  Description of Artificial Sequence: Synthetic coding sequence

SEQ ID NO: 90767 - DNA, 753 bp, Artificial Sequence
  Description of Artificial Sequence: Synthetic coding sequence
gagatcgagaagtaccaggaggtggaggaggaccaggaccccagctgccccagactgagcagagagctgctggacgagaaggagcccgaggtgctgcaggacagcctgggcagatgctacagcacccccagcggctacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcggcgagctgctggacgagaaggagcccgaggtgctgcaggagagcctggacagatgctacagcacccccagcggctgcctggagctgaccgacagctgccagccctacagaagcgccttctacatcctggagcagcagagagtgggcctggccgtggacatggacggcgagtacctgagcatgtag

SEQ ID NO: 90768 - DNA, 1539 bp, Artificial Sequence; identical to SEQ ID NO: 90763
  Description of Artificial Sequence: Synthetic coding sequence

SEQ ID NO: 90769 - DNA, 1539 bp, Artificial Sequence; identical to SEQ ID NO: 90763
  Description of Artificial Sequence: Synthetic coding sequence

SEQ ID NO: 90770 - DNA, 1539 bp, Artificial Sequence; identical to SEQ ID NO: 90763
  Description of Artificial Sequence: Synthetic coding sequence

SEQ ID NO: 90771 - DNA, 1539 bp, Artificial Sequence; identical to SEQ ID NO: 90763
  Description of Artificial Sequence: Synthetic coding sequence

SEQ ID NO: 90772 - DNA, 2013 bp, Artificial Sequence
  Description of Artificial Sequence: Synthetic coding sequence
atggtggtgagcgccggccccctgagcagcgagaaggccgagatgaacatcctggagatcaacgagaagctgagaccccagctggccgagaagaagcagcagttcagaaacctgaaggagaagtgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactgacccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctgcagcaacagccacggcccctacgacagcaaccagccccacaagaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcggctgcctggagctgaccgacagctgccagccctacagaagcgccttctacgtgctggagcagcagagagtgggcctggccatcgacatggacgagatcgagaagtaccaggaggtggaggaggaccaggaccccagctgccccagactgagcagagagctgctggacgagaaggagcccgaggtgctgcaggacagcctggacagatgctacagcacccccagcgactacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggacgacaaccccccctgccccagactgtacggcgtgctgatggaggtggaggagcccgaggtgctgcaggacagcctggacagatgctacagcacccccagcatgtacttcgagcagcccgacagcttccagcactacagaagcgtgttctacagcttcgaggaggagcacatcagcttcgccctgtacgtggacaacagattcttcaccctgaccgtgaccagcctgcacctggtgttccagatgggcgtgatcttcccccagtag

SEQ ID NO: 90773 - DNA, 2013 bp, Artificial Sequence; identical to SEQ ID NO: 90772
  Description of Artificial Sequence: Synthetic coding sequence

SEQ ID NO: 90774 - DNA, 2013 bp, Artificial Sequence
  Description of Artificial Sequence: Synthetic coding sequence
atggtggtgagcgccggccccctgagcagcgagaaggccgagatgaacatcctggagatcaacgagaagctgagaccccagctggccgagaagaagcagcagttcagaaacctgaaggagaagtgcttcctgacccagctggccggcttcctggccaacagacagaagaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactgacccagcacctggtgcagaagctgagccccgagaacgacaacgacgacgacgaggacgtgcaggtggaggtggccgagaaggtgcagaagagcagcgcccccagagagatgcagaaggccgaggagaaggaggtgcccgaggacagcctggaggagtgcgccatcacctgcagcaacagccacggcccctacgacagcaaccagccccacaagaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaaggagcccgaggtgctgcaggacagcctggacagatgctacagcacccccagcggctgcctggagctgaccgacagctgccagccctacagaagcgccttctacgtgctggagcagcagagagtgggcctggccatcgacatggacgagatcgagaagtaccaggaggtggaggaggaccaggaccccagctgccccagactgagcagagagctgctggacgagaaggagcccgaggtgctgcaggacagcctggacagatgctacagcacccccagcgactacctggagctgcccgacctgggccagccctacagcagcgccgtgtacagcctggaggagcagtacctgggcctggccctggacgtggacagaatcaagaaggaccaggaggaggaggaggaccagggccccccctgccccagactgagcagagagctgctggaggtggtggagcccgaggtgctgcaggacagcctggacagatactacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggacgacaaccccccctgccccagactgaacggcgtgctgatggaggtggaggagcccgaggtgctgcaggacagcctggacagatgctacagcacccagagcatgtacttcgagctgcccgacagcttccagcactacagaagcgtgttctacagcttcgaggaggagcacatcagcttcgccctgtacgtggacaacagattcttcaccctgaccgtgaccagcctgcacctggtgttccagatgggcgtgatcttcccccagtag

SEQ ID NO: 90775 - DNA, 2013 bp, Artificial Sequence; identical to SEQ ID NO: 90774
  Description of Artificial Sequence: Synthetic coding sequence

SEQ ID NO: 90776 - DNA, 2526 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcggcaacctgaaggagagatgcttcgtgacccagctggccggcttcctggccaaccagcagaagaagtacaactacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgaccctggacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgcagaagagcagcgcccccagagaggtgcagaagaccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagctag

SEQ ID NO: 90777 - DNA, 13866 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcggcaacctgaaggagagatgcttcgtgacccagctggccggcttcctggccaaccagcagaagaagtacaactacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgaccctggacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgcagaagagcagcgcccccagagaggtgcagaagaccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgcccgtgcccggccccaccagcagcgccaccaacgtgagcatggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagaatcggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagacccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90778 - DNA, 780 bp, Artificial Sequence
  Description of Artificial Sequence: Synthetic coding sequence
atggtggtgagcgccggcccctggagcagcgagaaggccgagatgaacatcctggagatcaacgagaagctgagaccccagctggccgagaacaagcagcagttcggcaacctgaaggagagatgcttcgtgacccagctggccggcttcctggccaaccagcagaagaagtacaactacgaggagtgcaaggacctgatcaagttcatgctgagaaacgagagacagttcaaggaggagaagctggccgagcagctgaagcaggccgaggagctgagacagtacaaggtgctggtgcacagccaggagagagagctgacccagctgagagagaagctgagagagggcagagacgccagcagaagcctgaacgagcacctgcaggccctgctgaccctggacgagcccgacaagagccagggccaggacctgcaggagcagctggccgagggctgcagactggcccagcacctggtgcagaagctgagccccgagaacgacgaggacgaggacgaggacgtgcaggtggaggaggccgagaaggtgcagaagagcagcgcccccagagaggtgcagaagaccgaggagagcaaggtgcccgaggacagcctggaggagtgcgccatcacctgcagcaacagccacggcccctgcgacagcaaccagccccacaagaacatcaagatcaccttcgaggaggacgaggtgaacagcaccctggtggtggacagagagagcagccacgacgagtgccaggacgccctgaacatcctgccctag

SEQ ID NO: 90779 - DNA, 456 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagacccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggactag

SEQ ID NO: 90780 - DNA, 456 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggactag

SEQ ID NO: 90781 - DNA, 456 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagaagctacagcacccccagcggctgcctggagctgaccgacagctgccagccctacagaagcgccttctacgtgctggagcagcagagagtgggcctggccgtggacatggactag

SEQ ID NO: 90782 - DNA, 456 bp, Artificial Sequence; identical to SEQ ID NO: 90780
  Description of Artificial Sequence: Synthetic coding sequence

SEQ ID NO: 90783 - DNA, 2016 bp, Artificial Sequence
  Description of Artificial Sequence: Synthetic coding sequence
atggtggtgagcgccggccccctgagcagcgagaaggccgagatgaacatcctggagatcaacgagaagctgcacccccagctggccgagaagaagcagcagttcagaaacctgaaggagagatgcttcgtgacccagctggccggcttcctggccaaccagcagaagaagtacaagtacgaggagtgcaaggacctgatcaagagcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacgacgaggacgtgcaggtggagctggccgagaaggtgcagaagagcagcgcccccagagagatgcagaaggccgaggagaaggaggtgcccgaggacagccaggaggagtgcgccatcacctacagcaacagccacggcccctacgacagcaaccagccccacagaaagaccaagatcaccttcgaggaggacaaggtggacagcaccctgatcggcagcagcagccacgtggagtgggaggacgccgtgcacatcatccccgagaacgagagcgacgacgaggaggaggaggagaagggccccgtgagccccagaaacctgcaggagagcgaggaggaggaggtgccccaggagagctgggacgagggctacagcaccctgagcatcccccccgagatgctggccagctaccagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90784 - DNA, 474 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacggcgagtacctgagcatgtag

SEQ ID NO: 90785 - DNA, 681 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggactag

SEQ ID NO: 90786 - DNA, 810 bp, Artificial Sequence
  Description of Artificial Sequence: Synthetic coding sequence
atggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90787 - DNA, 474 bp, Artificial Sequence; identical to SEQ ID NO: 90784
  Description of Artificial Sequence: Synthetic coding sequence

SEQ ID NO: 90788 - DNA, 525 bp, Artificial Sequence
  Description of Artificial Sequence: Synthetic coding sequence
ctgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaagaagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatgggcgtgatcttcccccagtag

SEQ ID NO: 90789 - DNA, 456 bp, Artificial Sequence; identical to SEQ ID NO: 90781
  Description of Artificial Sequence: Synthetic coding sequence

SEQ ID NO: 90790 - DNA, 759 bp, Artificial Sequence
  Description of Artificial Sequence: Synthetic coding sequence
atggacgagatcgagaagtaccaggaggtggaggaggaccaggaccccagctgccccagactgagcagagagctgctggacgagaaggagcccgaggtgctgcaggacagcctggacagatgctacagcacccccagcggctacctggagctgcccgacctgggccagccctacagcagcgccgtgtacagcctggaggagcagtacctgggcctggccctggacgtggacagaaccaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgagcagagagctgctggacgagaagggccccgaggtgctgcaggacagcctggacagatgctacagcacccccagcggctgcctggagctgaccgacagctgccagccctacagaagcgccttctacgtgctggagcagcagagagtgggcctggccgtggacatggacggcgagtacctgagcatgtag

SEQ ID NO: 90791 - DNA, 1734 bp, Artificial Sequence
  Description of Artificial Sequence: Synthetic coding sequence
atggtggtgagcgccggcccctggagcggcgagaaggccgagatgaacatcctggagatcaacaagaagagcagaccccagctggccgagaacaagcagcagttcagaaacctgaagcagaagtgcctggtgacccaggtggcctacttcctggccaacagacagaacaactacgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaaacctgcaggagagcgaggaggaggaggccccccaggagagctgggacgagggcgactggaccctgagcatcccccccgacatgagcgccagctaccagagcgacagaagcaccttccacagcgtggaggagcagcaggtgggcctggccctggacatcggcagacactggtgcgaccaggtgaagaaggaggaccaggaggccaccagccccagactgagcagagagctgctggacgagaaggagcccgaggtgctgcaggacagcctggacagattctacagcacccccttcgagtacctggagctgcccgacctgtgccagccctacagaagcgacttctacagcctgcaggagcagcacctgggcctggccctggacctggacagaatgaagaaggaccaggaggaggaggaggaccagggccccccctgccccagactgagcagagagctgcccgaggtggtggagcccgaggacctgcaggacagcctggacagatggtacagcacccccttcagctaccccgagctgcccgacagctgccagccctacggcagctgcttctacagcctggaggaggagcacgtgggcttcagcctggacgtggacgagatcgagaagtaccaggagggcgaggaggaccagaagcccccctgccccagactgaacgaggtgctgatggaggccgaggagcccgaggtgctgcaggacagcctggacagatgctacagcaccaccagcacctacttccagctgcacgccagcttccagcagtacagaagcgccttctacagcttcgaggagcaggacgtgagcctggccctggacgtggacaacagattcttcaccctgaccgtgatcagacaccacctggccttccagatgggcgtgatcttcccccactag

SEQ ID NO: 90792 - DNA, 1902 bp, Artificial Sequence
  Description of Artificial Sequence: Synthetic coding sequence
atgcccctgacccccaccgtgcagggcttccagtggaccctgagaggccccgacgtggagaccagccccttcggcgcccccagagccgccagccacggcgtgggcagacaccaggagctgagagaccccaccgtgcccggccccaccagcagcgccaccaacgtgagcatggtggtgagcgccggcccctggagcggcgagaaggccgagatgaacatcctggagatcaacaagaagagcagaccccagctggccgagaacaagcagcagttcagaaacctgaagcagaagtgcctggtgacccaggtggcctacttcctggccaacagacagaacaactacgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaaacctgcaggagagcgaggaggaggaggccccccaggagagctgggacgagggcgactggaccctgagcatcccccccgacatgagcgccagctaccagagcgacagaagcaccttccacagcgtggaggagcagcaggtgggcctggccctggacatcggcagacactggtgcgaccaggtgaagaaggaggaccaggaggccaccagccccagactgagcagagagctgctggacgagaaggagcccgaggtgctgcaggacagcctggacagattctacagcacccccttcgagtacctggagctgcccgacctgtgccagccctacagaagcgacttctacagcctgcaggagcagcacctgggcctggccctggacctggacagaatgaagaaggaccaggaggaggaggaggaccagggccccccctgccccagactgagcagagagctgcccgaggtggtggagcccgaggacctgcaggacagcctggacagatggtacagcacccccttcagctaccccgagctgcccgacagctgccagccctacggcagctgcttctacagcctggaggaggagcacgtgggcttcagcctggacgtggacgagatcgagaagtaccaggagggcgaggaggaccagaagcccccctgccccagactgaacgaggtgctgatggaggccgaggagcccgaggtgctgcaggacagcctggacagatgctacagcaccaccagcacctacttccagctgcacgccagcttccagcagtacagaagcgccttctacagcttcgaggagcaggacgtgagcctggccctggacgtggacaacagattcttcaccctgaccgtgatcagacaccacctggccttccagatgggcgtgatcttcccccactag

SEQ ID NO: 90793 - DNA, 1866 bp, Artificial Sequence
  Description of Artificial Sequence: Synthetic coding sequence
atgcccctgacccccaccgtgcagggcttccagtggaccctgagaggccccgacgtggagaccagccccttcggcgcccccagagccgccagccacggcgtgggcagacaccaggagctgagagaccccaccgtgcccggccccaccagcagcgccaccaacgtgagcatggtggtgagcgccggcccctggagcggcgagaaggccgagatgaacatcctggagatcaacaagaagagcagaccccagctggccgagaacaagcagcagttcagaaacctgaagcagaagtgcctggtgacccaggtggcctacttcctggccaacagacagaacaactacgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaagcagcggcagattctgctgcctgatcagcgtgggctacatcttctgccacccctgccccgcctggctgatcagaaacctgcaggagagcgaggaggaggaggccccccaggagagctgggacgagggccactggtgcgaccaggtgaagaaggaggaccaggaggccaccagccccagactgagcagagagctgctggacgagaaggagcccgaggtgctgcaggacagcctggacagattctacagcacccccttcgagtacctggagctgcccgacctgtgccagccctacagaagcgacttctacagcctgcaggagcagcacctgggcctggccctggacctggacagaatgaagaaggaccaggaggaggaggaggaccagggccccccctgccccagactgagcagagagctgcccgaggtggtggagcccgaggacctgcaggacagcctggacagatggtacagcacccccttcagctaccccgagctgcccgacagctgccagccctacggcagctgcttctacagcctggaggaggagcacgtgggcttcagcctggacgtggacgagatcgagaagtaccaggagggcgaggaggaccagaagcccccctgccccagactgaacgaggtgctgatggaggccgaggagcccgaggtgctgcaggacagcctggacagatgctacagcaccaccagcacctacttccagctgcacgccagcttccagcagtacagaagcgccttctacagcttcgaggagcaggacgtgagcctggccctggacgtggacaacagattcttcaccctgaccgtgatcagacaccacctggccttccagatgggcgtgatcttcccccactag

SEQ ID NO: 90794 - DNA, 1062 bp, Artificial Sequence
  Description of Artificial Sequence: Synthetic coding sequence
atggtggtgagcgccggcccctggagcggcgagaaggccgagatgaacatcctggagatcaacaagaagagcagaccccagctggccgagaacaagcagcagttcagaaacctgaagcagaagtgcctggtgacccaggtggcctacttcctggccaacagacagaacaactacgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaaacctgcaggagagcgaggaggaggaggccccccaggagagctgggacgagggcgactggaccctgagcatcccccccgacatgagcgccagctaccagagcgacagaagcaccttccacagcgtggaggagcagcaggtgggcctggccctggacatcggcagacactggtgcgaccaggagaagggcggccccagaggccacaagagccaggcccagcagggcgccgccggctag

SEQ ID NO: 90795 - DNA, 1668 bp, Artificial Sequence
  Description of Artificial Sequence: Synthetic coding sequence
atggtggtgagcgccggcccctggagcggcgagaaggccgagatgaacatcctggagatcaacaagaagagcagaccccagctggccgagaacaagcagcagttcagaaacctgaagcagaagtgcctggtgacccaggtggcctacttcctggccaacagacagaacaactacgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaaacctgcaggagagcgaggaggaggaggccccccaggagagctgggacgagggcgactggaccctgagcatcccccccgacatgagcgccagctaccagagcgacagaagcaccttccacagcgtggaggagcagcaggtgggcctggccctggacatcggcagacactggtgcgaccaggtgaagaaggaggaccaggaggccaccagccccagactgagcagagagctgctggacgagaaggagcccgaggtgctgcaggacagcctggacagattctacagcacccccttcgagtacctggagctgcccgacctgtgccagccctacagaagcgacttctacagcctgcaggagcagcacctgggcctggccctggacctggacagaatgaagaaggaccaggaggaggaggaggaccagggccccccctgccccagactgagcagagagctgcccgaggtggtggagcccgaggacctgcaggacagcctggacagatggtacagcacccccttcagctaccccgagctgcccgacagctgccagccctacggcagctgcttctacagcctggaggaggagcacgtgggcttcagcctggacgtggacgagatcgagaagtaccaggagggcgaggaggaccagaagcccccctgccccagactgaacgaggtgctgatggaggccgaggagcccgaggtgctgcaggacagcctggacagatgctacagcaccaccagcacctacttccagctgcacgccagcttccagcagtacagaagcgccttctacagcttcgaggagcaggacgtgagcctggccctggacgtggacaactag

SEQ ID NO: 90796 - DNA, 1692 bp, Artificial Sequence
  Description of Artificial Sequence: Synthetic coding sequence
atgcccctgacccccaccgtgcagggcttccagtggaccctgagaggccccgacgtggagaccagccccttcggcgcccccagagccgccagccacggcgtgggcagacaccaggagctgagagaccccaccgactacgaggactgcaaggacctgatcaagagcatgctgagagacgagagactgctgaccgaggagaagctggccgaggagctgggccaggccgaggagctgagacagtacaaggtgctggtgcacagccaggagagagagctgacccagctgagagagaagctgcaggagggcagagacgccagcagaagcctgaaccagcacctgcaggccctgctgacccccgacgagcccgacaacagccagggcagagacctgagagagcagctggccgagggctgcagactggcccagcacctggtgcagaagctgagccccgagaacgacgacgacgaggacgaggacgtgaaggtggaggaggccgagaaggtgcaggagctgtacgcccccagagaggtgcagaaggccgaggagaaggaggtgcccgaggacagcctggaggagtgcgccatcacctgcagcaacagccaccacccctgcgagagcaaccagccctacggcaacaccagaatcaccttcgaggaggaccaggtggacagcaccctgatcgacagcagcagccacgacgagtggctggacgccgtgtgcatcatccccgagaacgagagcgaccacgagcaggaggaggagaagggccccgtgagccccagaaacctgcaggagagcgaggaggaggaggccccccaggagagctgggacgagggcgactggaccctgagcatcccccccgacatgagcgccagctaccagagcgacagaagcaccttccacagcgtggaggagcagcaggtgggcctggccctggacatcggcagacactggtgcgaccaggtgaagaaggaggaccaggaggccaccagccccagactgagcagagagctgctggacgagaaggagcccgaggtgctgcaggacagcctggacagattctacagcacccccttcgagtacctggagctgcccgacctgtgccagccctacagaagcgacttctacagcctgcaggagcagcacctgggcctggccctggacctggacagaatgaagaaggaccaggaggaggaggaggaccagggccccccctgccccagactgagcagagagctgcccgaggtggtggagcccgaggacctgcaggacagcctggacagatggtacagcacccccttcagctaccccgagctgcccgacagctgccagccctacggcagctgcttctacagcctggaggaggagcacgtgggcttcagcctggacgtggacgagatcgagaagtaccaggagggcgaggaggaccagaagcccccctgccccagactgaacgaggtgctgatggaggccgaggagcccgaggtgctgcaggacagcctggacagatgctacagcaccaccagcacctacttccagctgcacgccagcttccagcagtacagaagcgccttctacagcttcgaggagcaggacgtgagcctggccctggacgtggacaacagattcttcaccctgaccgtgatcagacaccacctggccttccagatgggcgtgatcttcccccactag

SEQ ID NO: 90797 - DNA, 1917 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacaagtgcgaggagtacaaggacatcatcgacagcgtgctgagagacgagctgcagagcatggagaagctggccgagaagctgagacaggccgaggagctgagacagtacaaggccctggtgcacagccaggccaaggagctgacccagctgagagagaagctgagagagggcagagacgccagcagatggctgaacaagcacctgaagaccctgctgacccccgacgaccccgacaagagccagggccaggacctgagagagcagctggccgagggccacagactggccgagcacctggtgcacaagctgagccccgagaacgacgaggacgaggacgaggacgaggacgacaaggacgaggaggtggagaaggtgcaggagagccccgcccccagagaggtgcagaagaccgaggagaaggaggtgccccaggacagcctggaggagtgcgccgtgacctgcagcaacagccacaaccccagcaacagcaaccagccccacagaagcaccaagatcaccttcaaggagcacgaggtggacagcgccctggtggtggagagcgagcacccccacgacgaggaggaggaggccctgaacatcccccccgagaaccagaacgaccacgaggaggaggagggcaaggcccccgtgccccccagacaccacgacaagagcaacagctacagacacagagaggtgagcttcctggccctggacgagcagaaggtgtgcagcgcccaggacgtggccagagactacagcaaccccaagtgggacgagaccagcctgggcttcctggagaagcagagcgacctggaggaggtgaagggccaggagaccgtggcccccagactgagcagaggccccctgagagtggacaagcacgagatcccccaggagagcctggacggctgctgcctgacccccagcatcctgcccgacctgacccccagctaccacccctactggagcaccctgtacagcttcgaggacaagcaggtgagcctggccctggtggacaagatcaagaaggaccaggaggagatcgaggaccagagccccccctgccccagactgagccaggagctgcccgaggtgaaggagcaggaggtgcccgaggacagcgtgaacgaggtgtacctgacccccagcgtgcaccacgacgtgagcgactgccaccagccctacagcagcaccctgagcagcctggaggaccagctggcctgcagcgccctggacgtggccagccccaccgaggccgcctgcccccagggcacctggagcggcgacctgagccaccaccagagcgaggtgcaggtgagccaggcccagctggagcccagcaccctggtgcccagctgcctgagactgcagctggaccagggcttccactgcggcaacggcctggcccagagaggcctgagcagcaccacctgcagcttcagcgccaacgccgacagcggcaaccagtggcccttccaggagctggtgctggagcccagcctgggcatgaagaaccccccccagctggaggacgacgccctggagggcagcgccagcaacacccagggcagacaggtgaccggcagaatcagagccagcctggtgctgatcctgaagaccatcagaagaagactgcccttcagcaagtggagactggccttcagattcgccggcccccacgccgagagcgccgagatccccaacaccgccggcagaacccagagaatggccggctag

SEQ ID NO: 90798 - DNA, 1917 bp, Artificial Sequence; identical to SEQ ID NO: 90797
  Description of Artificial Sequence: Synthetic coding sequence

SEQ ID NO: 90799 - DNA, 1722 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacaagtgcgaggagtacaaggacatcatcgacagcgtgctgagagacgagctgcagagcatggagaagctggccgagaagctgagacaggccgaggagctgagacagtacaaggccctggtgcacagccaggccaaggagctgacccagctgagagagaagctgagagagggcagagacgccagcagatggctgaacaagcacctgaagaccctgctgacccccgacgaccccgacaagagccagggccaggacctgagagagcagctggccgagggccacagactggccgagcacctggtgcacaagctgagccccgagaacgacgaggacgaggacgaggacgaggacgacaaggacgaggaggtggagaaggtgcaggagagccccgcccccagagaggtgcagaagaccgaggagaaggaggtgccccaggacagcctggaggagtgcgccgtgacctgcagcaacagccacaaccccagcaacagcaaccagccccacagaagcaccaagatcaccttcaaggagcacgaggtggacagcgccctggtggtggagagcgagcacccccacgacgaggaggaggaggccctgaacatcccccccgagaaccagaacgaccacgaggaggaggagggcaaggcccccgtgccccccagaaacagacagagcctggagcccggcgagctgaccaacctgagagacttcctgatcagccccgtggtgagccacgtggccaaccccggccaccacgacaagagcaacagctacagacacagagaggtgagcttcctggccctggacgagcagaaggtgtgcagcgcccaggacgtggccagagactacagcaaccccaagtgggacgagaccagcctgggcttcctggagaagcagagcgacctggaggaggtgaagggccaggagaccgtggcccccagactgagcagaggccccctgagagtggacaagcacgagatcccccaggagagcctggacggctgctgcctgacccccagcatcctgcccgacctgacccccagctaccacccctactggagcaccctgtacagcttcgaggacaagcaggtgagcctggccctggtggacaagatcaagaaggaccaggaggagatcgaggaccagagccccccctgccccagactgagccaggagctgcccgaggtgaaggagcaggaggtgcccgaggacagcgtgaacgaggtgtacctgacccccagcgtgcaccacgacgtgagcgactgccaccagccctacagcagcaccctgagcagcctggaggaccagctggcctgcagcgccctggacgtggccagccccaccgaggccgcctgcccccagggcacctggagcggcgacctgagccaccaccagagcgaggtgcaggtgagccaggcccagctggagcccagcaccctggtgcccagctgcctgagactgcagctggaccagggcttccactgcggcaacggcctggcccagagaggcctgagcagcaccacctgcagcttcagcgccaacgcctag

SEQ ID NO: 90800 - DNA, 372 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacagctgcctgaagtacagaaaccacctgccccccgagagatgcagaagactgaagaagagaaagagcctgagaacccactggagaaacgtgctgagcctggtgcagatcgtgaccaccctgctgacccccaccagcctgaccggcgcccccaagagccacctgagaaacaccaagagcaccctgctgtggctgtag

SEQ ID NO: 90801 - DNA, 2004 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacaagtgcgaggagtacaaggacatcatcgacagcgtgctgagagacgagctgcagagcatggagaagctggccgagaagctgagacaggccgaggagctgagacagtacaaggccctggtgcacagccaggccaaggagctgacccagctgagagagaagctgagagagggcagagacgccagcagatggctgaacaagcacctgaagaccctgctgacccccgacgaccccgacaagagccagggccaggacctgagagagcagctggccgagggccacagactggccgagcacctggtgcacaagctgagccccgagaacgacgaggacgaggacgaggacgaggacgacaaggacgaggaggtggagaaggtgcaggagagccccgcccccagagaggtgcagaagaccgaggagaaggaggtgccccaggacagcctggaggagtgcgccgtgacctgcagcaacagccacaaccccagcaacagcaaccagccccacagaagcaccaagatcaccttcaaggagcacgaggtggacagcgccctggtggtggagagcgagcacccccacgacgaggaggaggaggccctgaacatcccccccgagaaccagaacgaccacgaggaggaggagggcaaggcccccgtgccccccagaaacagacagagcctggagcccggcgagctgaccaacctgagagacttcctgatcagccccgtggtgagccacgtggccaaccccggccaccacgacaagagcaacagctacagacacagagaggtgagcttcctggccctggacgagcagaaggtgtgcagcgcccaggacgtggccagagactacagcaaccccaagtgggacgagaccagcctgggcttcctggagaagcagagcgacctggaggaggtgaagggccaggagaccgtggcccccagactgagcagaggccccctgagagtggacaagcacgagatcccccaggagagcctggacggctgctgcctgacccccagcatcctgcccgacctgacccccagctaccacccctactggagcaccctgtacagcttcgaggacaagcaggtgagcctggccctggtggacaagatcaagaaggaccaggaggagatcgaggaccagagccccccctgccccagactgagccaggagctgcccgaggtgaaggagcaggaggtgcccgaggacagcgtgaacgaggtgtacctgacccccagcgtgcaccacgacgtgagcgactgccaccagccctacagcagcaccctgagcagcctggaggaccagctggcctgcagcgccctggacgtggccagccccaccgaggccgcctgcccccagggcacctggagcggcgacctgagccaccacagaagcgaggtgcagatcagccaggcccagctggagcccagcaccctggtgcccagctgcctgagactgcagctggaccagggcttccactgcggcaacggcctggcccagagaggcctgagcagcaccacctgcagcttcagcgccaacgccgacagcggcaaccagtggcccttccaggagctggtgctggagcccagcctgggcatgaagaaccccccccagctggaggacgacgccctggagggcagcgccagcaacacccagggcagacaggtgaccggcagaatcagagccagcctggtgctgatcctgaagaccatcagaagaagactgcccttcagcaagtggagactggccttcagattcgccggcccccacgccgagagcgccgagatccccaacaccgccgagagaatgcagagaatgatcggctag

SEQ ID NO: 90802 - DNA, 1722 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacaagtgcgaggagtacaaggacatcatcgacagcgtgctgagagacgagctgcagagcatggagaagctggccgagaagctgagacaggccgaggagctgagacagtacaaggccctggtgcacagccaggccaaggagctgacccagctgagagagaagctgagagagggcagagacgccagcagatggctgaacaagcacctgaagaccctgctgacccccgacgaccccgacaagagccagggccaggacctgagagagcagctggccgagggccacagactggccgagcacctggtgcacaagctgagccccgagaacgacgaggacgaggacgaggacgaggacgacaaggacgaggaggtggagaaggtgcaggagagccccgcccccagagaggtgcagaagaccgaggagaaggaggtgccccaggacagcctggaggagtgcgccgtgacctgcagcaacagccacaaccccagcaacagcaaccagccccacagaagcaccaagatcaccttcaaggagcacgaggtggacagcgccctggtggtggagagcgagcacccccacgacgaggaggaggaggccctgaacatcccccccgagaaccagaacgaccacgaggaggaggagggcaaggcccccgtgccccccagaaacagacagagcctggagcccggcgagctgaccaacctgagagacttcctgatcagccccgtggtgagccacgtggccaaccccggccaccacgacaagagcaacagctacagacacagagaggtgagcttcctggccctggacgagcagaaggtgtgcagcgcccaggacgtggccagagactacagcaaccccaagtgggacgagaccagcctgggcttcctggagaagcagagcgacctggaggaggtgaagggccaggagaccgtggcccccagactgagcagaggccccctgagagtggacaagcacgagatcccccaggagagcctggacggctgctgcctgacccccagcatcctgcccgacctgacccccagctaccacccctactggagcaccctgtacagcttcgaggacaagcaggtgagcctggccctggtggacaagatcaagaaggaccaggaggagatcgaggaccagagccccccctgccccagactgagccaggagctgcccgaggtgaaggagcaggaggtgcccgaggacagcgtgaacgaggtgtacctgacccccagcgtgcaccacgacgtgagcgactgccaccagccctacagcagcaccctgagcagcctggaggaccagctggcctgcagcgccctggacgtggccagccccaccgaggccgcctgcccccagggcacctggagcggcgacctgagccaccacagaagcgaggtgcagatcagccaggcccagctggagcccagcaccctggtgcccagctgcctgagactgcagctggaccagggcttccactgcggcaacggcctggcccagagaggcctgagcagcaccacctgcagcttcagcgccaacgcctag

SEQ ID NO: 90803 - DNA, 1917 bp, Artificial Sequence
  Description of Artificial Sequence: Synthetic coding sequence
atggtggtgagcgccgaccccctgagcagcgagagagccgagatgaacatcctggagatcaaccaggagctgagaagccagctggccgagagcaaccagcagttcagagacctgaaggagaagttcctgatcacccaggccaccgcctacagcctggccaaccagctgaagaagtacaagtgcgaggagtacaaggacatcatcgacagcgtgctgagagacgagctgcagagcatggagaagctggccgagaagctgagacaggccgaggagctgagacagtacaaggccctggtgcacagccaggccaaggagctgacccagctgagagagaagctgagagagggcagagacgccagcagatggctgaacaagcacctgaagaccctgctgacccccgacgaccccgacaagagccagggccaggacctgagagagcagctggccgagggccacagactggccgagcacctggtgcacaagctgagccccgagaacgacgaggacgaggacgaggacgaggacgacaaggacgaggaggtggagaaggtgcaggagagccccgcccccagagaggtgcagaagaccgaggagaaggaggtgccccaggacagcctggaggagtgcgccgtgacctgcagcaacagccacaaccccagcaacagcaaccagccccacagaagcaccaagatcaccttcaaggagcacgaggtggacagcgccctggtggtggagagcgagcacccccacgacgaggaggaggaggccctgaacatcccccccgagaaccagaacgaccacgaggaggaggagggcaaggcccccgtgccccccagacaccacgacaagagcaacagctacagacacagagaggtgagcttcctggccctggacgagcagaaggtgtgcagcgcccaggacgtggccagagactacagcaaccccaagtgggacgagaccagcctgggcttcctggagaagcagagcgacctggaggaggtgaagggccaggagaccgtggcccccagactgagcagaggccccctgagagtggacaagcacgagatcccccaggagagcctggacggctgctgcctgacccccagcatcctgcccgacctgacccccagctaccacccctactggagcaccctgtacagcttcgaggacaagcaggtgagcctggccctggtggacaagatcaagaaggaccaggaggagatcgaggaccagagccccccctgccccagactgagccaggagctgcccgaggtgaaggagcaggaggtgcccgaggacagcgtgaacgaggtgtacctgacccccagcgtgcaccacgacgtgagcgactgccaccagccctacagcagcaccctgagcagcctggaggaccagctggcctgcagcgccctggacgtggccagccccaccgaggccgcctgcccccagggcacctggagcggcgacctgagccaccacagaagcgaggtgcagatcagccaggcccagctggagcccagcaccctggtgcccagctgcctgagactgcagctggaccagggcttccactgcggcaacggcctggcccagagaggcctgagcagcaccacctgcagcttcagcgccaacgccgacagcggcaaccagtggcccttccaggagctggtgctggagcccagcctgggcatgaagaaccccccccagctggaggacgacgccctggagggcagcgccagcaacacccagggcagacaggtgaccggcagaatcagagccagcctggtgctgatcctgaagaccatcagaagaagactgcccttcagcaagtggagactggccttcagattcgccggcccccacgccgagagcgccgagatccccaacaccgccgagagaatgcagagaatgatcggctag

SEQ ID NO: 90804 - DNA, 1917 bp, Artificial Sequence; identical to SEQ ID NO: 90803
  Description of Artificial Sequence: Synthetic coding sequence

SEQ ID NO: 90805 - DNA, 624 bp, Artificial Sequence
  Description of Artificial Sequence: Synthetic coding sequence
atgctggccagctacaagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctgtacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccagggcagatgggaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatggaggtgatcttcccccagtag

SEQ ID NO: 90806 - DNA, 1830 bp, Artificial Sequence
  Description of Artificial Sequence: Synthetic coding sequence
cccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaacaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacaacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcccctacgacagcaaccagccccacagaaagaccaagatcaccttcgaggaggacaaggtggacagcaccctgatcggcagcagcagccacgtggagagagaggacgccgtgcacatcatccccgagaacgagagcgacgacgaggaggaggaggagaagggccccgtgagccccagaaacctgcaggagagcgaggaggaggaggtgccccaggagagctgggacgagggctacagcacccccagcatcccccccgagatgctggccagctacaagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctgtacagatgctacagcacccccagcggctacctggagctgcccgacctgggccagccctacagcagcgccgtgtacagcctggaggagcagtacctgggcctggccctggacctggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatggaggtgatcttcccccagtag

SEQ ID NO: 90807 - DNA, 2052 bp, Artificial Sequence
  Description of Artificial Sequence: Synthetic coding sequence
tgacccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaacaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacaacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcccctacgacagcaaccagccccacagaaagaccaagatcaccttcgaggaggacaaggtggacagcaccctgatcggcagcagcagccacgtggagagagaggacgccgtgcacatcatccccgagaacgagagcgacgacgaggaggaggaggagaagggccccgtgagccccagaaacctgcaggagagcgaggaggaggaggtgccccaggagagctgggacgagggctacagcacccccagcatcccccccgagatgctggccagctacaagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctgtacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctgggcagatggtacagcacccccagcggctacctggagctgcccgacctgggccagccctacagcagcgccgtgtacagcctggaggagcagtacctgggcctggccctggacctggacagaatcaagaaggaccaggaggaggaggaggaccagggccccccctgccccagactgagcagagagctgctggaggtggtggagcccgaggtgctgcaggacagcctggacagatgctacagcacccccagcagctgcctggagcagcccgacagctgccagccctacggcagcagcttctacgccctggaggagaagcacgtgggcttcagcctggacgtgggcgagatcgagaagaagggcaagggcaagaagagaagaggcagaagaagcaagaaggagagaagaagaggcagaaaggagggcgaggaggaccagaaccccccctgccccagactgaacggcgtgctgatggaggtggaggagcccgaggtgctgcaggacagcctggacggctgctacagcacccccagcatgtacttcgagctgcccgacagcttccagcactacagaagcgtgttctacagcttcgaggagcagcacatcagcttcgccctgtacgtggacaacagattcttcaccctgaccgtgaccagcctgcacctggtgttccagatggaggtgatcttcccccagtag

SEQ ID NO: 90808 - DNA, 1824 bp, Artificial Sequence
  Description of Artificial Sequence: Synthetic coding sequence
cccgtgcccggccccaccagcagcgccaccaacgtgagcatggtggtgagcgccggccccctgagcagcgagaaggccgagatgaacatcctggagatcaacgagaagctgagaccccagctggccgagaagaagcagcagttcagaaacctgaaggagaagtgcttcctgacccagctgagcggcttcctggccaaccagcagaacaagtacaagtacgaggagtgcaaggacctgatcaagttcatgctgagaaacgagagacagttcaaggaggagaagctggccgagcagctgaagcaggccgaggagctgagacagtacaaggtgctggtgcacgcccaggagagagagctgacccagctgagagagaagctgagagagggcagagacgccagcagaagcctgaacgagcacctgcaggccctgctgacccccgacgagcccgacaagagccagggccaggacctgcaggagcagctggccgagggctgcagactggcccagcacctggtgcagaagctgagccccgagaacgacaacgacgacaacgaggacgtgcaggtggaggtggccgagaaggtgcagaagagcagcgcccccagagagatgcagaaggccgaggagaaggaggtgcccgaggacagcctggaggagtgcgccatcacctacagcaacagccacggcccctacgacagcaaccagccccacagaaagaccaagatcaccttcgaggaggacaaggtggacagcaccctgatcggcagcagcagccacgtggagagagaggacgccgtgcacatcatccccgagaacgagagcgacgacgaggaggaggaggagaagggccccgtgagccccagaaacctgcaggagagcgaggaggaggaggtgccccaggagagctgggacgagggctacagcacccccagcatcccccccgagatgctggccagctacaagagctacagcagcaccttccacagcctggaggagcagcaggtgtgcatggccgtggacatcggcagacacagatgggaccaggtgaagaaggaggaccaggaggccaccggccccagactgagcagagagctgctggacgagaagggccccgaggtgctgcaggacagcctgtacagatgctacagcacccccagcggctgcctggagctgaccgacagctgccagccctacagaagcgccttctacgtgctggagcagcagagagtgggcctggccgtggacatggacgagatcgagaagtaccaggaggtggaggaggaccaggaccccagctgccccagactgagcagagagctgctggacgagaaggagcccgaggtgctgcaggacagcctgggcagatggtacagcacccccagcggctacctggagctgcccgacctgggccagccctacagcagcgccgtgtacagcctggaggagcagtacctgggcctggccctggacctggacagaatcaagaaggaccaggaggaggaggaggaccagggccccccctgccccagactgagcagagagctgctggaggtggtggagcccgaggtgctgcaggacagcctggacgtgatccagctgctgcccgtggtgctgaacagcctgacccccgccagccccatggaggtgcccttcatgcactggagaaagaacatgctggccttcctgctgacctgggagaagctgaagagaagaggcagaggcagaaaggagggcgaggaggaccagagaagaaaggaggagggcgaggagaagaagggcaagaagatcaagacccaccacgcccccggcagcaccgcctgctag

SEQ ID NO: 90809 - DNA, 396 bp, Artificial Sequence
  Description of Artificial Sequence: Synthetic coding sequence
atggccgacgtggtggtgggcaaggacaagggcggcgagcagagactgatcagcctgcccctgagcagaatcagagtgatcatgaagagcagccccgaggtgagcagcatcaaccaggaggccctggtgctgaccgccaaggccaccgagctgttcgtgcagtgcctggccacctacagctacagacacggcagcggcaaggagaagaaggtgctgacctacagcgacctggccaacaccgcccagcagagcgagaccttccagttcctggccgacatcctgcccaagaagatcctggccagcaagtacctgaagatgctgaaggaggagaagagagaggaggacgaggagaacgacaacgacaacgagagcgaccacgacgaggccgacagctag

SEQ ID NO: 90810 - DNA, 582 bp, Artificial Sequence; identical to SEQ ID NO: 83459
  Description of Artificial Sequence: Synthetic coding sequence

SEQ ID NO: 90811 - DNA, 582 bp, Artificial Sequence; identical to SEQ ID NO: 83459
  Description of Artificial Sequence: Synthetic coding sequence

SEQ ID NO: 90812 - DNA, 582 bp, Artificial Sequence; identical to SEQ ID NO: 83459
  Description of Artificial Sequence: Synthetic coding sequence

SEQ ID NO: 90813 - DNA, 582 bp, Artificial Sequence; identical to SEQ ID NO: 83459
  Description of Artificial Sequence: Synthetic coding sequence

SEQ ID NO: 90814 - DNA, 3966 bp, Artificial Sequence
  Description of Artificial Sequence: Synthetic coding sequence
atgggcgcccccttcgtgtgggccctgggcctgctgatgctgcagatgctgctgttcgtggccggcgagcagggcacccaggacatcaccgacgccagcgagagaggcctgcacatgcagaagctgggcagcggcagcgtgcaggccgccctggccgagctggtggccctgccctgcctgttcaccctgcagcccagacccagcgccgccagagacgcccccagaatcaagtggaccaaggtgagaaccgccagcggccagagacaggacctgcccatcctggtggccaaggacaacgtggtgagagtggccaagagctggcagggcagagtgagcctgcccagctaccccagaagaagagccaacgccaccctgctgctgggccccctgagagccagcgacagcggcctgtacagatgccaggtggtgagaggcatcgaggacgagcaggacctggtgcccctggaggtgaccggcgtggtgttccactacagaagcgccagagacagatacgccctgaccttcgccgaggcccaggaggcctgcagactgagcagcgccatcatcgccgcccccagacacctgcaggccgccttcgaggacggcttcgacaactgcgacgccggctggctgagcgacagaaccgtgagataccccatcacccagagcagacccggctgctacggcgacagaagcagcctgcccggcgtgagaagctacggcagaagaaacccccaggagctgtacgacgtgtactgcttcgccagagagctgggcggcgaggtgttctacgtgggccccgccagaagactgaccctggccggcgccagagcccagtgcagaagacagggcgccgccctggccagcgtgggccagctgcacctggcctggcacgagggcctggaccagtgcgaccccggctggctggccgacggcagcgtgagataccccatccagacccccagaagaagatgcggcggccccgcccccggcgtgagaaccgtgtacagattcgccaacagaaccggcttccccagccccgccgagagattcgacgcctactgcttcagagcccaccaccccaccagccagcacggcgacctggagacccccagcagcggcgacgagggcgagatcctgagcgccgagggcccccccgtgagagagctggagcccaccctggaggaggaggaggtggtgacccccgacttccaggagcccctggtgagcagcggcgaggaggagaccctgatcctggaggagaagcaggagagccagcagaccctgagccccacccccggcgaccccatgctggccagctggcccaccggcgaggtgtggctgagcaccgtggcccccagccccagcgacatgggcgccggcaccgccgccagcagccacaccgaggtggcccccaccgaccccatgcccagaagaagaggcagattcaagggcctgaacggcagatacttccagcagcaggagcccgagcccggcctgcagggcggcatggaggccagcgcccagccccccaccagcgaggccgccgtgaaccagatggagccccccctggccatggccgtgaccgagatgctgggcagcggccagagcagaagcccctgggccgacctgaccaacgaggtggacatgcccggcgccggcagcgccggcggcaagagcagccccgagccctggctgtggccccccaccatggtgccccccagcatcagcggccacagcagagcccccgtgctggagctggagaaggccgagggccccagcgccagacccgccacccccgacctgttctggagccccctggaggccaccgtgagcgcccccagccccgccccctgggaggccttccccgtggccaccagccccgacctgcccatgatggccatgctgagaggccccaaggagtggatgctgccccaccccacccccatcagcaccgaggccaacagagtggaggcccacggcgaggccaccgccaccgccccccccagccccgccgccgagaccaaggtgtacagcctgcccctgagcctgacccccaccggccagggcggcgaggccatgcccaccacccccgagagccccagagccgacttcagagagaccggcgagaccagccccgcccaggtgaacaaggccgagcacagcagcagcagcccctggcccagcgtgaacagaaacgtggccgtgggcttcgtgcccaccgagaccgccaccgagcccaccggcctgagaggcatccccggcagcgagagcggcgtgttcgacaccgccgagagccccaccagcggcctgcaggccaccgtggacgaggtgcaggacccctggcccagcgtgtacagcaagggcctggacgccagcagccccagcgcccccctgggcagccccggcgtgttcctggtgcccaaggtgacccccaacctggagccctgggtggccaccgacgagggccccaccgtgaaccccatggacagcaccgtgacccccgcccccagcgacgccagcggcatctgggagcccggcagccaggtgttcgaggaggccgagagcaccaccctgagcccccaggtggccctggacaccagcatcgtgacccccctgaccaccctggagcagggcgacaaggtgggcgtgcccgccatgagcaccctgggcagcagcagcagccagccccaccccgagcccgaggaccaggtggagacccagggcaccagcggcgccagcgtgcccccccaccagagcagccccctgggcaagcccgccgtgccccccggcacccccaccgccgccagcgtgggcgagagcgccagcgtgagcagcggcgagcccaccgtgccctgggaccccagcagcaccctgctgcccgtgaccctgggcatcgaggacttcgagctggaggtgctggccggcagccccggcgtggagagcttctgggaggaggtggccagcggcgaggagcccgccctgcccggcacccccatgaacgccggcgccgaggaggtgcacagcgacccctgcgagaacaacccctgcctgcacggcggcacctgcaacgccaacggcaccatgtacggctgcagctgcgaccagggcttcgccggcgagaactgcgagatcgacatcgacgactgcctgtgcagcccctgcgagaacggcggcacctgcatcgacgaggtgaacggcttcgtgtgcctgtgcctgcccagctacggcggcagcttctgcgagaaggacaccgagggctgcgacagaggctggcacaagttccagggccactgctacagatacttcgcccacagaagagcctgggaggacgccgagaaggactgcagaagaagaagcggccacctgaccagcgtgcacagccccgaggagcacagcttcatcaacagcttcggccacgagaacacctggatcggcctgaacgacagaatcgtggagagagacttccagtggaccgacaacaccggcctgcagttcgagaactggagagagaaccagcccgacaacttcttcgccggcggcgaggactgcgtggtgatggtggcccacgagagcggcagatggaacgacgtgccctgcaactacaacctgccctacgtgtgcaagaagggcaccgtgctgtgcggccccccccccgccgtggagaacgccagcctgatcggcgccagaaaggccaagtacaacgtgcacgccaccgtgagataccagtgcaacgagggcttcgcccagcaccacgtggccaccatcagatgcagaagcaacggcaagtgggacagaccccagatcgtgtgcaccaagcccagaagaagccacagaatgagaagacaccaccaccaccaccagcaccaccaccagcaccaccaccacaagagcagaaaggagagaagaaagcacaagaagcaccccaccgaggactgggagaaggacgagggcaacttctgctag

SEQ ID NO: 90815 - DNA, 2319 bp, Artificial Sequence
  Description of Artificial Sequence: Synthetic coding sequence
atgcccggcgccggcagcgccggcggcaagagcagccccgagccctggctgtggccccccaccatggtgccccccagcatcagcggccacagcagagcccccgtgctggagctggagaaggccgagggccccagcgccagacccgccacccccgacctgttctggagccccctggaggccaccgtgagcgcccccagccccgccccctgggaggccttccccgtggccaccagccccgacctgcccatgatggccatgctgagaggccccaaggagtggatgctgccccaccccacccccatcagcaccgaggccaacagagtggaggcccacggcgaggccaccgccaccgccccccccagccccgccgccgagaccaaggtgtacagcctgcccctgagcctgacccccaccggccagggcggcgaggccatgcccaccacccccgagagccccagagccgacttcagagagaccggcgagaccagccccgcccaggtgaacaaggccgagcacagcagcagcagcccctggcccagcgtgaacagaaacgtggccgtgggcttcgtgcccaccgagaccgccaccgagcccaccggcctgagaggcatccccggcagcgagagcggcgtgttcgacaccgccgagagccccaccagcggcctgcaggccaccgtggacgaggtgcaggacccctggcccagcgtgtacagcaagggcctggacgccagcagccccagcgcccccctgggcagccccggcgtgttcctggtgcccaaggtgacccccaacctggagccctgggtggccaccgacgagggccccaccgtgaaccccatggacagcaccgtgacccccgcccccagcgacgccagcggcatctgggagcccggcagccaggtgttcgaggaggccgagagcaccaccctgagcccccaggtggccctggacaccagcatcgtgacccccctgaccaccctggagcagggcgacaaggtgggcgtgcccgccatgagcaccctgggcagcagcagcagccagccccaccccgagcccgaggaccaggtggagacccagggcaccagcggcgccagcgtgcccccccaccagagcagccccctgggcaagcccgccgtgccccccggcacccccaccgccgccagcgtgggcgagagcgccagcgtgagcagcggcgagcccaccgtgccctgggaccccagcagcaccctgctgcccgtgaccctgggcatcgaggacttcgagctggaggtgctggccggcagccccggcgtggagagcttctgggaggaggtggccagcggcgaggagcccgccctgcccggcacccccatgaacgccggcgccgaggaggtgcacagcgacccctgcgagaacaacccctgcctgcacggcggcacctgcaacgccaacggcaccatgtacggctgcagctgcgaccagggcttcgccggcgagaactgcgagatcgacatcgacgactgcctgtgcagcccctgcgagaacggcggcacctgcatcgacgaggtgaacggcttcgtgtgcctgtgcctgcccagctacggcggcagcttctgcgagaaggacaccgagggctgcgacagaggctggcacaagttccagggccactgctacagatacttcgcccacagaagagcctgggaggacgccgagaaggactgcagaagaagaagcggccacctgaccagcgtgcacagccccgaggagcacagcttcatcaacagcttcggccacgagaacacctggatcggcctgaacgacagaatcgtggagagagacttccagtggaccgacaacaccggcctgcagttcgagaactggagagagaaccagcccgacaacttcttcgccggcggcgaggactgcgtggtgatggtggcccacgagagcggcagatggaacgacgtgccctgcaactacaacctgccctacgtgtgcaagaagggcaccgtgctgtgcggccccccccccgccgtggagaacgccagcctgatcggcgccagaaaggccaagtacaacgtgcacgccaccgtgagataccagtgcaacgagggcttcgcccagcaccacgtggccaccatcagatgcagaagcaacggcaagtgggacagaccccagatcgtgtgcaccaagcccagaagaagccacagaatgagaagacaccaccaccaccaccagcaccaccaccagcaccaccaccacaagagcagaaaggagagaagaaagcacaagaagcaccccaccgaggactgggagaaggacgagggcaacttctgctag

SEQ ID NO: 90816 - DNA, 4008 bp, Artificial Sequence
  Description of Artificial Sequence: Synthetic coding sequence
agaccccccagagacgccagcgagctgggcgccagaagcagaatgggcgcccccttcgtgtgggccctgggcctgctgatgctgcagatgctgctgttcgtggccggcgagcagggcacccaggacatcaccgacgccagcgagagaggcctgcacatgcagaagctgggcagcggcagcgtgcaggccgccctggccgagctggtggccctgccctgcctgttcaccctgcagcccagacccagcgccgccagagacgcccccagaatcaagtggaccaaggtgagaaccgccagcggccagagacaggacctgcccatcctggtggccaaggacaacgtggtgagagtggccaagagctggcagggcagagtgagcctgcccagctaccccagaagaagagccaacgccaccctgctgctgggccccctgagagccagcgacagcggcctgtacagatgccaggtggtgagaggcatcgaggacgagcaggacctggtgcccctggaggtgaccggcgtggtgttccactacagaagcgccagagacagatacgccctgaccttcgccgaggcccaggaggcctgcagactgagcagcgccatcatcgccgcccccagacacctgcaggccgccttcgaggacggcttcgacaactgcgacgccggctggctgagcgacagaaccgtgagataccccatcacccagagcagacccggctgctacggcgacagaagcagcctgcccggcgtgagaagctacggcagaagaaacccccaggagctgtacgacgtgtactgcttcgccagagagctgggcggcgaggtgttctacgtgggccccgccagaagactgaccctggccggcgccagagcccagtgcagaagacagggcgccgccctggccagcgtgggccagctgcacctggcctggcacgagggcctggaccagtgcgaccccggctggctggccgacggcagcgtgagataccccatccagacccccagaagaagatgcggcggccccgcccccggcgtgagaaccgtgtacagattcgccaacagaaccggcttccccagccccgccgagagattcgacgcctactgcttcagagcccaccaccccaccagccagcacggcgacctggagacccccagcagcggcgacgagggcgagatcctgagcgccgagggcccccccgtgagagagctggagcccaccctggaggaggaggaggtggtgacccccgacttccaggagcccctggtgagcagcggcgaggaggagaccctgatcctggaggagaagcaggagagccagcagaccctgagccccacccccggcgaccccatgctggccagctggcccaccggcgaggtgtggctgagcaccgtggcccccagccccagcgacatgggcgccggcaccgccgccagcagccacaccgaggtggcccccaccgaccccatgcccagaagaagaggcagattcaagggcctgaacggcagatacttccagcagcaggagcccgagcccggcctgcagggcggcatggaggccagcgcccagccccccaccagcgaggccgccgtgaaccagatggagccccccctggccatggccgtgaccgagatgctgggcagcggccagagcagaagcccctgggccgacctgaccaacgaggtggacatgcccggcgccggcagcgccggcggcaagagcagccccgagccctggctgtggccccccaccatggtgccccccagcatcagcggccacagcagagcccccgtgctggagctggagaaggccgagggccccagcgccagacccgccacccccgacctgttctggagccccctggaggccaccgtgagcgcccccagccccgccccctgggaggccttccccgtggccaccagccccgacctgcccatgatggccatgctgagaggccccaaggagtggatgctgccccaccccacccccatcagcaccgaggccaacagagtggaggcccacggcgaggccaccgccaccgccccccccagccccgccgccgagaccaaggtgtacagcctgcccctgagcctgacccccaccggccagggcggcgaggccatgcccaccacccccgagagccccagagccgacttcagagagaccggcgagaccagccccgcccaggtgaacaaggccgagcacagcagcagcagcccctggcccagcgtgaacagaaacgtggccgtgggcttcgtgcccaccgagaccgccaccgagcccaccggcctgagaggcatccccggcagcgagagcggcgtgttcgacaccgccgagagccccaccagcggcctgcaggccaccgtggacgaggtgcaggacccctggcccagcgtgtacagcaagggcctggacgccagcagccccagcgcccccctgggcagccccggcgtgttcctggtgcccaaggtgacccccaacctggagccctgggtggccaccgacgagggccccaccgtgaaccccatggacagcaccgtgacccccgcccccagcgacgccagcggcatctgggagcccggcagccaggtgttcgaggaggccgagagcaccaccctgagcccccaggtggccctggacaccagcatcgtgacccccctgaccaccctggagcagggcgacaaggtgggcgtgcccgccatgagcaccctgggcagcagcagcagccagccccaccccgagcccgaggaccaggtggagacccagggcaccagcggcgccagcgtgcccccccaccagagcagccccctgggcaagcccgccgtgccccccggcacccccaccgccgccagcgtgggcgagagcgccagcgtgagcagcggcgagcccaccgtgccctgggaccccagcagcaccctgctgcccgtgaccctgggcatcgaggacttcgagctggaggtgctggccggcagccccggcgtggagagcttctgggaggaggtggccagcggcgaggagcccgccctgcccggcacccccatgaacgccggcgccgaggaggtgcacagcgacccctgcgagaacaacccctgcctgcacggcggcacctgcaacgccaacggcaccatgtacggctgcagctgcgaccagggcttcgccggcgagaactgcgagatcgacatcgacgactgcctgtgcagcccctgcgagaacggcggcacctgcatcgacgaggtgaacggcttcgtgtgcctgtgcctgcccagctacggcggcagcttctgcgagaaggacaccgagggctgcgacagaggctggcacaagttccagggccactgctacagatacttcgcccacagaagagcctgggaggacgccgagaaggactgcagaagaagaagcggccacctgaccagcgtgcacagccccgaggagcacagcttcatcaacagcttcggccacgagaacacctggatcggcctgaacgacagaatcgtggagagagacttccagtggaccgacaacaccggcctgcagttcgagaactggagagagaaccagcccgacaacttcttcgccggcggcgaggactgcgtggtgatggtggcccacgagagcggcagatggaacgacgtgccctgcaactacaacctgccctacgtgtgcaagaagggcaccgtgctgtgcggccccccccccgccgtggagaacgccagcctgatcggcgccagaaaggccaagtacaacgtgcacgccaccgtgagataccagtgcaacgagggcttcgcccagcaccacgtggccaccatcagatgcagaagcaacggcaagtgggacagaccccagatcgtgtgcaccaagcccagaagaagccacagaatgagaagacaccaccaccaccaccagcaccaccaccagcaccaccaccacaagagcagaaaggagagaagaaagcacaagaagcaccccaccgaggactgggagaaggacgagggcaacttctgctag

SEQ ID NO: 90817 - DNA, 2190 bp, Artificial Sequence
  Description of Artificial Sequence: Synthetic coding sequence
atgagctgctgcgacctggccgccgccggccagctgggcaaggccagcatcatggccagcgactgcgagcccgccctgaaccaggccgagggcagaaaccccaccctggagagatacctgggcgccctgagagaggccaagaacgacagcgagcagttcgccgccctgctgctggtgaccaaggccgtgaaggccggcgacatcgacgccaagaccagaagaagaatcttcgacgccgtgggcttcaccttccccaacagactgctgaccaccaaggaggcccccgacggctgccccgaccacgtgctgagagccctgggcgtggccctgctggcctgcttctgcagcgaccccgagctggccgcccacccccaggtgctgaacaagatccccatcctgagcaccttcctgaccgccagaggcgaccccgacgacgccgccagaagaagcatgatcgacgacacctaccagtgcctgaccgccgtggccggcacccccagaggccccagacacctgatcgccggcggcaccgtgagcgccctgtgccaggcctacctgggccacggctacggcttcgaccaggccctggccctgctggtgggcctgctggccgccgccgagacccagtgctggaaggaggccgagcccgacctgctggccgtgctgagaggcctgagcgaggacttccagaaggccgaggacgccagcaagttcgagctgtgccagctgctgcccctgttcctgccccccaccaccgtgccccccgagtgctacagagacctgcaggccggcctggccagaatcctgggcagcaagctgagcagctggcagagaaaccccgccctgaagctggccgccagactggcccacgcctgcggcagcgactggatccccgccggcagcagcggcagcaagttcctggccctgctggtgaacctggcctgcgtggaggtgagactggccctggaggagaccggcaccgaggtgaaggaggacgtggtgaccgcctgctacgccctgatggagctgggcatccaggagtgcaccagatgcgagcagagcctgctgaaggagccccagaaggtgcagctggtgagcgtgatgaaggaggccatcggcgccgtgatccactacctgctgcaggtgggcagcgagaagcagaaggagcccttcgtgttcgccagcgtgagaatcctgggcgcctggctggccgaggagaccagcagcctgagaaaggaggtgtgccagctgctgcccttcctggtgagatacgccaagaccctgtacgaggaggccgaggaggccaacgacctgagccagcaggtggccaacctggccatcagccccaccacccccggccccacctggcccggcgacgccctgagactgctgctgcccggctggtgccacctgaccgtggaggacggccccagagagatcctgatcaaggagggcgcccccagcctgctgtgcaagtacttcctgcagcagtgggagctgaccagccccggccacgacaccagcgtgctgcccgacagcgtggagatcggcctgcagacctgctgccacatcttcctgaacctggtggtgaccgcccccggcctgatcaagagagacgcctgcttcaccagcctgatgaacaccctgatgaccagcctgcccgccctggtgcagcagcagggcagactgctgctggccgccaacgtggccaccctgggcctgctgatggccagactgctgagcaccagccccgccctgcagggcacccccgccagcagaggcttcttcgccgccgccatcctgttcctgagccagagccacgtggccagagccacccccggcagcgaccaggccgtgctggccctgagccccgagtacgagggcatctgggccgacctgcaggagctgtggttcctgggcatgcaggccttcaccggctgcgtgcccctgctgccctggctggcccccgccgccctgagaagcagatggccccaggagctgctgcagctgctgggcagcgtgagccccaacagcgtgaagcccgagatggtggccgcctaccagggcgtgctggtggagctggccagagccaacagactgtgcagagaggccatgagactgcaggccggcgaggagaccgccagccactacagaatggccgccctggagcagtgcctgagcgagccctag

SEQ ID NO: 90818 - DNA, 2190 bp, Artificial Sequence; identical to SEQ ID NO: 90817
  Description of Artificial Sequence: Synthetic coding sequence

SEQ ID NO: 90819 - DNA, 2139 bp, Artificial Sequence
  Description of Artificial Sequence: Synthetic coding sequence
atggccagcgactgcgagcccgccctgaaccaggccgagggcagaaaccccaccctggagagatacctgggcgccctgagagaggccaagaacgacagcgagcagttcgccgccctgctgctggtgaccaaggccgtgaaggccggcgacatcgacgccaagaccagaagaagaatcttcgacgccgtgggcttcaccttccccaacagactgctgaccaccaaggaggcccccgacggctgccccgaccacgtgctgagagccctgggcgtggccctgctggcctgcttctgcagcgaccccgagctggccgcccacccccaggtgctgaacaagatccccatcctgagcaccttcctgaccgccagaggcgaccccgacgacgccgccagaagaagcatgatcgacgacacctaccagtgcctgaccgccgtggccggcacccccagaggccccagacacctgatcgccggcggcaccgtgagcgccctgtgccaggcctacctgggccacggctacggcttcgaccaggccctggccctgctggtgggcctgctggccgccgccgagacccagtgctggaaggaggccgagcccgacctgctggccgtgctgagaggcctgagcgaggacttccagaaggccgaggacgccagcaagttcgagctgtgccagctgctgcccctgttcctgccccccaccaccgtgccccccgagtgctacagagacctgcaggccggcctggccagaatcctgggcagcaagctgagcagctggcagagaaaccccgccctgaagctggccgccagactggcccacgcctgcggcagcgactggatccccgccggcagcagcggcagcaagttcctggccctgctggtgaacctggcctgcgtggaggtgagactggccctggaggagaccggcaccgaggtgaaggaggacgtggtgaccgcctgctacgccctgatggagctgggcatccaggagtgcaccagatgcgagcagagcctgctgaaggagccccagaaggtgcagctggtgagcgtgatgaaggaggccatcggcgccgtgatccactacctgctgcaggtgggcagcgagaagcagaaggagcccttcgtgttcgccagcgtgagaatcctgggcgcctggctggccgaggagaccagcagcctgagaaaggaggtgtgccagctgctgcccttcctggtgagatacgccaagaccctgtacgaggaggccgaggaggccaacgacctgagccagcaggtggccaacctggccatcagccccaccacccccggccccacctggcccggcgacgccctgagactgctgctgcccggctggtgccacctgaccgtggaggacggccccagagagatcctgatcaaggagggcgcccccagcctgctgtgcaagtacttcctgcagcagtgggagctgaccagccccggccacgacaccagcgtgctgcccgacagcgtggagatcggcctgcagacctgctgccacatcttcctgaacctggtggtgaccgcccccggcctgatcaagagagacgcctgcttcaccagcctgatgaacaccctgatgaccagcctgcccgccctggtgcagcagcagggcagactgctgctggccgccaacgtggccaccctgggcctgctgatggccagactgctgagcaccagccccgccctgcagggcacccccgccagcagaggcttcttcgccgccgccatcctgttcctgagccagagccacgtggccagagccacccccggcagcgaccaggccgtgctggccctgagccccgagtacgagggcatctgggccgacctgcaggagctgtggttcctgggcatgcaggccttcaccggctgcgtgcccctgctgccctggctggcccccgccgccctgagaagcagatggccccaggagctgctgcagctgctgggcagcgtgagccccaacagcgtgaagcccgagatggtggccgcctaccagggcgtgctggtggagctggccagagccaacagactgtgcagagaggccatgagactgcaggccggcgaggagaccgccagccactacagaatggccgccctggagcagtgcctgagcgagccctag

SEQ ID NO: 90820 - DNA, 531 bp, Artificial Sequence
  Description of Artificial Sequence: Synthetic coding sequence
atgccccacagcttcagatacctggccgccctgcagggcacccccgccagcagaggcttcttcgccgccgccatcctgttcctgagccagagccacgtggccagagccacccccggcagcgaccaggccgtgctggccctgagccccgagtacgagggcatctgggccgacctgcaggagctgtggttcctgggcatgcaggccttcaccggctgcgtgcccctgctgccctggctggcccccgccgccctgagaagcagatggccccaggagctgctgcagctgctgggcagccagccccagctgtgccaggccagagacggcggcagactgagcggctgccccggcggcgccggcgccggccagcccgccgtgcccggcggccacgaggccgccggcggcagaggcgacggccagcccctgccccacggctgcctgggcgccgtgcccgtgagagccctgagaggcgtgcacagaggccagacccagggcagagccgagagagagggcggcagaagacacctgccctag

SEQ ID NO: 90821 - DNA, 582 bp, Artificial Sequence
  Description of Artificial Sequence: Synthetic coding sequence
tgaagcagcctgagaaaggaggtgtgccagctgctgcccttcctggtgagatacgccaagaccctgtacgaggaggccgaggaggccaacgacctgagccagcaggtggccaacctggccatcagccccaccacccccggccccacctggcccggcgacgccctgagactgctgctgcccggctggtgccacctgaccgtggaggacggccccagagagatcctgatcaaggagggcgcccccagcctgctgtgcaagtacttcctgcagcagtgggagctgaccagccccggccacgacaccagcgtgctgcccgacagcgtggagatcggcctgcagacctgctgccacatcttcctgaacctggtggtgaccgcccccggcctgatcaagagagacgcctgcttcaccagcctgatgaacaccctgatgaccagcctgcccgccctggtgcagcagcagggcagactgctgctggccgccaacgtggccaccctgggcctgctgatggccagactgctgagcaccagccccggcagcatcagcagccagctgcccggcgccgagcacatgccctgctag

SEQ ID NO: 90822 - DNA, 735 bp, Artificial Sequence
  Description of Artificial Sequence: Synthetic coding sequence
atggccagcgactgcgagcccgccctgaaccaggccgagggcagaaaccccaccctggagagatacctgggcgccctgagagaggccaagaacgacagcgagcagttcgccgccctgctgctggtgaccaaggccgtgaaggccggcgacatcgacgccaagaccagaagaagaatcttcgacgccgtgggcttcaccttccccaacagactgctgaccaccaaggaggcccccgacggctgccccgaccacgtgctgagagccctgggcgtggccctgctggcctgcttctgcagcgaccccgagctggccgcccacccccaggtgctgaacaagatccccatcctgagcaccttcctgaccgccagaggcgaccccgacgacgccgccagaagaagcatgatcgacgacacctaccagtgcctgaccgccgtggccggcacccccagaggccccagacacctgatcgccggcggcaccgtgagcgccctgtgccaggcctacctgggccacggctacggcttcgaccaggccctggccctgctggtgggcctgctggccgccgccgagacccagtgctggaaggaggccgagcccgacctgctggccgtgctgagaggcctgagcgaggacttccagaaggccgaggacgccagcaagttcgagctgtgccagctgctgcccctgttcctgccccccaccaccgtgccccccgagtgctacagagacctgtag

SEQ ID NO: 90823 - DNA, 1791 bp, Artificial Sequence
  Description of Artificial Sequence: Synthetic coding sequence
atggagcccgagctggccgcccagaagcagcccagacccagaagaagaagcagaagagccagcggcctgagcaccgagggcgccaccggccccagcgccgacaccagcggcagcgagctggacggcagatgcagcctgagaagaggcagcagcttcaccttcctgacccccggccccaactgggacttcaccctgaagagaaagagaagagagaaggacgacgacgtggtgagcctgagcagcctggacctgaaggagcccagcaacaagagagtgagacccctggccagagtgaccagcctggccaacctgatcagccccgtgagaaacggcgccgtgagaagattcggccagaccatccagagcttcaccctgagaggcgaccacagaagccccgccagcgcccagaagttcagcagcagaagcaccgtgcccacccccgccaagagaagaagcagcgccctgtggagcgagatgctggacatcaccatgaaggagagcctgaccaccagagagatcagaagacaggaggccatctacgagatgagcagaggcgagcaggacctgatcgaggacctgaagctggccagaaaggcctaccacgaccccatgctgaagctgagcatcatgagcgaggaggagctgacccacatcttcggcgacctggacagctacatccccctgcacgaggacctgctgaccagaatcggcgaggccaccaagcccgacggcaccgtggagcagatcggccacatcctggtgagctggctgcccagactgaacgcctacagaggctactgcagcaaccagctggccgccaaggccctgctggaccagaagaagcaggaccccagagtgcaggacttcctgcagagatgcctggagagccccttcagcagaaagctggacctgtggagcttcctggacatccccagaagcagactggtgaagtaccccctgctgctgaaggagatcctgaagcacacccccaaggagcaccccgacgtgcagctgctggaggacgccatcctgatcatccagggcgtgctgagcgacatcaacctgaagaagggcgagagcgagtgccagtactacatcgacaagctggagtacctggacgagaagcagagagaccccagaatcgaggccagcaaggtgctgctgtgccacggcgagctgagaagcaagagcggccacaagctgtacatcttcctgttccaggacatcctggtgctgaccagacccgtgaccagaaacgagagacacagctaccaggtgtacagacagcccatccccgtgcaggagctggtgctggaggacctgcaggacggcgacgtgagaatgggcggcagcttcagaggcgccttcagcaacagcgagaaggccaagaacatcttcagaatcagattccacgaccccagccccgcccagagccacaccctgcaggccaacgacgtgttccacaagcagcagtggttcaactgcatcagagccgccatcgcccccttccagagcgccggcagcccccccgagctgcagggcctgcccgagctgcacgaggagtgcgagggcaaccaccccagcgccagaaagctgaccgcccagagaagagccagcaccgtgagcagcgtgacccaggtggaggtggacgagaacgcctacagatgcggcagcggcatgcagatggccgaggacagcaagagcctgaagacccaccagacccagcccggcatcagaagagccagagacaaggccctgagcggcggcaagagaaaggagaccctggtgtag

SEQ ID NO: 90824 - DNA, 483 bp, Artificial Sequence
  Description of Artificial Sequence: Synthetic coding sequence
atggtggcccacgacgagaccggcggcctgctgcccatcaagagaaccatcagagtgctggacgtgaacaaccagagcttcagagagcaggaggagctgacccacatcttcggcgacctggacagctacatccccctgcacgaggacctgctgaccagaatcggcgaggccaccaagcccgacggcaccgtggagcagatcggccacatcctggtgagctggctgcccagactgaacgcctacagaggctactgcagcaaccagctggccgccaaggccctgctggaccagaagaagcaggaccccagagtgcaggacttcctgcagagatgcctggagagccccttcagcagaaagctggacctgtggagcttcctggacatccccagaagcagactggtgaagtaccccctgctgctgaaggagatcctgaagcacacccccaaggagcaccccgacgtgcagctgctggaggacgcctag

SEQ ID NO: 90825 - DNA, 1629 bp, Artificial Sequence
  Description of Artificial Sequence: Synthetic coding sequence
atggtggcccacgacgagaccggcggcctgctgcccatcaagagaaccatcagagtgctggacgtgaacaaccagagcttcagagagcaggaggagcccagcaacaagagagtgagacccctggccagagtgaccagcctggccaacctgatcagccccgtgagaaacggcgccgtgagaagattcggccagaccatccagagcttcaccctgagaggcgaccacagaagccccgccagcgcccagaagttcagcagcagaagcaccgtgcccacccccgccaagagaagaagcagcgccctgtggagcgagatgctggacatcaccatgaaggagagcctgaccaccagagagatcagaagacaggaggccatctacgagatgagcagaggcgagcaggacctgatcgaggacctgaagctggccagaaaggcctaccacgaccccatgctgaagctgagcatcatgagcgaggaggagctgacccacatcttcggcgacctggacagctacatccccctgcacgaggacctgctgaccagaatcggcgaggccaccaagcccgacggcaccgtggagcagatcggccacatcctggtgagctggctgcccagactgaacgcctacagaggctactgcagcaaccagctggccgccaaggccctgctggaccagaagaagcaggaccccagagtgcaggacttcctgcagagatgcctggagagccccttcagcagaaagctggacctgtggagcttcctggacatccccagaagcagactggtgaagtaccccctgctgctgaaggagatcctgaagcacacccccaaggagcaccccgacgtgcagctgctggaggacgccatcctgatcatccagggcgtgctgagcgacatcaacctgaagaagggcgagagcgagtgccagtactacatcgacaagctggagtacctggacgagaagcagagagaccccagaatcgaggccagcaaggtgctgctgtgccacggcgagctgagaagcaagagcggccacaagctgtacatcttcctgttccaggacatcctggtgctgaccagacccgtgaccagaaacgagagacacagctaccaggtgtacagacagcccatccccgtgcaggagctggtgctggaggacctgcaggacggcgacgtgagaatgggcggcagcttcagaggcgccttcagcaacagcgagaaggccaagaacatcttcagaatcagattccacgaccccagccccgcccagagccacaccctgcaggccaacgacgtgttccacaagcagcagtggttcaactgcatcagagccgccatcgcccccttccagagcgccggcagcccccccgagctgcagggcctgcccgagctgcacgaggagtgcgagggcaaccaccccagcgccagaaagctgaccgcccagagaagagccagcaccgtgagcagcgtgacccaggtggaggtggacgagaacgcctacagatgcggcagcggcatgcagatggccgaggacagcaagagcctgaagacccaccagacccagcccggcatcagaagagccagagacaaggccctgagcggcggcaagagaaaggagaccctggtgtag

SEQ ID NO: 90826 - DNA, 483 bp, Artificial Sequence; identical to SEQ ID NO: 90824
  Description of Artificial Sequence: Synthetic coding sequence

SEQ ID NO: 90827 - DNA, 1248 bp, Artificial Sequence
  Description of Artificial Sequence: Synthetic coding sequence
atgagcagaggcgagcaggacctgatcgaggacctgaagctggccagaaaggcctaccacgaccccatgctgaagctgagcatcatgagcgaggaggagctgacccacatcttcggcgacctggacagctacatccccctgcacgaggacctgctgaccagaatcggcgaggccaccaagcccgacggcaccgtggagcagatcggccacatcctggtgagctggctgcccagactgaacgcctacagaggctactgcagcaaccagctggccgccaaggccctgctggaccagaagaagcaggaccccagagtgcaggacttcctgcagagatgcctggagagccccttcagcagaaagctggacctgtggagcttcctggacatccccagaagcagactggtgaagtaccccctgctgctgaaggagatcctgaagcacacccccaaggagcaccccgacgtgcagctgctggaggacgccatcctgatcatccagggcgtgctgagcgacatcaacctgaagaagggcgagagcgagtgccagtactacatcgacaagctggagtacctggacgagaagcagagagaccccagaatcgaggccagcaaggtgctgctgtgccacggcgagctgagaagcaagagcggccacaagctgtacatcttcctgttccaggacatcctggtgctgaccagacccgtgaccagaaacgagagacacagctaccaggtgtacagacagcccatccccgtgcaggagctggtgctggaggacctgcaggacggcgacgtgagaatgggcggcagcttcagaggcgccttcagcaacagcgagaaggccaagaacatcttcagaatcagattccacgaccccagccccgcccagagccacaccctgcaggccaacgacgtgttccacaagcagcagtggttcaactgcatcagagccgccatcgcccccttccagagcgccggcagcccccccgagctgcagggcctgcccgagctgcacgaggagtgcgagggcaaccaccccagcgccagaaagctgaccgcccagagaagagccagcaccgtgagcagcgtgacccaggtggaggtggacgagaacgcctacagatgcggcagcggcatgcagatggccgaggacagcaagagcctgaagacccaccagacccagcccggcatcagaagagccagagacaaggccctgagcggcggcaagagaaaggagaccctggtgtag

SEQ ID NO: 90828 - DNA, 3063 bp, Artificial Sequence
  Description of Artificial Sequence: Synthetic coding sequence
atgatgagcttcggcggcgccgacgccctgctgggcgcccccttcgcccccctgcacggcggcggcagcctgcactacgccctggccagaaagggcggcgccggcggcaccagaagcgccgccggcagcagcagcggcttccacagctggaccagaaccagcgtgagcagcgtgagcgccagccccagcagattcagaggcgccggcgccgccagcagcaccgacagcctggacaccctgagcaacggccccgagggctgcatggtggccgtggccaccagcagaagcgagaaggagcagctgcaggccctgaacgacagattcgccggctacatcgacaaggtgagacagctggaggcccacaacagaagcctggagggcgaggccgccgccctgagacagcagcaggccggcagaagcgccatgggcgagctgtacgagagagaggtgagagagatgagaggcgccgtgctgagactgggcgccgccagaggccagctgagactggagcaggagcacctgctggaggacatcgcccacgtgagacagagactggacgacgaggccagacagagagaggaggccgaggccgccgccagagccctggccagattcgcccaggaggccgaggccgccagagtggacctgcagaagaaggcccaggccctgcaggaggagtgcggctacctgagaagacaccaccaggaggaggtgggcgagctgctgggccagatccagggcagcggcgccgcccaggcccagatgcaggccgagaccagagacgccctgaagtgcgacgtgaccagcgccctgagagagatcagagcccagctggagggccacgccgtgcagagcaccctgcagagcgaggagtggttcagagtgagactggacagactgagcgaggccgccaaggtgaacaccgacgccatgagaagcgcccaggaggagatcaccgagtacagaagacagctgcaggccagaaccaccgagctggaggccctgaagagcaccaaggacagcctggagagacagagaagcgagctggaggacagacaccaggccgacatcgccagctaccaggaggccatccagcagctggacgccgagctgagaaacaccaagtgggagatggccgcccagctgagagagtaccaggacctgctgaacgtgaagatggccctggacatcgagatcgccgcctacagaaagctgctggagggcgaggagtgcagaatcggcttcggccccatccccttcagcctgcccgagggcctgcccaagatccccagcgtgagcacccacatcaaggtgaagagcgaggagaagatcaaggtggtggagaagagcgagaaggagaccgtgatcgtggaggagcagaccgaggagacccaggtgaccgaggaggtgaccgaggaggaggagaaggaggccaaggaggaggagggcaaggaggaggagggcggcgaggaggaggaggccgagggcggcgaggaggagaccaagagcccccccgccgaggaggccgccagccccgagaaggaggccaagagccccgtgaaggaggaggccaagagccccgccgaggccaagagccccgagaaggaggaggccaagagccccgccgaggtgaagagccccgagaaggccaagagccccgccaaggaggaggccaagagcccccccgaggccaagagccccgagaaggaggaggccaagagccccgccgaggtgaagagccccgagaaggccaagagccccgccaaggaggaggccaagagccccgccgaggccaagagccccgagaaggccaagagccccgtgaaggaggaggccaagagccccgccgaggccaagagccccgtgaaggaggaggccaagagccccgccgaggtgaagagccccgagaaggccaagagccccaccaaggaggaggccaagagccccgagaaggccaagagccccgagaaggaggaggccaagagccccgagaaggccaagagccccgtgaaggccgaggccaagagccccgagaaggccaagagccccgtgaaggccgaggccaagagccccgagaaggccaagagccccgtgaaggaggaggccaagagccccgagaaggccaagagccccgtgaaggaggaggccaagagccccgagaaggccaagagccccgtgaaggaggaggccaagacccccgagaaggccaagagccccgtgaaggaggaggccaagagccccgagaaggccaagagccccgagaaggccaagaccctggacgtgaagagccccgaggccaagacccccgccaaggaggaggccagaagccccgccgacaagttccccgagaaggccaagagccccgtgaaggaggaggtgaagagccccgagaaggccaagagccccctgaaggaggacgccaaggcccccgagaaggagatccccaagaaggaggaggtgaagagccccgtgaaggaggaggagaagccccaggaggtgaaggtgaaggagccccccaagaaggccgaggaggagaaggcccccgccacccccaagaccgaggagaagaaggacagcaagaaggaggaggcccccaagaaggaggcccccaagcccaaggtggaggagaagaaggagcccgccgtggagaagcccaaggagagcaaggtggaggccaagaaggaggaggccgaggacaagaagaaggtgcccacccccgagaaggaggcccccgccaaggtggaggtgaaggaggacgccaagcccaaggagaagaccgaggtggccaagaaggagcccgacgacgccaaggccaaggagcccagcaagcccgccgagaagaaggaggccgcccccgagaagaaggacaccaaggaggagaaggccaagaagcccgaggagaagcccaagaccgaggccaaggccaaggaggacgacaagaccctgagcaaggagcccagcaagcccaaggccgagaaggccgagaagagcagcagcaccgaccagaaggacagcaagccccccgagaaggccaccgaggacaaggccgccaagggcaagtag

SEQ ID NO: 90829 - DNA, 2916 bp, Artificial Sequence
  Description of Artificial Sequence: Synthetic coding sequence
atgatgagcttcggcggcgccgacgccctgctgggcgcccccttcgcccccctgcacggcggcggcagcctgcactacgccctggccagaaagggcggcgccggcggcaccagaagcgccgccggcagcagcagcggcttccacagctggaccagaaccagcgtgagcagcgtgagcgccagccccagcagattcagaggcgccggcgccgccagcagcaccgacagcctggacaccctgagcaacggccccgagggctgcatggtggccgtggccaccagcagaagcgagaaggagcagctgcaggccctgaacgacagattcgccggctacatcgacaaggtgagacagctggaggcccacaacagaagcctggagggcgaggccgccgccctgagacagcagcaggccggcagaagcgccatgggcgagctgtacgagagagaggtgagagagatgagaggcgccgtgctgagactgggcgccgccagaggccagctgagactggagcaggagcacctgctggaggacatcgcccacgtgagacagagactggacgacgaggccagacagagagaggaggccgaggccgccgccagagccctggccagattcgcccaggaggccgaggccgccagagtggacctgcagaagaaggcccaggccctgcaggaggagtgcggctacctgagaagacaccaccaggaggaggtgggcgagctgctgggccagatccagggcagcggcgccgcccaggcccagatgcaggccgagaccagagacgccctgaagtgcgacgtgaccagcgccctgagagagatcagagcccagctggagggccacgccgtgcagagcaccctgcagagcgaggagtggttcagagtgagactggacagactgagcgaggccgccaaggtgaacaccgacgccatgagaagcgcccaggaggagatcaccgagtacagaagacagctgcaggccagaaccaccgagctggaggccctgaagagcaccaaggacagcctggagagacagagaagcgagctggaggacagacaccaggccgacatcgccagctaccaggaggccatccagcagctggacgccgagctgagaaacaccaagtgggagatggccgcccagctgagagagtaccaggacctgctgaacgtgaagatggccctggacatcgagatcgccgcctacagaaagctgctggagggcgaggagtgcagaatcggcttcggccccatccccttcagcctgcccgagggcctgcccaagatccccagcgtgagcacccacatcaaggtgaagagcgaggagaagatcaaggtggtggagaagagcgagaaggagaccgtgatcgtggaggagcagaccgaggagacccaggtgaccgaggaggtgaccgaggaggaggagaaggaggccaaggaggaggagggcaaggaggaggagggcggcgaggaggaggaggccgagggcggcgaggaggagaccaagagcccccccgccgaggaggccgccagccccgagaaggaggccaagagccccgtgaaggaggaggccaagagccccgccgaggccaagagccccgagaaggaggaggccaagagccccgccgaggtgaagagccccgagaaggccaagagccccgccaaggaggaggccaagagcccccccgaggccaagagccccgagaaggaggaggccaagagccccgccgaggtgaagagccccgagaaggccaagagccccgccaaggaggaggccaagagccccgccgaggccaagagccccgagaaggccaagagccccgtgaaggaggaggccaagagccccgccgaggccaagagccccgtgaaggaggaggccaagagccccgccgaggtgaagagccccgagaaggccaagagccccaccaaggaggaggccaagagccccgagaaggccaagagccccgagaaggaggaggccaagagccccgagaaggccaagagccccgtgaaggccgaggccaagagccccgagaaggccaagagccccgtgaaggccgaggccaagagccccgagaaggccaagagccccgtgaaggaggaggccaagagccccgagaaggccaagagccccgtgaaggaggaggccaagagccccgagaaggccaagagccccgtgaaggaggaggccaagacccccgagaaggccaagagccccgtgaaggaggaggccaagagccccgagaaggccaagagccccctgaaggaggacgccaaggcccccgagaaggagatccccaagaaggaggaggtgaagagccccgtgaaggaggaggagaagccccaggaggtgaaggtgaaggagccccccaagaaggccgaggaggagaaggcccccgccacccccaagaccgaggagaagaaggacagcaagaaggaggaggcccccaagaaggaggcccccaagcccaaggtggaggagaagaaggagcccgccgtggagaagcccaaggagagcaaggtggaggccaagaaggaggaggccgaggacaagaagaaggtgcccacccccgagaaggaggcccccgccaaggtggaggtgaaggaggacgccaagcccaaggagaagaccgaggtggccaagaaggagcccgacgacgccaaggccaaggagcccagcaagcccgccgagaagaaggaggccgcccccgagaagaaggacaccaaggaggagaaggccaagaagcccgaggagaagcccaagaccgaggccaaggccaaggaggacgacaagaccctgagcaaggagcccagcaagcccaaggccgagaaggccgagaagagcagcagcaccgaccagaaggacagcaagccccccgagaaggccaccgaggacaaggccgccaagggcaagtag

SEQ ID NO: 90830 - DNA, 930 bp, Artificial Sequence
  Description of Artificial Sequence: Synthetic coding sequence
atggacgacaaggccttcaccaaggagctggaccagtgggtggagcagctgaacgagtgcaagcagctgaacgagaaccaggtgagaaccctgtgcgagaaggccaaggagatcctgaccaaggagagcaacgtgcaggaggtgagatgccccgtgaccgtgtgcggcgacgtgcacggccagttccacgacctgatggagctgttcagaatcggcggcaagagccccgacaccaactacctgttcatgggcgactacgtggacagaggctactacagcgtggagaccgtgaccctgctggtggccctgaaggtgagataccccgagagaatcaccatcctgagaggcaaccacgagagcagacagatcacccaggtgtacggcttctacgacgagtgcctgagaaagtacggcaacgccaacgtgtggaagtacttcaccgacctgttcgactacctgcccctgaccgccctggtggacggccagatcttctgcctgcacggcggcctgagccccagcatcgacaccctggaccacatcagagccctggacagactgcaggaggtgccccacgagggccccatgtgcgacctgctgtggagcgaccccgacgacagaggcggctggggcatcagccccagaggcgccggctacaccttcggccaggacatcagcgagaccttcaaccacgccaacggcctgaccctggtgagcagagcccaccagctggtgatggagggctacaactggtgccacgacagaaacgtggtgaccatcttcagcgcccccaactactgctacagatgcggcaaccaggccgccatcatggagctggacgacaccctgaagtacagcttcctgcagttcgaccccgcccccagaagaggcgagccccacgtgaccagaagaacccccgactacttcctgtag

SEQ ID NO: 90831 - DNA, 1623 bp, Artificial Sequence
  Description of Artificial Sequence: Synthetic coding sequence
atggccagacacctgagagagtaccaggacctgctgaacgtgaagatggccctggacatcgagatcgccgcctacagaaagctgctggagggcgaggagaccagattcagcaccttcgccggcagcatcaccggccccctgtacacccacagaccccccatcaccatcagcagcaagatccagaagcccaaggtggaggcccccaagctgaaggtgcagcacaagttcgtggaggagatcatcgaggagaccaaggtggaggacgagaagagcgagatggaggaggccctgaccgccatcaccgaggagctggccgtgagcatgaaggaggagaagaaggaggccgccgaggagaaggaggaggagcccgaggccgaggaggaggaggtggccgccaagaagagccccgtgaaggccaccgcccccgaggtgaaggaggaggagggcgagaaggaggaggaggagggccaggaggaggaggaggaggaggacgagggcgccaagagcgaccaggccgaggagggcggcagcgagaaggagggcagcagcgagaaggaggagggcgagcaggaggagggcgagaccgaggccgaggccgagggcgaggaggccgaggccaaggaggagaagaaggtggaggagaagagcgaggaggtggccaccaaggaggagctggtggccgacgccaaggtggagaagcccgagaaggccaagagccccgtgcccaagagccccgtggaggagaagggcaagagccccgtgcccaagagccccgtggaggagaagggcaagagccccgtgcccaagagccccgtggaggagaagggcaagagccccgtgcccaagagccccgtggaggagaagggcaagagccccgtgagcaagagccccgtggaggagaaggccaagagccccgtgcccaagagccccgtggaggaggccaagagcaaggccgaggtgggcaagggcgagcagaaggaggaggaggagaaggaggtgaaggaggcccccaaggaggagaaggtggagaagaaggaggagaagcccaaggacgtgcccgagaagaagaaggccgagagccccgtgaaggaggaggccgtggccgaggtggtgaccatcaccaagagcgtgaaggtgcacctggagaaggagaccaaggaggagggcaagcccctgcagcaggagaaggagaaggagaaggccggcggcgagggcggcagcgaggaggagggcagcgacaagggcgccaagggcagcagaaaggaggacatcgccgtgaacggcgaggtggagggcaaggaggaggtggagcaggagaccaaggagaagggcagcggcagagaggaggagaagggcgtggtgaccaacggcctggacctgagccccgccgacgagaagaagggcggcgacaagagcgaggagaaggtggtggtgaccaagaccgtggagaagatcaccagcgagggcggcgacggcgccaccaagtacatcaccaagagcgtgaccgtgacccagaaggtggaggagcacgaggagaccttcgaggagaagctggtgagcaccaagaaggtggagaaggtgaccagccacgccatcgtgaaggaggtgacccagagcgactag

SEQ ID NO: 90832 - DNA, 2634 bp, Artificial Sequence
  Description of Artificial Sequence: Synthetic coding sequence
atgagctacaccctggacagcctgggcaaccccagcgcctacagaagagtgaccgagaccagaagcagcttcagcagagtgagcggcagccccagcagcggcttcagaagccagagctggagcagaggcagccccagcaccgtgagcagcagctacaagagaagcatgctggcccccagactggcctacagcagcgccatgctgagcagcgccgagagcagcctggacttcagccagagcagcagcctgctgaacggcggcagcggccccggcggcgactacaagctgagcagaagcaacgagaaggagcagctgcagggcctgaacgacagattcgccggctacatcgagaaggtgcactacctggagcagcagaacaaggagatcgaggccgagatccaggccctgagacagaagcaggccagccacgcccagctgggcgacgcctacgaccaggagatcagagagctgagagccaccctggagatggtgaaccacgagaaggcccaggtgcagctggacagcgaccacctggaggaggacatccacagactgaaggagagattcgaggaggaggccagactgagagacgacaccgaggccgccatcagagccctgagaaaggacatcgaggaggccagcctggtgaaggtggagctggacaagaaggtgcagagcctgcaggacgaggtggccttcctgagaagcaaccacgaggaggaggtggccgacctgctggcccagatccaggccagccacatcaccgtggagagaaaggactacctgaagaccgacatcagcaccgccctgaaggagatcagaagccagctggagagccacagcgaccagaacatgcaccaggccgaggagtggttcaagtgcagatacgccaagctgaccgaggccgccgagcagaacaaggaggccatcagaagcgccaaggaggagatcgccgagtacagaagacagctgcagagcaagagcatcgagctggagagcgtgagaggcaccaaggagagcctggagagacagctgagcgacatcgaggagagacacaaccacgacctgagcagctaccaggacaccatccagcagctggagaacgagctgagaggcaccaagtgggagatggccagacacctgagagagtaccaggacctgctgaacgtgaagatggccctggacatcgagatcgccgcctacagaaagctgctggagggcgaggagaccagattcagcaccttcgccggcagcatcaccggccccctgtacacccacagaccccccatcaccatcagcagcaagatccagaagcccaaggtggaggcccccaagctgaaggtgcagcacaagttcgtggaggagatcatcgaggagaccaaggtggaggacgagaagagcgagatggaggaggccctgaccgccatcaccgaggagctggccgtgagcatgaaggaggagaagaaggaggccgccgaggagaaggaggaggagcccgaggccgaggaggaggaggtggccgccaagaagagccccgtgaaggccaccgcccccgaggtgaaggaggaggagggcgagaaggaggaggaggagggccaggaggaggaggaggaggaggacgagggcgccaagagcgaccaggccgaggagggcggcagcgagaaggagggcagcagcgagaaggaggagggcgagcaggaggagggcgagaccgaggccgaggccgagggcgaggaggccgaggccaaggaggagaagaaggtggaggagaagagcgaggaggtggccaccaaggaggagctggtggccgacgccaaggtggagaagcccgagaaggccaagagccccgtgcccaagagccccgtggaggagaagggcaagagccccgtgagcaagagccccgtggaggagaaggccaagagccccgtgcccaagagccccgtggaggaggccaagagcaaggccgaggtgggcaagggcgagcagaaggaggaggaggagaaggaggtgaaggaggcccccaaggaggagaaggtggagaagaaggaggagaagcccaaggacgtgcccgagaagaagaaggccgagagccccgtgaaggaggaggccgtggccgaggtggtgaccatcaccaagagcgtgaaggtgcacctggagaaggagaccaaggaggagggcaagcccctgcagcaggagaaggagaaggagaaggccggcggcgagggcggcagcgaggaggagggcagcgacaagggcgccaagggcagcagaaaggaggacatcgccgtgaacggcgaggtggagggcaaggaggaggtggagcaggagaccaaggagaagggcagcggcagagaggaggagaagggcgtggtgaccaacggcctggacctgagccccgccgacgagaagaagggcggcgacaagagcgaggagaaggtggtggtgaccaagaccgtggagaagatcaccagcgagggcggcgacggcgccaccaagtacatcaccaagagcgtgaccgtgacccagaaggtggaggagcacgaggagaccttcgaggagaagctggtgagcaccaagaaggtggagaaggtgaccagccacgccatcgtgaaggaggtgacccagagcgactag

SEQ ID NO: 90833 - DNA, 1071 bp, Artificial Sequence
  Description of Artificial Sequence: Synthetic coding sequence
atgaccaagagctacagcgagagcggcctgatgggcgagccccagccccagggcccccccagctggaccgacgagtgcctgagcagccaggacgaggagcacgaggccgacaagaaggaggacgacctggagaccatgaacgccgaggaggacagcctgagaaacggcggcgaggaggaggacgaggacgaggacctggaggaggaggaggaggaggaggaggaggacgacgaccagaagcccaagagaagaggccccaagaagaagaagatgaccaaggccagactggagagattcaagctgagaagaatgaaggccaacgccagagagagaaacagaatgcacggcctgaacgccgccctggacaacctgagaaaggtggtgccctgctacagcaagacccagaagctgagcaagatcgagaccctgagactggccaagaactacatctgggccctgagcgagatcctgagaagcggcaagagccccgacctggtgagcttcgtgcagaccctgtgcaagggcctgagccagcccaccaccaacctggtggccggctgcctgcagctgaaccccagaaccttcctgcccgagcagaaccaggacatgcccccccacctgcccaccgccagcgccagcttccccgtgcacccctacagctaccagagccccggcctgcccagccccccctacggcaccatggacagcagccacgtgttccacgtgaagccccccccccacgcctacagcgccgccctggagcccttcttcgagagccccctgaccgactgcaccagccccagcttcgacggccccctgagcccccccctgagcatcaacggcaacttcagcttcaagcacgagcccagcgccgagttcgagaagaactacgccttcaccatgcactaccccgccgccaccctggccggcgcccagagccacggcagcatcttcagcggcaccgccgcccccagatgcgagatccccatcgacaacatcatgagcttcgacagccacagccaccacgagagagtgatgagcgcccagctgaacgccatcttccacgactag

SEQ ID NO: 90834 - DNA, 1149 bp, Artificial Sequence
  Description of Artificial Sequence: Synthetic coding sequence
atgctgaccagactgttcagcgagcccggcctgctgagcgacgtgcccaagttcgccagctggggcgacggcgaggacgacgagcccagaagcgacaagggcgacgccccccccccccccccccccgcccccggccccggcgcccccggccccgccagagccgccaagcccgtgcccctgagaggcgaggagggcaccgaggccaccctggccgaggtgaaggaggagggcgagctgggcggcgaggaggaggaggaggaggaggaggaggagggcctggacgaggccgagggcgagagacccaagaagagaggccccaagaagagaaagatgaccaaggccagactggagagaagcaagctgagaagacagaaggccaacgccagagagagaaacagaatgcacgacctgaacgccgccctggacaacctgagaaaggtggtgccctgctacagcaagacccagaagctgagcaagatcgagaccctgagactggccaagaactacatctgggccctgagcgagatcctgagaagcggcaagagacccgacctggtgagctacgtgcagaccctgtgcaagggcctgagccagcccaccaccaacctggtggccggctgcctgcagctgaacagcagaaacttcctgaccgagcagggcgccgacggcgccggcagattccacggcagcggcggccccttcgccatgcacccctacccctacccctgcagcagactggccggcgcccagtgccaggccgccggcggcctgggcggcggcgccgcccacgccctgagaacccacggctactgcgccgcctacgagaccctgtacgccgccgccggcggcggcggcgccagccccgactacaacagcagcgagtacgagggccccctgagcccccccctgtgcctgaacggcaacttcagcctgaagcaggacagcagccccgaccacgagaagagctaccactacagcatgcactacagcgccctgcccggcagcagacccaccggccacggcctggtgttcggcagcagcgccgtgagaggcggcgtgcacagcgagaacctgctgagctacgacatgcacctgcaccacgacagaggccccatgtacgaggagctgaacgccttcttccacaactag

SEQ ID NO: 90835 - DNA, 996 bp, Artificial Sequence
  Description of Artificial Sequence: Synthetic coding sequence
atgagcaagaccttcgtgaagagcaaggagatgggcgagctggtgaacacccccagctggatggacaagggcctgggcagccagaacgaggtgaaggaggaggagagcagacccggcacctacggcatgctgagcagcctgaccgaggagcacgacagcatcgaggaggaggaggaggaggaggaggacggcgagaagcccaagagaagaggccccaagaagaagaagatgaccaaggccagactggagagattcagagccagaagagtgaaggccaacgccagagagagaaccagaatgcacggcctgaacgacgccctggacaacctgagaagagtgatgccctgctacagcaagacccagaagctgagcaagatcgagaccctgagactggccagaaactacatctgggccctgagcgaggtgctggagaccggccagacccccgagggcaagggcttcgtggagatgctgtgcaagggcctgagccagcccaccagcaacctggtggccggctgcctgcagctgggcccccagagcgtgctgctggagaagcacgaggacaagagccccatctgcgacagcgccatcagcgtgcacaacttcaactaccagagccccggcctgcccagccccccctacggccacatggagacccacctgctgcacctgaagccccaggtgttcaagagcctgggcgagagcagcttcggcagccacctgcccgactgcagcacccccccctacgagggccccctgaccccccccctgagcatcagcggcaacttcagcctgaagcaggacggcagccccgacctggagaagagctacagcttcatgccccactaccccagcagcagcctgagcagcggccacgtgcacagcacccccttccaggccggcacccccagatacgacgtgcccatcgacatgagctacgacagctacccccaccacggcatcggcacccagctgaacaccgtgttcaccgagtag

SEQ ID NO: 90836 - DNA, 1014 bp, Artificial Sequence
  Description of Artificial Sequence: Synthetic coding sequence
atgctgaccctgcccttcgacgagagcgtggtgatgcccgagagccagatgtgcagaaagttcagcagagagtgcgaggaccagaagcagatcaagaagcccgagagcttcagcaagcagatcgtgctgagaggcaagagcatcaagagagcccccggcgaggagaccgagaaggaggaggaggaggaggacagagaggaggaggacgagaacggcctgcccagaagaagaggcctgagaaagaagaagaccaccaagctgagactggagagagtgaagttcagaagacaggaggccaacgccagagagagaaacagaatgcacggcctgaacgacgccctggacaacctgagaaaggtggtgccctgctacagcaagacccagaagctgagcaagatcgagaccctgagactggccaagaactacatctgggccctgagcgagatcctgagaatcggcaagagacccgacctgctgaccttcgtgcagaacctgtgcaagggcctgagccagcccaccaccaacctggtggccggctgcctgcagctgaacgccagaagcttcctgatgggccagggcggcgaggccgcccaccacaccagaagcccctacagcaccttctaccccccctaccacagccccgagctgaccaccccccccggccacggcaccctggacaacagcaagagcatgaagccctacaactactgcagcgcctacgagagcttctacgagagcaccagccccgagtgcgccagcccccagttcgagggccccctgagccccccccccatcaactacaacggcatcttcagcctgaagcaggaggagaccctggactacggcaagaactacaactacggcatgcactactgcgccgtgccccccagaggccccctgggccagggcgccatgttcagactgcccaccgacagccacttcccctacgacctgcacctgagaagccagagcctgaccatgcaggacgagctgaacgccgtgttccacaactag

SEQ ID NO: 90837 - DNA, 714 bp, Artificial Sequence
  Description of Artificial Sequence: Synthetic coding sequence
atgcccgccagactggagacctgcatcagcgacctggactgcgccagcagcagcggcagcgacctgagcggcttcctgaccgacgaggaggactgcgccagactgcagcaggccgccagcgccagcggcccccccgcccccgccagaagaggcgcccccaacatcagcagagccagcgaggtgcccggcgcccaggacgacgagcaggagagaagaagaagaagaggcagaaccagagtgagaagcgaggccctgctgcacagcctgagaagaagcagaagagtgaaggccaacgacagagagagaaacagaatgcacaacctgaacgccgccctggacgccctgagaagcgtgctgcccagcttccccgacgacaccaagctgaccaagatcgagaccctgagattcgcctacaactacatctgggccctggccgagaccctgagactggccgaccagggcctgcccggcggcggcgccagagagagactgctgcccccccagtgcgtgccctgcctgcccggcccccccagccccgccagcgacgccgagagctggggcagcggcgccgccgccgccagccccctgagcgaccccagcagccccgccgccagcgaggacttcacctacagacccggcgaccccgtgttcagcttccccagcctgcccaaggacctgctgcacaccaccccctgcttcatcccctaccactag

SEQ ID NO: 90838 - DNA, 645 bp, Artificial Sequence
  Description of Artificial Sequence: Synthetic coding sequence
atgaccccccagcccagcggcgcccccaccgtgcaggtgaccagagagaccgagagaagcttccccagagccagcgaggacgaggtgacctgccccaccagcgccccccccagccccaccagaaccagaggcaactgcgccgaggccgaggagggcggctgcagaggcgcccccagaaagctgagagccagaagaggcggcagaagcagacccaagagcgagctggccctgagcaagcagagaagaagcagaagaaagaaggccaacgacagagagagaaacagaatgcacaacctgaacagcgccctggacgccctgagaggcgtgctgcccaccttccccgacgacgccaagctgaccaagatcgagaccctgagattcgcccacaactacatctgggccctgacccagaccctgagaatcgccgaccacagcctgtacgccctggagccccccgccccccactgcggcgagctgggcagccccggcggcagccccggcgactggggcagcctgtacagccccgtgagccaggccggcagcctgagccccgccgccagcctggaggagagacccggcctgctgggcgccaccttcagcgcctgcctgagccccggcagcctggccttcagcgacttcctgtag

SEQ ID NO: 90839 - DNA, 456 bp, Artificial Sequence
  Description of Artificial Sequence: Synthetic coding sequence
atggagagacccgagcccgagctgatcagacagagctggagagccgtgagcagaagccccctggagcacggcaccgtgctgttcgccagactgttcgccctggagcccgacctgctgcccctgttccagtacaactgcagacagttcagcagccccgaggactgcctgagcagccccgagttcctggaccacatcagaaaggtgatgctggtgatcgacgccgccgtgaccaacgtggaggacctgagcagcctggaggagtacctggccagcctgggcagaaagcacagagccgtgggcgtgaagctgagcagcttcagcaccgtgggcgagagcctgctgtacatgctggagaagtgcctgggccccgccttcacccccgccaccagagccgcctggagccagctgtacggcgccgtggtgcaggccatgagcagaggctgggacggcgagtag

SEQ ID NO: 90840 - DNA, 237 bp, Artificial Sequence
  Description of Artificial Sequence: Synthetic coding sequence
atggactgctgcaccgagaacgcctgcagcaagcccgacgacgacatcctggacatccccctggacgaccccggcgccaacgccgccgccgccaagatccaggccagcttcagaggccacatggccagaaagaagatcaagagcggcgagagaggcagaaagggccccggccccggcggccccggcggcgccggcgtggccagaggcggcgccggcggcggccccagcggcgactag

SEQ ID NO: 90841 - DNA, 237 bp, Artificial Sequence; identical to SEQ ID NO: 90840
  Description of Artificial Sequence: Synthetic coding sequence

SEQ ID NO: 90842 - DNA, 237 bp, Artificial Sequence; identical to SEQ ID NO: 90840
  Description of Artificial Sequence: Synthetic coding sequence

SEQ ID NO: 90843 - DNA, 936 bp, Artificial Sequence
  Description of Artificial Sequence: Synthetic coding sequence
atggccgccctgggcgtgctggagagcgacctgcccagcgccgtgaccctgctgaagaacctgcaggagcaggtgatggccgtgaccgcccaggtgaagagcctgacccagaaggtgcaggccggcgcctaccccaccgagaagggcctgagcttcctggaggtgaaggaccagctgctgctgatgtacctgatggacctgacccacctgatcctggacaaggccagcggcggcagcctgcagggccacgacgccgtgctgagactggtggagatcagaaccgtgctggagaagctgagacccctggaccagaagctgaagtaccagatcgacaagctgatcaagaccgccgtgaccggcagcctgagcgagaacgaccccctgagattcaagccccaccccagcaacatgatgagcaagctgagcagcgaggacgaggaggaggacgaggccgaggacgaccagagcgaggccagcggcaagaagagcgtgaagggcgtgagcaagaagtacgtgccccccagactggtgcccgtgcactacgacgagaccgaggccgagagagagaagaagagactggagagagccaagagaagagccctgagcagcagcgtgatcagagagctgaaggagcagtacagcgacgcccccgaggagatcagagacgccagacacccccacgtgaccagacagagccaggaggaccagcacagaatcaactacgaggagagcatgatggtgagactgagcgtgagcaagagagagaagggcagaagaaagagagccaacgtgatgagcagccagctgcacagcctgacccacttcagcgacatcagcgccctgaccggcggcaccgtgcacctggacgaggaccagaaccccatcaagaagagaaagaagatcccccagaagggcagaaagaagaagggccagtag

SEQ ID NO: 90844 - DNA, 948 bp, Artificial Sequence
  Description of Artificial Sequence: Synthetic coding sequence
atggccgccctgggcgtgctggagagcgacctgcccagcgccgtgaccctgctgaagaacctgcaggagcaggtgatggccgtgaccgcccaggtgaagagcctgacccagaaggtgcaggccggcgcctaccccaccgagaagggcctgagcttcctggaggtgaaggaccagctgctgctgatgtacctgatggacctgacccacctgatcctggacaaggccagcggcggcagcctgcagggccacgacgccgtgctgagactggtggagatcagaaccgtgctggagaagctgagacccctggaccagaagctgaagtaccagatcgacaagctgatcaagaccgccgtgaccggcagcctgagcgagaacgaccccctgagattcaagccccaccccagcaacatgatgagcaagctgagcagcgaggacgaggaggaggacgaggccgaggacgaccagagcgaggccagcggcaagaagagcgtgaagggcgtgagcaagaagtacgtgccccccagactggtgcccgtgcactacgacgagaccgaggccgagagagagaagaagagactggagagagccaagagaagagccctgagcagcagcgtgatcagagagctgaaggagcagtacagcgacgcccccgaggagatcagagacgccagacacccccacgtgaccagacagagccaggaggaccagcacagaatcaactacgaggagagcatgatggtgagactgagcgtgagcaagagagagaagggcagaagaaagagagccaacgtgatgagcagccagctgcacagcctgacccacttcagcgacatcagcgccctgaccggcggcaccgtgcacctggacgaggaccagaaccccatcaagaagagaaagaagatcccccagaagggcagaaagaagaagggcttcagaagaagaagatag

SEQ ID NO: 90845 - DNA, 2472 bp, Artificial Sequence
  Description of Artificial Sequence: Synthetic coding sequence
atggccctgcccagatgcacctggcccaactacgtgtggagagccgtgatggcctgcctggtgcacagaggcctgggcgcccccctgaccctgtgcatgctgggctgcctgctgcaggccggccacgtgctgagccagaagctggacgacgtggaccccctggtggccaccaacttcggcaagatcagaggcatcaagaaggagctgaacaacgagatcctgggccccgtgatccagttcctgggcgtgccctacgccgccccccccaccggcgagagaagattccagccccccgagccccccagcccctggagcgacatcagaaacgccacccagttcgcccccgtgtgcccccagaacatcatcgacggcagactgcccgaggtgatgctgcccgtgtggttcaccaacaacctggacgtggtgagcagctacgtgcaggaccagagcgaggactgcctgtacctgaacatctacgtgcccaccgaggacgacatcagagacagcggcggccccaagcccgtgatggtgtacatccacggcggcagctacatggagggcaccggcaacctgtacgacggcagcgtgctggccagctacggcaacgtgatcgtgatcaccgtgaactacagactgggcgtgctgggcttcctgagcaccggcgaccaggccgccaagggcaactacggcctgctggacctgatccaggccctgagatggaccagcgagaacatcggcttcttcggcggcgaccccctgagaatcaccgtgttcggcagcggcgccggcggcagctgcgtgaacctgctgaccctgagccactacagcgagggcaacagatggagcaacagcaccaagggcctgttccagagagccatcgcccagagcggcaccgccctgagcagctgggccgtgagcttccagcccgccaagtacgccagaatgctggccaccaaggtgggctgcaacgtgagcgacaccgtggagctggtggagtgcctgcagaagaagccctacaaggagctggtggaccaggacatccagcccgccagataccacatcgccttcggccccgtgatcgacggcgacgtgatccccgacgacccccagatcctgatggagcagggcgagttcctgaactacgacatcatgctgggcgtgaaccagggcgagggcctgaagttcgtggagaacatcgtggacagcgacgacggcatcagcgccagcgacttcgacttcgccgtgagcaacttcgtggacaacctgtacggctaccccgagggcaaggacgtgctgagagagaccatcaagttcatgtacaccgactgggccgacagacacaaccccgagaccagaagaaagaccctgctggccctgttcaccgaccaccagtgggtggcccccgccgtggccaccgccgacctgcacagcaacttcggcagccccacctacttctacgccttctaccaccactgccagaccgaccaggtgcccgcctgggccgacgccgcccacggcgacgaggtgccctacgtgctgggcatccccatgatcggccccaccgagctgttcccctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggaccagatacagccagaaggaccagctgtacctgcacatcggcctgaagcccagagtgaaggagcactacagagccaacaaggtgaacctgtggctggagctggtgccccacctgcacaacctgaacgacatcagccagtacaccagcaccaccaccaaggtgcccagcaccgacatcaccttcagacccaccagaaagaacagcgtgcccgtgaccagcgccttccccaccgccaagcaggacgaccccaagcagcagcccagccccttcagcgtggaccagagagactacagcaccgagctgagcgtgaccatcgccgtgggcgccagcctgctgttcctgaacatcctggccttcgccgccctgtactacaagaaggacaagagaagacacgacgtgcacagaagatgcagcccccagagaaccaccaccaacgacctgacccacgcccaggaggaggagatcatgagcctgcagatgaagcacaccgacctggaccacgagtgcgagagcatccacccccacgaggtggtgctgagaaccgcctgcccccccgactacaccctggccatgagaagaagccccgacgacgtgcccctgatgacccccaacaccatcaccatgatccccaacaccatccccggcatccagcccctgcacaccttcaacaccttcaccggcggccagaacaacaccctgccccacccccacccccacccccacagccacagcaccaccagagtgtag

SEQ ID NO: 90846 - DNA, 2592 bp, Artificial Sequence
  Description of Artificial Sequence: Synthetic coding sequence
atggccctgcccagatgcacctggcccaactacgtgtggagagccgtgatggcctgcctggtgcacagaggcctgggcgcccccctgaccctgtgcatgctgggctgcctgctgcaggccggccacgtgctgagccagaagctggacgacgtggaccccctggtggccaccaacttcggcaagatcagaggcatcaagaaggagctgaacaacgagatcctgggccccgtgatccagttcctgggcgtgccctacgccgccccccccaccggcgagagaagattccagccccccgagccccccagcccctggagcgacatcagaaacgccacccagttcgcccccgtgtgcccccagaacatcatcgacggcagactgcccgaggtgatgctgcccgtgtggttcaccaacaacctggacgtggtgagcagctacgtgcaggaccagagcgaggactgcctgtacctgaacatctacgtgcccaccgaggacgtgaagagaatcagcaaggagtgcgccagaaagcccggcaagaagatctgcagaaagggcggccccctgaccaagaagcagaccgacgacctgggcgacaacgacggcgccgaggacgaggacatcagagacagcggcggccccaagcccgtgatggtgtacatccacggcggcagctacatggagggcaccggcaacctgtacgacggcagcgtgctggccagctacggcaacgtgatcgtgatcaccgtgaactacagactgggcgtgctgggcttcctgagcaccggcgaccaggccgccaagggcaactacggcctgctggacctgatccaggccctgagatggaccagcgagaacatcggcttcttcggcggcgaccccctgagaatcaccgtgttcggcagcggcgccggcggcagctgcgtgaacctgctgaccctgagccactacagcgagggcaacagatggagcaacagcaccaagggcctgttccagagagccatcgcccagagcggcaccgccctgagcagctgggccgtgagcttccagcccgccaagtacgccagaatgctggccaccaaggtgggctgcaacgtgagcgacaccgtggagctggtggagtgcctgcagaagaagccctacaaggagctggtggaccaggacatccagcccgccagataccacatcgccttcggccccgtgatcgacggcgacgtgatccccgacgacccccagatcctgatggagcagggcgagttcctgaactacgacatcatgctgggcgtgaaccagggcgagggcctgaagttcgtggagaacatcgtggacagcgacgacggcatcagcgccagcgacttcgacttcgccgtgagcaacttcgtggacaacctgtacggctaccccgagggcaaggacgtgctgagagagaccatcaagttcatgtacaccgactgggccgacagacacaaccccgagaccagaagaaagaccctgctggccctgttcaccgaccaccagtgggtggcccccgccgtggccaccgccgacctgcacagcaacttcggcagccccacctacttctacgccttctaccaccactgccagaccgaccaggtgcccgcctgggccgacgccgcccacggcgacgaggtgccctacgtgctgggcatccccatgatcggccccaccgagctgttcccctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggaccagatacagccagaaggaccagctgtacctgcacatcggcctgaagcccagagtgaaggagcactacagagccaacaaggtgaacctgtggctggagctggtgccccacctgcacaacctgaacgacatcagccagtacaccagcaccaccaccaaggtgcccagcaccgacatcaccttcagacccaccagaaagaacagcgtgcccgtgaccagcgccttccccaccgccaagcaggacgaccccaagcagcagcccagccccttcagcgtggaccagagagactacagcaccgagctgagcgtgaccatcgccgtgggcgccagcctgctgttcctgaacatcctggccttcgccgccctgtactacaagaaggacaagagaagacacgacgtgcacagaagatgcagcccccagagaaccaccaccaacgacctgacccacgcccaggaggaggagatcatgagcctgcagatgaagcacaccgacctggaccacgagtgcgagagcatccacccccacgaggtggtgctgagaaccgcctgcccccccgactacaccctggccatgagaagaagccccgacgacgtgcccctgatgacccccaacaccatcaccatgatccccaacaccatccccggcatccagcccctgcacaccttcaacaccttcaccggcggccagaacaacaccctgccccacccccacccccacccccacagccacagcaccaccagagtgtag

SEQ ID NO: 90847 - DNA, 33 bp, Artificial Sequence
  Description of Artificial Sequence: Synthetic coding sequence
atggccctgcccagatgcacctggcccaactag

SEQ ID NO: 90848 - DNA, 42 bp, Artificial Sequence
  Description of Artificial Sequence: Synthetic coding sequence
atggccctgcccagatgcacctggcccaactacgtgtggtag

SEQ ID NO: 90849 - DNA, 2472 bp, Artificial Sequence; identical to SEQ ID NO: 90845
  Description of Artificial Sequence: Synthetic coding sequence

SEQ ID NO: 90850 - DNA, 2472 bp, Artificial Sequence; identical to SEQ ID NO: 90845
  Description of Artificial Sequence: Synthetic coding sequence

SEQ ID NO: 90851 - DNA, 2508 bp, Artificial Sequence
  Description of Artificial Sequence: Synthetic coding sequence
atgtggctgctggccctgtgcctggtgggcctggccggcgcccagagaggcggcggcggccccggcggcggcgcccccggcggccccggcctgggcctgggcagcctgggcgaggagagattccccgtggtgaacaccgcctacggcagagtgagaggcgtgagaagagagctgaacaacgagatcctgggccccgtggtgcagttcctgggcgtgccctacgccaccccccccctgggcgccagaagattccagccccccgaggcccccgccagctggcccggcgtgagaaacgccaccaccctgccccccgcctgcccccagaacctgcacggcgccctgcccgccatcatgctgcccgtgtggttcaccgacaacctggaggccgccgccacctacgtgcagaaccagagcgaggactgcctgtacctgaacctgtacgtgcccaccgaggacggccccctgaccaagaagagagacgaggccaccctgaacccccccgacaccgacatcagagaccccggcaagaagcccgtgatgctgttcctgcacggcggcagctacatggagggcaccggcaacatgttcgacggcagcgtgctggccgcctacggcaacgtgatcgtggccaccctgaactacagactgggcgtgctgggcttcctgagcaccggcgaccaggccgccaagggcaactacggcctgctggaccagatccaggccctgagatggctgagcgagaacatcgcccacttcggcggcgaccccgagagaatcaccatcttcggcagcggcgccggcgccagctgcgtgaacctgctgatcctgagccaccacagcgagggcctgttccagaaggccatcgcccagagcggcaccgccatcagcagctggagcgtgaactaccagcccctgaagtacaccagactgctggccgccaaggtgggctgcgacagagaggacagcgccgaggccgtggagtgcctgagaagaaagcccagcagagagctggtggaccaggacgtgcagcccgccagataccacatcgccttcggccccgtggtggacggcgacgtggtgcccgacgaccccgagatcctgatgcagcagggcgagttcctgaactacgacatgctgatcggcgtgaaccagggcgagggcctgaagttcgtggaggacagcgccgagagcgaggacggcgtgagcgccagcgccttcgacttcaccgtgagcaacttcgtggacaacctgtacggctaccccgagggcaaggacgtgctgagagagaccatcaagttcatgtacaccgactgggccgacagagacaacggcgagatgagaagaaagaccctgctggccctgttcaccgaccaccagtgggtggcccccgccgtggccaccgccaagctgcacgccgactaccagagccccgtgtacttctacaccttctaccaccactgccaggccgagggcagacccgagtgggccgacgccgcccacggcgacgagctgccctacgtgttcggcgtgcccatggtgggcgccaccgacctgttcccctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggtgtggagcaagttcaacagcaaggagaagcagtacctgcacatcggcctgaagcccagagtgagagacaactacagagccaacaaggtggccttctggctggagctggtgccccacctgcacaacctgcacaccgagctgttcaccaccaccaccagactgcccccctacgccaccagatggccccccagaccccccgccggcgcccccggcaccagaagaccccccccccccgccaccctgccccccgagcccgagcccgagcccggccccagagcctacgacagattccccggcgacagcagagactacagcaccgagctgagcgtgaccgtggccgtgggcgccagcctgctgttcctgaacatcctggccttcgccgccctgtactacaagagagacagaagacaggagctgagatgcagaagactgagcccccccggcggcagcggcagcggcgtgcccggcggcggccccctgctgcccgccgccggcagagagctgccccccgaggaggagctggtgagcctgcagctgaagagaggcggcggcgtgggcgccgaccccgccgaggccctgagacccgcctgcccccccgactacaccctggccctgagaagagcccccgacgacgtgcccctgctggcccccggcgccctgaccctgctgcccagcggcctgggcccccccccccccccccccccccccagcctgcaccccttcggccccttccccccccccccccccaccgccaccagccacaacaacaccctgccccacccccacagcaccaccagagtgtag

SEQ ID NO: 90852 - DNA, 2547 bp, Artificial Sequence
  Description of Artificial Sequence: Synthetic coding sequence
atgtggctgagactgggcccccccagcctgagcctgagccccaagcccaccgtgggcagaagcctgtgcctgaccctgtggttcctgagcctggccctgagagccagcacccaggcccccgcccccaccgtgaacacccacttcggcaagctgagaggcgccagagtgcccctgcccagcgagatcctgggccccgtggaccagtacctgggcgtgccctacgccgccccccccatcggcgagaagagattcctgccccccgagcccccccccagctggagcggcatcagaaacgccacccacttcccccccgtgtgcccccagaacatccacaccgccgtgcccgaggtgatgctgcccgtgtggttcaccgccaacctggacatcgtggccacctacatccaggagcccaacgaggactgcctgtacctgaacgtgtacgtgcccaccgaggacgtgaagagaatcagcaaggagtgcgccagaaagcccaacaagaagatctgcagaaagggcggcagcggcgccaagaagcagggcgaggacctggccgacaacgacggcgacgaggacgaggacatcagagacagcggcgccaagcccgtgatggtgtacatccacggcggcagctacatggagggcaccggcaacatgatcgacggcagcatcctggccagctacggcaacgtgatcgtgatcaccctgaactacagagtgggcgtgctgggcttcctgagcaccggcgaccaggccgccaagggcaactacggcctgctggaccagatccaggccctgagatgggtgagcgagaacatcgccttcttcggcggcgaccccagaagaatcaccgtgttcggcagcggcatcggcgccagctgcgtgagcctgctgaccctgagccaccacagcgagggcctgttccagagagccatcatccagagcggcagcgccctgagcagctgggccgtgaactaccagcccgtgaagtacaccagcctgctggccgacaaggtgggctgcaacgtgctggacaccgtggacatggtggactgcctgagacagaagagcgccaaggagctggtggagcaggacatccagcccgccagataccacgtggccttcggccccgtgatcgacggcgacgtgatccccgacgaccccgagatcctgatggagcagggcgagttcctgaactacgacatcatgctgggcgtgaaccagggcgagggcctgaagttcgtggagggcgtggtggaccccgaggacggcgtgagcggcaccgacttcgactacagcgtgagcaacttcgtggacaacctgtacggctaccccgagggcaaggacaccctgagagagaccatcaagttcatgtacaccgactgggccgacagagacaaccccgagaccagaagaaagaccctggtggccctgttcaccgaccaccagtgggtggagcccagcgtggtgaccgccgacctgcacgccagatacggcagccccacctacttctacgccttctaccaccactgccagagcctgatgaagcccgcctggagcgacgccgcccacggcgacgaggtgccctacgtgttcggcgtgcccatggtgggccccaccgacctgttcccctgcaacttcagcaagaacgacgtgatgctgagcgccgtggtgatgacctactggaccaacttcgccaagaccggcgaccccaacaagcccgtgccccaggacaccaagttcatccacaccaaggccaacagattcgaggaggtggcctggagcaagtacaaccccagagaccagctgtacctgcacatcggcctgaagcccagagtgagagaccactacagagccaccaaggtggccttctggaagcacctggtgccccacctgtacaacctgcacgacatgttccactacaccagcaccaccaccaaggtgcccccccccgacaccacccacagcagccacatcaccagaagacccaacggcaagacctggagcaccaagagacccgccatcagccccgcctacagcaacgagaacgcccagggcagctggaacggcgaccaggacgccggccccctgctggtggagaaccccagagactacagcaccgagctgagcgtgaccatcgccgtgggcgccagcctgctgttcctgaacgtgctggccttcgccgccctgtactacagaaaggacaagagaagacaggagcccctgagacagcccagcccccagagaggcgccggcgcccccgagctgggcgccgcccccgaggaggagctggccgccctgcagctgggccccacccaccacgagtgcgaggccggccccccccacgacaccctgagactgaccgccctgcccgactacaccctgaccctgagaagaagccccgacgacatccccctgatgacccccaacaccatcaccatgatccccaacagcctggtgggcctgcagaccctgcacccctacaacaccttcgccgccggcttcaacagcaccggcctgccccacagccacagcaccaccagagtgtag

SEQ ID NO: 90853 - DNA, 2487 bp, Artificial Sequence
  Description of Artificial Sequence: Synthetic coding sequence
atgtggctgagactgggcccccccagcctgagcctgagccccaagcccaccgtgggcagaagcctgtgcctgaccctgtggttcctgagcctggccctgagagccagcacccaggcccccgcccccaccgtgaacacccacttcggcaagctgagaggcgccagagtgcccctgcccagcgagatcctgggccccgtggaccagtacctgggcgtgccctacgccgccccccccatcggcgagaagagattcctgccccccgagcccccccccagctggagcggcatcagaaacgccacccacttcccccccgtgtgcccccagaacatccacaccgccgtgcccgaggtgatgctgcccgtgtggttcaccgccaacctggacatcgtggccacctacatccaggagcccaacgaggactgcctgtacctgaacgtgtacgtgcccaccgaggacggcagcggcgccaagaagcagggcgaggacctggccgacaacgacggcgacgaggacgaggacatcagagacagcggcgccaagcccgtgatggtgtacatccacggcggcagctacatggagggcaccggcaacatgatcgacggcagcatcctggccagctacggcaacgtgatcgtgatcaccctgaactacagagtgggcgtgctgggcttcctgagcaccggcgaccaggccgccaagggcaactacggcctgctggaccagatccaggccctgagatgggtgagcgagaacatcgccttcttcggcggcgaccccagaagaatcaccgtgttcggcagcggcatcggcgccagctgcgtgagcctgctgaccctgagccaccacagcgagggcctgttccagagagccatcatccagagcggcagcgccctgagcagctgggccgtgaactaccagcccgtgaagtacaccagcctgctggccgacaaggtgggctgcaacgtgctggacaccgtggacatggtggactgcctgagacagaagagcgccaaggagctggtggagcaggacatccagcccgccagataccacgtggccttcggccccgtgatcgacggcgacgtgatccccgacgaccccgagatcctgatggagcagggcgagttcctgaactacgacatcatgctgggcgtgaaccagggcgagggcctgaagttcgtggagggcgtggtggaccccgaggacggcgtgagcggcaccgacttcgactacagcgtgagcaacttcgtggacaacctgtacggctaccccgagggcaaggacaccctgagagagaccatcaagttcatgtacaccgactgggccgacagagacaaccccgagaccagaagaaagaccctggtggccctgttcaccgaccaccagtgggtggagcccagcgtggtgaccgccgacctgcacgccagatacggcagccccacctacttctacgccttctaccaccactgccagagcctgatgaagcccgcctggagcgacgccgcccacggcgacgaggtgccctacgtgttcggcgtgcccatggtgggccccaccgacctgttcccctgcaacttcagcaagaacgacgtgatgctgagcgccgtggtgatgacctactggaccaacttcgccaagaccggcgaccccaacaagcccgtgccccaggacaccaagttcatccacaccaaggccaacagattcgaggaggtggcctggagcaagtacaaccccagagaccagctgtacctgcacatcggcctgaagcccagagtgagagaccactacagagccaccaaggtggccttctggaagcacctggtgccccacctgtacaacctgcacgacatgttccactacaccagcaccaccaccaaggtgcccccccccgacaccacccacagcagccacatcaccagaagacccaacggcaagacctggagcaccaagagacccgccatcagccccgcctacagcaacgagaacgcccagggcagctggaacggcgaccaggacgccggccccctgctggtggagaaccccagagactacagcaccgagctgagcgtgaccatcgccgtgggcgccagcctgctgttcctgaacgtgctggccttcgccgccctgtactacagaaaggacaagagaagacaggagcccctgagacagcccagcccccagagaggcgccggcgcccccgagctgggcgccgcccccgaggaggagctggccgccctgcagctgggccccacccaccacgagtgcgaggccggccccccccacgacaccctgagactgaccgccctgcccgactacaccctgaccctgagaagaagccccgacgacatccccctgatgacccccaacaccatcaccatgatccccaacagcctggtgggcctgcagaccctgcacccctacaacaccttcgccgccggcttcaacagcaccggcctgccccacagccacagcaccaccagagtgtag

SEQ ID NO: 90854 - DNA, 1542 bp, Artificial Sequence
  Description of Artificial Sequence: Synthetic coding sequence
atgtggctgagactgggcccccccagcctgagcctgagccccaagcccaccgtgggcagaagcctgtgcctgaccctgtggttcctgagcctggccctgagagccagcacccaggcccccgcccccaccgtgaacacccacttcggcaagctgagaggcgccagagtgcccctgcccagcgagatcctgggccccgtggaccagtacctgggcgtgccctacgccgccccccccatcggcgagaagagattcctgccccccgagcccccccccagctggagcggcatcagaaacgccacccacttcccccccgtgtgcccccagaacatccacaccgccgtgcccgaggtgatgctgcccgtgtggttcaccgccaacctggacatcgtggccacctacatccaggagcccaacgaggactgcctgtacctgaacgtgtacgtgcccaccgaggacgacatcagagacagcggcgccaagcccgtgatggtgtacatccacggcggcagctacatggagggcaccggcaacatgatcgacggcagcatcctggccagctacggcaacgtgatcgtgatcaccctgaactacagagtgggcgtgctgggcttcctgagcaccggcgaccaggccgccaagggcaactacggcctgctggaccagatccaggccctgagatgggtgagcgagaacatcgccttcttcggcggcgaccccagaagaatcaccgtgttcggcagcggcatcggcgccagctgcgtgagcctgctgaccctgagccaccacagcgagggcctgttccagagagccatcatccagagcggcagcgccctgagcagctgggccgtgaactaccagcccgtgaagtacaccagcctgctggccgacaaggtgggctgcaacgtgctggacaccgtggacatggtggactgcctgagacagaagagcgccaaggagctggtggagcaggacatccagcccgccagataccacgtggccttcggccccgtgatcgacggcgacgtgatccccgacgaccccgagatcctgatggagcagggcgagttcctgaactacgacatcatgctgggcgtgaaccagggcgagggcctgaagttcgtggagggcgtggtggaccccgaggacggcgtgagcggcaccgacttcgactacagcgtgagcaacttcgtggacaacctgtacggctaccccgagggcaaggacaccctgagagagaccatcaagttcatgtacaccgactgggccgacagagacaaccccgagaccagaagaaagaccctggtggccctgttcaccgaccaccagtgggtggagcccagcgtggtgaccgccgacctgcacgccagatacggcagccccacctacttctacgccttctaccaccactgccagagcctgatgaagcccgcctggagcgacgccgcccacggcgacgaggtgccctacgtgttcggcgtgcccatggtgggccccaccgacctgttcccctgcaacttcagcaagaacgacgtgatgctgtag

SEQ ID NO: 90855 - DNA, 2427 bp, Artificial Sequence
  Description of Artificial Sequence: Synthetic coding sequence
atgtggctgagactgggcccccccagcctgagcctgagccccaagcccaccgtgggcagaagcctgtgcctgaccctgtggttcctgagcctggccctgagagccagcacccaggcccccgcccccaccgtgaacacccacttcggcaagctgagaggcgccagagtgcccctgcccagcgagatcctgggccccgtggaccagtacctgggcgtgccctacgccgccccccccatcggcgagaagagattcctgccccccgagcccccccccagctggagcggcatcagaaacgccacccacttcccccccgtgtgcccccagaacatccacaccgccgtgcccgaggtgatgctgcccgtgtggttcaccgccaacctggacatcgtggccacctacatccaggagcccaacgaggactgcctgtacctgaacgtgtacgtgcccaccgaggacgacatcagagacagcggcgccaagcccgtgatggtgtacatccacggcggcagctacatggagggcaccggcaacatgatcgacggcagcatcctggccagctacggcaacgtgatcgtgatcaccctgaactacagagtgggcgtgctgggcttcctgagcaccggcgaccaggccgccaagggcaactacggcctgctggaccagatccaggccctgagatgggtgagcgagaacatcgccttcttcggcggcgaccccagaagaatcaccgtgttcggcagcggcatcggcgccagctgcgtgagcctgctgaccctgagccaccacagcgagggcctgttccagagagccatcatccagagcggcagcgccctgagcagctgggccgtgaactaccagcccgtgaagtacaccagcctgctggccgacaaggtgggctgcaacgtgctggacaccgtggacatggtggactgcctgagacagaagagcgccaaggagctggtggagcaggacatccagcccgccagataccacgtggccttcggccccgtgatcgacggcgacgtgatccccgacgaccccgagatcctgatggagcagggcgagttcctgaactacgacatcatgctgggcgtgaaccagggcgagggcctgaagttcgtggagggcgtggtggaccccgaggacggcgtgagcggcaccgacttcgactacagcgtgagcaacttcgtggacaacctgtacggctaccccgagggcaaggacaccctgagagagaccatcaagttcatgtacaccgactgggccgacagagacaaccccgagaccagaagaaagaccctggtggccctgttcaccgaccaccagtgggtggagcccagcgtggtgaccgccgacctgcacgccagatacggcagccccacctacttctacgccttctaccaccactgccagagcctgatgaagcccgcctggagcgacgccgcccacggcgacgaggtgccctacgtgttcggcgtgcccatggtgggccccaccgacctgttcccctgcaacttcagcaagaacgacgtgatgctgagcgccgtggtgatgacctactggaccaacttcgccaagaccggcgaccccaacaagcccgtgccccaggacaccaagttcatccacaccaaggccaacagattcgaggaggtggcctggagcaagtacaaccccagagaccagctgtacctgcacatcggcctgaagcccagagtgagagaccactacagagccaccaaggtggccttctggaagcacctggtgccccacctgtacaacctgcacgacatgttccactacaccagcaccaccaccaaggtgcccccccccgacaccacccacagcagccacatcaccagaagacccaacggcaagacctggagcaccaagagacccgccatcagccccgcctacagcaacgagaacgcccagggcagctggaacggcgaccaggacgccggccccctgctggtggagaaccccagagactacagcaccgagctgagcgtgaccatcgccgtgggcgccagcctgctgttcctgaacgtgctggccttcgccgccctgtactacagaaaggacaagagaagacaggagcccctgagacagcccagcccccagagaggcgccggcgcccccgagctgggcgccgcccccgaggaggagctggccgccctgcagctgggccccacccaccacgagtgcgaggccggccccccccacgacaccctgagactgaccgccctgcccgactacaccctgaccctgagaagaagccccgacgacatccccctgatgacccccaacaccatcaccatgatccccaacagcctggtgggcctgcagaccctgcacccctacaacaccttcgccgccggcttcaacagcaccggcctgccccacagccacagcaccaccagagtgtag

SEQ ID NO: 90856 - DNA, 1056 bp, Artificial Sequence
  Description of Artificial Sequence: Synthetic coding sequence
atgctgcccgtgtggttcaccgccaacctggacatcgtggccacctacatccaggagcccaacgaggactgcctgtacctgaacgtgtacgtgcccaccgaggacggcagcggcgccaagaagcagggcgaggacctggccgacaacgacggcgacgaggacgaggacatcagagacagcggcgccaagcccgtgatggtgtacatccacggcggcagctacatggagggcaccggcaacatgatcgacggcagcatcctggccagctacggcaacgtgatcgtgatcaccctgaactacagagtgggcgtgctgggcttcctgagcaccggcgaccaggccgccaagggcaactacggcctgctggaccagatccaggccctgagatgggtgagcgagaacatcgccttcttcggcggcgaccccagaagaatcaccgtgttcggcagcggcatcggcgccagctgcgtgagcctgctgaccctgagccaccacagcgagggcctgttccagagagccatcatccagagcggcagcgccctgagcagctgggccgtgaactaccagcccgtgaagtacaccagcctgctggccgacaaggtgggctgcaacgtgctggacaccgtggacatggtggactgcctgagacagaagagcgccaaggagctggtggagcaggacatccagcccgccagataccacgtggccttcggccccgtgatcgacggcgacgtgatccccgacgaccccgagatcctgatggagcagggcgagttcctgaactacgacatcatgctgggcgtgaaccagggcgagggcctgaagttcgtggagggcgtggtggaccccgaggacggcgtgagcggcaccgacttcgactacagcgtgagcatcctgtggaccatctgcatggccatcctgagagtgagaaccccctgcgagagacccagcagcagctgcatccagaccggccagaccgtgaccaccctgagacccgccgtgaagcactggtggcacagcagcctgaccaccagcggctggagcccccagtggtag

SEQ ID NO: 90857 - DNA, 771 bp, Artificial Sequence
  Description of Artificial Sequence: Synthetic coding sequence
atgctgagaccccagggcctgctgtggctgcccctgctgttcaccagcgtgtgcgtgatgctgaacagcaacgtgctgctgtggatcaccgccctggccatcaagttcaccctgatcgacagccaggcccagtaccccgtggtgaacaccaactacggcaagatccagggcctgagaacccccctgcccagcgagatcctgggccccgtggagcagtacctgggcgtgccctacgccagcccccccaccggcgagagaagattccagccccccgagagccccagcagctggaccggcatcagaaacgccacccagttcagcgccgtgtgcccccagcacctggacgagagattcctgctgcacgacatgctgcccatctggttcaccaccagcctggacaccctgatgacctacgtgcaggaccagaacgaggactgcctgtacctgaacatctacgtgcccatggaggacggcaccaacatcaagagaaacgccgacgacatcaccagcaacgaccacggcgaggacaaggacatccacgagcagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcatgcaggaggccagactgtgcggcagcagcaagatgttcaactacttcaagagccccttcaccaacctgatcaacttcttctag

SEQ ID NO: 90858 - DNA, 2451 bp, Artificial Sequence
  Description of Artificial Sequence: Synthetic coding sequence
atgctgagaccccagggcctgctgtggctgcccctgctgttcaccagcgtgtgcgtgatgctgaacagcaacgtgctgctgtggatcaccgccctggccatcaagttcaccctgatcgacagccaggcccagtaccccgtggtgaacaccaactacggcaagatccagggcctgagaacccccctgcccagcgagatcctgggccccgtggagcagtacctgggcgtgccctacgccagcccccccaccggcgagagaagattccagccccccgagagccccagcagctggaccggcatcagaaacgccacccagttcagcgccgtgtgcccccagcacctggacgagagattcctgctgcacgacatgctgcccatctggttcaccaccagcctggacaccctgatgacctacgtgcaggaccagaacgaggactgcctgtacctgaacatctacgtgcccatggaggacgacatccacgagcagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgaagaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagacaccccagcccccagagaaacaccaccaacgacatcacccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccttcatgacccccaacaccatcaccatgatccccaacaccctgatgggcatgcagcccctgcacaccttcaagaccttcagcggcggccagaacagcaccaacctgccccacggccacagcaccaccagagtgtag

SEQ ID NO: 90859 - DNA, 2451 bp, Artificial Sequence; identical to SEQ ID NO: 90858
  Description of Artificial Sequence: Synthetic coding sequence

SEQ ID NO: 90860 - DNA, 2622 bp, Artificial Sequence
  Description of Artificial Sequence: Synthetic coding sequence
atgctgagaccccagggcctgctgtggctgcccctgctgttcaccagcgtgtgcgtgatgctgaacagcaacgtgctgctgtggatcaccgccctggccatcaagttcaccctgatcgacagccaggcccagtaccccgtggtgaacaccaactacggcaagatccagggcctgagaacccccctgcccagcgagatcctgggccccgtggagcagtacctgggcgtgccctacgccagcccccccaccggcgagagaagattccagccccccgagagccccagcagctggaccggcatcagaaacgccacccagttcagcgccgtgtgcccccagcacctggacgagagattcctgctgcacgacatgctgcccatctggttcaccaccagcctggacaccctgatgacctacgtgcaggaccagaacgaggactgcctgtacctgaacatctacgtgcccatggaggacggcaccaacatcaagagaaacgccgacgacatcaccagcaacgaccacggcgaggacaaggacatccacgagcagaacagcaagaagcccgtgatggtgtacatccacggcggcagctacatggagggcaccggcaacatgatcgacggcagcatcctggccagctacggcaacgtgatcgtgatcaccatcaactacagactgggcatcctggcccagaacaccctggcccacggcaactgcaagcacagatgccagctgcacctgcaggcccccagagactgcaagagcgcctaccccttcagaaacgaggacgagatcagaggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgaagaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagacaccccagcccccagagaaacaccaccaacgacatcacccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccttcatgacccccaacaccatcaccatgatccccaacaccctgatgggcatgcagcccctgcacaccttcaagaccttcagcggcggccagaacagcaccaacctgccccacggccacagcaccaccagagtgtag

SEQ ID NO: 90861 - DNA, 1947 bp, Artificial Sequence
  Description of Artificial Sequence: Synthetic coding sequence
atggtgtacatccacggcggcagctacatggagggcaccggcaacatgatcgacggcagcatcctggccagctacggcaacgtgatcgtgatcaccatcaactacagactgggcatcctgggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgaagaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagacaccccagcccccagagaaacaccaccaacgacatcacccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccttcatgacccccaacaccatcaccatgatccccaacaccctgatgggcatgcagcccctgcacaccttcaagaccttcagcggcggccagaacagcaccaacctgccccacggccacagcaccaccagagtgtag

SEQ ID NO: 90862 - DNA, 711 bp, Artificial Sequence
  Description of Artificial Sequence: Synthetic coding sequence
tgaaacagcaacgtgctgctgtggatcaccgccctggccatcaagttcaccctgatcgacagccaggcccagtaccccgtggtgaacaccaactacggcaagatccagggcctgagaacccccctgcccagcgagatcctgggccccgtggagcagtacctgggcgtgccctacgccagcccccccaccggcgagagaagattccagccccccgagagccccagcagctggaccggcatcagaaacgccacccagttcagcgccgtgtgcccccagcacctggacgagagattcctgctgcacgacatgctgcccatctggttcaccaccagcctggacaccctgatgacctacgtgcaggaccagaacgaggactgcctgtacctgaacatctacgtgcccatggaggacggcaccaacatcaagagaaacgccgacgacatcaccagcaacgaccacggcgaggacaaggacatccacgagcagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcatgcaggaggccagactgtgcggcagcagcaagatgttcaactacttcaagagccccttcaccaacctgatcaacttcttctag

SEQ ID NO: 90863 - DNA, 2511 bp, Artificial Sequence
  Description of Artificial Sequence: Synthetic coding sequence
atgctgagaccccagggcctgctgtggctgcccctgctgttcaccagcgtgtgcgtgatgctgaacagcaacgtgctgctgtggatcaccgccctggccatcaagttcaccctgatcgacagccaggcccagtaccccgtggtgaacaccaactacggcaagatccagggcctgagaacccccctgcccagcgagatcctgggccccgtggagcagtacctgggcgtgccctacgccagcccccccaccggcgagagaagattccagccccccgagagccccagcagctggaccggcatcagaaacgccacccagttcagcgccgtgtgcccccagcacctggacgagagattcctgctgcacgacatgctgcccatctggttcaccaccagcctggacaccctgatgacctacgtgcaggaccagaacgaggactgcctgtacctgaacatctacgtgcccatggaggacggcaccaacatcaagagaaacgccgacgacatcaccagcaacgaccacggcgaggacaaggacatccacgagcagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgaagaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagacaccccagcccccagagaaacaccaccaacgacatcacccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccttcatgacccccaacaccatcaccatgatccccaacaccctgatgggcatgcagcccctgcacaccttcaagaccttcagcggcggccagaacagcaccaacctgccccacggccacagcaccaccagagtgtag

SEQ ID NO: 90864 - DNA, 1824 bp, Artificial Sequence
  Description of Artificial Sequence: Synthetic coding sequence
atgatcgccagatgcctgctggccgtgagaagcctgagaagagtgggcggcagcagaatcctgctgagaatgaccctgggcagagaggtgatgagccccctgcaggccatgagcagctacaccgtggccggcagaaacgtgctgagatgggacctgagccccgagcagatcaagaccagaaccgaggagctgatcgtgcagaccaagcaggtgtacgacgccgtgggcatgctgggcatcgaggaggtgacctacgagaactgcctgcaggccctggccgacgtggaggtgaagtacatcgtggagagaaccatgctggacttcccccagcacgtgagcagcgacaaggaggtgagagccgccagcaccgaggccgacaagagactgagcagattcgacatcgagatgagcatgagaggcgacatcttcgagagaatcgtgcacctgcaggagacctgcgacctgggcaagatcaagcccgaggccagaagatacctggagaagagcatcaagatgggcaagagaaacggcctgcacctgcccgagcaggtgcagaacgagatcaagagcatgaagaagagaatgagcgagctgtgcatcgacttcaacaagaacctgaacgaggacgacaccttcctggtgttcagcaaggccgagctgggcgccctgcccgacgacttcatcgacagcctggagaagaccgacgacgacaagtacaagatcaccctgaagtacccccactacttccccgtgatgaagaagtgctgcatccccgagaccagaagaagaatggagatggccttcaacaccagatgcaaggaggagaacaccatcatcctgcagcagctgctgcccctgagaaccaaggtggccaagctgctgggctacagcacccacgccgacttcgtgctggagatgaacaccgccaagagcaccagcagagtgaccgccttcctggacgacctgagccagaagctgaagcccctgggcgaggccgagagagagttcatcctgaacctgaagaagaaggagtgcaaggacagaggcttcgagtacgacggcaagatcaacgcctgggacctgtactactacatgacccagaccgaggagctgaagtacagcatcgaccaggagttcctgaaggagtacttccccatcgaggtggtgaccgagggcctgctgaacacctaccaggagctgctgggcctgagcttcgagcagatgaccgacgcccacgtgtggaacaagagcgtgaccctgtacaccgtgaaggacaaggccaccggcgaggtgctgggccagttctacctggacctgtaccccagagagggcaagtacaaccacgccgcctgcttcggcctgcagcccggctgcctgctgcccgacggcagcagaatgatggccgtggccgccctggtggtgaacttcagccagcccgtggccggcagacccagcctgctgagacacgacgaggtgagaacctacttccacgagttcggccacgtgatgcaccagatctgcgcccagaccgacttcgccagattcagcggcaccaacgtggagaccgacttcgtggaggtgcccagccagatgctggagaactgggtgtgggacgtggacagcctgagaagactgagcaagcactacaaggacggcagccccatcgccgacgacctgctggagaagctggtggccagcagactggtgaacaccggcctgctgaccctgagacagatcgtgctgagcaaggtggaccagagcctgcacaccaacaccagcctggacgccgccagcaacatgcccaacaccgcccagaagtactag

SEQ ID NO: 90865 - DNA, 2115 bp, Artificial Sequence
  Description of Artificial Sequence: Synthetic coding sequence
atgatcgccagatgcctgctggccgtgagaagcctgagaagagtgggcggcagcagaatcctgctgagaatgaccctgggcagagaggtgatgagccccctgcaggccatgagcagctacaccgtggccggcagaaacgtgctgagatgggacctgagccccgagcagatcaagaccagaaccgaggagctgatcgtgcagaccaagcaggtgtacgacgccgtgggcatgctgggcatcgaggaggtgacctacgagaactgcctgcaggccctggccgacgtggaggtgaagtacatcgtggagagaaccatgctggacttcccccagcacgtgagcagcgacaaggaggtgagagccgccagcaccgaggccgacaagagactgagcagattcgacatcgagatgagcatgagaggcgacatcttcgagagaatcgtgcacctgcaggagacctgcgacctgggcaagatcaagcccgaggccagaagatacctggagaagagcatcaagatgggcaagagaaacggcctgcacctgcccgagcaggtgcagaacgagatcaagagcatgaagaagagaatgagcgagctgtgcatcgacttcaacaagaacctgaacgaggacgacaccttcctggtgttcagcaaggccgagctgggcgccctgcccgacgacttcatcgacagcctggagaagaccgacgacgacaagtacaagatcaccctgaagtacccccactacttccccgtgatgaagaagtgctgcatccccgagaccagaagaagaatggagatggccttcaacaccagatgcaaggaggagaacaccatcatcctgcagcagctgctgcccctgagaaccaaggtggccaagctgctgggctacagcacccacgccgacttcgtgctggagatgaacaccgccaagagcaccagcagagtgaccgccttcctggacgacctgagccagaagctgaagcccctgggcgaggccgagagagagttcatcctgaacctgaagaagaaggagtgcaaggacagaggcttcgagtacgacggcaagatcaacgcctgggacctgtactactacatgacccagaccgaggagctgaagtacagcatcgaccaggagttcctgaaggagtacttccccatcgaggtggtgaccgagggcctgctgaacacctaccaggagctgctgggcctgagcttcgagcagatgaccgacgcccacgtgtggaacaagagcgtgaccctgtacaccgtgaaggacaaggccaccggcgaggtgctgggccagttctacctggacctgtaccccagagagggcaagtacaaccacgccgcctgcttcggcctgcagcccggctgcctgctgcccgacggcagcagaatgatggccgtggccgccctggtggtgaacttcagccagcccgtggccggcagacccagcctgctgagacacgacgaggtgagaacctacttccacgagttcggccacgtgatgcaccagatctgcgcccagaccgacttcgccagattcagcggcaccaacgtggagaccgacttcgtggaggtgcccagccagatgctggagaactgggtgtgggacgtggacagcctgagaagactgagcaagcactacaaggacggcagccccatcgccgacgacctgctggagaagctggtggccagcagactggtgaacaccggcctgctgaccctgagacagatcgtgctgagcaaggtggaccagagcctgcacaccaacaccagcctggacgccgccagcgagtacgccaagtactgcagcgagatcctgggcgtggccgccacccccggcaccaacatgcccgccaccttcggccacctggccggcggctacgacggccagtactacggctacctgtggagcgaggtgttcagcatggacatgttctacagctgcttcaagaaggagggcatcatgaaccccgaggtgggcatgaagtacagaaacctgatcctgaagcccggcggcagcctggacggcatggacatgctgcacaacttcctgaagagagagcccaaccagaaggccttcctgatgagcagaggcctgcacgccccctag

SEQ ID NO: 90866 - DNA, 1803 bp, Artificial Sequence
  Description of Artificial Sequence: Synthetic coding sequence
atgctggacttcccccagcacgtgagcagcgacaaggaggtgagagccgccagcaccgaggccgacaagagactgagcagattcgacatcgagatgagcatgagaggcgacatcttcgagagaatcgtgcacctgcaggagacctgcgacctgggcaagatcaagcccgaggccagaagatacctggagaagagcatcaagatgggcaagagaaacggcctgcacctgcccgagcaggtgcagaacgagatcaagagcatgaagaagagaatgagcgagctgtgcatcgacttcaacaagaacctgaacgaggacgacaccttcctggtgttcagcaaggccgagctgggcgccctgcccgacgacttcatcgacagcctggagaagaccgacgacgacaagtacaagatcaccctgaagtacccccactacttccccgtgatgaagaagtgctgcatccccgagaccagaagaagaatggagatggccttcaacaccagatgcaaggaggagaacaccatcatcctgcagcagctgctgcccctgagaaccaaggtggccaagctgctgggctacagcacccacgccgacttcgtgctggagatgaacaccgccaagagcaccagcagagtgaccgccttcctggacgacctgagccagaagctgaagcccctgggcgaggccgagagagagttcatcctgaacctgaagaagaaggagtgcaaggacagaggcttcgagtacgacggcaagatcaacgcctgggacctgtactactacatgacccagaccgaggagctgaagtacagcatcgaccaggagttcctgaaggagtacttccccatcgaggtggtgaccgagggcctgctgaacacctaccaggagctgctgggcctgagcttcgagcagatgaccgacgcccacgtgtggaacaagagcgtgaccctgtacaccgtgaaggacaaggccaccggcgaggtgctgggccagttctacctggacctgtaccccagagagggcaagtacaaccacgccgcctgcttcggcctgcagcccggctgcctgctgcccgacggcagcagaatgatggccgtggccgccctggtggtgaacttcagccagcccgtggccggcagacccagcctgctgagacacgacgaggtgagaacctacttccacgagttcggccacgtgatgcaccagatctgcgcccagaccgacttcgccagattcagcggcaccaacgtggagaccgacttcgtggaggtgcccagccagatgctggagaactgggtgtgggacgtggacagcctgagaagactgagcaagcactacaaggacggcagccccatcgccgacgacctgctggagaagctggtggccagcagactggtgaacaccggcctgctgaccctgagacagatcgtgctgagcaaggtggaccagagcctgcacaccaacaccagcctggacgccgccagcgagtacgccaagtactgcagcgagatcctgggcgtggccgccacccccggcaccaacatgcccgccaccttcggccacctggccggcggctacgacggccagtactacggctacctgtggagcgaggtgttcagcatggacatgttctacagctgcttcaagaaggagggcatcatgaaccccgaggtgggcatgaagtacagaaacctgatcctgaagcccggcggcagcctggacggcatggacatgctgcacaacttcctgaagagagagcccaaccagaaggccttcctgatgagcagaggcctgcacgccccctag

SEQ ID NO: 90867 - DNA, 366 bp, Artificial Sequence
  Description of Artificial Sequence: Synthetic coding sequence
atggccagaagagccggcggcgccagaatgttcggcagcctgctgctgttcgccctgctggccgccggcgtggcccccctgagctgggacctgcccgagcccagaagcagagccagcaagatcagagtgcacagcagaggcaacctgtgggccaccggccacttcatgggcaagaagagcctggagcccagcagccccagccccctgggcaccgccccccacaccagcctgagagaccagagactgcagctgagccacgacctgctgggcatcctgctgctgaagaaggccctgggcgtgagcctgagcagacccgccccccagatccagtacagaagactgctggtgcagatcctgcagaagtag

SEQ ID NO: 90868 - DNA, 465 bp, Artificial Sequence
  Description of Artificial Sequence: Synthetic coding sequence
atggccagaagagccggcggcgccagaatgttcggcagcctgctgctgttcgccctgctggccgccggcgtggcccccctgagctgggacctgcccgagcccagaagcagagccagcaagatcagagtgcacagcagaggcaacctgtgggccaccggccacttcatgggcaagaagagcctggagcccagcagccccagccccctgggcaccgccccccacaccagcctgagagaccagagactgcagctgagccacgacctgctgggcatcctgctgctgaagaaggccctgggcgtgagcctgagcagacccgccccccagatccaggaggccgccggcaccaacaccgccgagatgacccccatcatgggccagacccagcagagaggcctggactgcgcccaccccggcaaggtgctgaacggcaccctgctgatggcccccagcggctgcaagagctag

SEQ ID NO: 90869 - DNA, 1173 bp, Artificial Sequence
  Description of Artificial Sequence: Synthetic coding sequence
atgcccagcaagagcctgagcaacctgagcgtgaccaccggcgccaacgagagcggcagcgtgcccgagggctgggagagagacttcctgcccgccagcgacggcaccaccaccgagctggtgatcagatgcgtgatccccagcctgtacctgctgatcatcaccgtgggcctgctgggcaacatcatgctggtgaagatcttcatcaccaacagcgccatgagaagcgtgcccaacatcttcatcagcaacctggccgccggcgacctgctgctgctgctgacctgcgtgcccgtggacgccagcagatacttcttcgacgagtggatgttcggcaaggtgggctgcaagctgatccccgtgatccagctgaccagcgtgggcgtgagcgtgttcaccctgaccgccctgagcgccgacagatacagagccatcgtgaaccccatggacatgcagaccagcggcgccctgctgagaacctgcgtgaaggccatgggcatctgggtggtgagcgtgctgctggccgtgcccgaggccgtgttcagcgaggtggccagaatcagcagcctggacaacagcagcttcaccgcctgcatcccctacccccagaccgacgagctgcaccccaagatccacagcgtgctgatcttcctggtgtacttcctgatccccctggccatcatcagcatctactactaccacatcgccaagaccctgatcaagagcgcccacaacctgcccggcgagtacaacgagcacaccaagaagcagatggagaccagaaagagactggccaagatcgtgctggtgttcgtgggctgcttcatcttctgctggttccccaaccacatcctgtacatgtacagaagcttcaactacaacgagatcgaccccagcctgggccacatgatcgtgaccctggtggccagagtgctgagcttcggcaacagctgcgtgaaccccttcgccctgtacctgctgagcgagagcttcagaagacacttcaacagccagctgtgctgcggcagaaagagctaccaggagagaggcaccagctacctgctgagcagcagcgccgtgagaatgaccagcctgaagagcaacgccaagaacatggtgaccaacagcgtgctgctgaacggccacagcatgaagcaggagatggccctgtag

SEQ ID NO: 90870 - DNA, 1281 bp, Artificial Sequence
  Description of Artificial Sequence: Synthetic coding sequence
atgacccccctgtgcctgaactgcagcgtgctgcccggcgacctgtaccccggcggcgccagaaaccccatggcctgcaacggcagcgccgccagaggccacttcgaccccgaggacctgaacctgaccgacgaggccctgagactgaagtacctgggcccccagcagaccgagctgttcatgcccatctgcgccacctacctgctgatcttcgtggtgggcgccgtgggcaacggcctgacctgcctggtgatcctgagacacaaggccatgagaacccccaccaactactacctgttcagcctggccgtgagcgacctgctggtgctgctggtgggcctgcccctggagctgtacgagatgtggcacaactaccccttcctgctgggcgtgggcggctgctacttcagaaccctgctgttcgagatggtgtgcctggccagcgtgctgaacgtgaccgccctgagcgtggagagatacgtggccgtggtgcaccccctgcaggccagaagcatggtgaccagagcccacgtgagaagagtgctgggcgccgtgtggggcctggccatgctgtgcagcctgcccaacaccagcctgcacggcatcagacagctgcacgtgccctgcagaggccccgtgcccgacagcgccgtgtgcatgctggtgagacccagagccctgtacaacatggtggtgcagaccaccgccctgctgttcttctgcctgcccatggccatcatgagcgtgctgtacctgctgatcggcctgagactgagaagagagagactgctgctgatgcaggaggccaagggcagaggcagcgccgccgccagaagcagatacacctgcagactgcagcagcacgacagaggcagaagacaggtgaccaagatgctgttcgtgctggtggtggtgttcggcatctgctgggcccccttccacgccgacagagtgatgtggagcgtggtgagccagtggaccgacggcctgcacctggccttccagcacgtgcacgtgatcagcggcatcttcttctacctgggcagcgccgccaaccccgtgctgtacagcctgatgagcagcagattcagagagaccttccaggaggccctgtgcctgggcgcctgctgccacagactgagacccagacacagcagccacagcctgagcagaatgaccaccggcagcaccctgtgcgacgtgggcagcctgggcagctgggtgcaccccctggccggcaacgacggccccgaggcccagcaggagaccgaccccagctag

SEQ ID NO: 90871 - DNA, 1248 bp, Artificial Sequence
  Description of Artificial Sequence: Synthetic coding sequence
atgagcggcatggagaagctgcagaacgccagctggatctaccagcagaagctggaggaccccttccagaagcacctgaacagcaccgaggagtacctggccttcctgtgcggccccagaagaagccacttcttcctgcccgtgagcgtggtgtacgtgcccatcttcgtggtgggcgtgatcggcaacgtgctggtgtgcctggtgatcctgcagcaccaggccatgaagacccccaccaactactacctgttcagcctggccgtgagcgacctgctggtgctgctgctgggcatgcccctggaggtgtacgagatgtggagaaactaccccttcctgttcggccccgtgggctgctacttcaagaccgccctgttcgagaccgtgtgcttcgccagcatcctgagcatcaccaccgtgagcgtggagagatacgtggccatcctgcaccccttcagagccaagctgcagagcaccagaagaagagccctgagaatcctgggcatcgtgtggggcttcagcgtgctgttcagcctgcccaacaccagcatccacggcatcaagttccactacttccccaacggcagcctggtgcccggcagcgccacctgcaccgtgatcaagcccatgtggatctacaacttcatcatccaggtgaccagcttcctgttctacctgctgcccatgaccgtgatcagcgtgctgtactacctgatggccctgagactgaagaaggacaagagcctggaggccgacgagggcaacgccaacatccagagaccctgcagaaagagcgtgaacaagatgctgttcgtgctggtgctggtgttcgccatctgctgggcccccttccacatcgacagactgttcttcagcttcgtggaggagtggagcgagagcctggccgccgtgttcaacctggtgcacgtggtgagcggcgtgttcttctacctgagcagcgccgtgaaccccatcatctacaacctgctgagcagaagattccaggccgccttccagaacgtgatcagcagcttccacaagcagtggcacagccagcacgacccccagctgccccccgcccagagaaacatcttcctgaccgagtgccacttcgtggagctgaccgaggacatcggcccccagttcccctgccagagcagcatgcacaacagccacctgcccgccgccctgagcagcgagcagatgagcagaaccaactaccagagcttccacttcaacaagacctag

SEQ ID NO: 90872 - DNA, 5625 bp, Artificial Sequence
  Description of Artificial Sequence: Synthetic coding sequence
atgctgggcagcagcgtgaagagcgtgcagcccgaggtggagctgagcagcggcggcggcgacgagggcgccgacgagcccagaggcgccggcagaaaggccgccgccgccgacggcagaggcatgctgcccaagagagccaaggcccccggcggcggcggcggcatggccaaggccagcgccgccgagctgaaggtgttcaagagcggcagcgtggacagcagagtgcccggcggcccccccgccagcaacctgagaaagcagaagagcctgaccaacctgagcttcctgaccgacagcgagaagaagctgcagctgtacgagcccgagtggagcgacgacatggccaaggcccccaagggcctgggcaaggtgggcagcaagggcagagaggcccccctgatgagcaagaccctgagcaagagcgagcacagcctgttccaggccaagggcagccccgccggcggcgccaagacccccctggcccccctggcccccaacctgggcaagcccagcagaatccccagaggcccctacgccgaggtgaagcccctgagcaaggcccccgaggccgccgtgagcgaggacggcaagagcgacgacgagctgctgagcagcaaggccaaggcccagaagagcagcggccccgtgcccagcgccaagggccaggaggagagagccttcctgaaggtggaccccgagctggtggtgaccgtgctgggcgacctggagcagctgctgttcagccagatgctggaccccgagagccagagaaagagaaccgtgcagaacgtgctggacctgagacagaacctggaggagaccatgagcagcctgagaggcagccaggtgacccacagcagcctggagatgacctgctacgacagcgacgacgccaaccccagaagcgtgagcagcctgagcaacagaagcagccccctgagctggagatacggccagagcagccccagactgcaggccggcgacgcccccagcgtgggcggcagctgcagaagcgagggcacccccgcctggtacatgcacggcgagagagcccactacagccacaccatgcccatgagaagccccagcaagctgagccacatcagcagactggagctggtggagagcctggacagcgacgaggtggacctgaagagcggctacatgagcgacagcgacctgatgggcaagaccatgaccgaggacgacgacatcaccaccggctgggacgagagcagcagcatcagcagcggcctgagcgacgccagcgacaacctgagcagcgaggagttcaacgccagcagcagcctgaacagcctgcccagcacccccaccgccagcagaagaaacagcaccatcgtgctgagaaccgacagcgagaagagaagcctggccgagagcggcctgagctggttcagcgagagcgaggagaaggcccccaagaagctggagtacgacagcggcagcctgaagatggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgagccccaccgccgccaccacccccagaatcaccagaagcaacagcatccccacccacgaggccgccttcgagctgtacagcggcagccagatgggcagcaccctgagcctggccgagagacccaagggcatgatcagaagcggcagcttcagagaccccaccgacgacgtgcacggcagcgtgctgagcctggccagcagcgccagcagcacctacagcagcgccgaggagagaatgcagagcgagcagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgccaagaagaagaagaagaagagctggctgagaagcagcttcaacaaggccttcagcatcaagaagggccccaagagcgccagcagctacagcgacatcgaggagatcgccacccccgacagcagcgcccccagcagccccaagctgcagcacggcagcaccgagaccgccagccccagcatcaagagcagcaccagcagcagcgtgggcaccgacgtgaccgagggccccgcccaccccgccccccacaccagactgttccacgccaacgaggaggaggagcccgagaagaaggaggtgagcgagctgagaagcgagctgtgggagaaggagatgaagctgaccgacatcagactggaggccctgaacagcgcccaccagctggaccagctgagagagaccatgcacaacatgcagctggaggtggacctgctgaaggccgagaacgacagactgaaggtggcccccggccccagcagcggcagcacccccggccaggtgcccggcagcagcgccctgagcagccccagaagaagcctgggcctggccctgacccacagcttcggccccagcctggccgacaccgacctgagccccatggacggcatcagcacctgcggccccaaggaggaggtgaccctgagagtggtggtgagaatgcccccccagcacatcatcaagggcgacctgaagcagcaggagttcttcctgggctgcagcaaggtgagcggcaaggtggactggaagatgctggacgaggccgtgttccaggtgttcaaggactacatcagcaagatggaccccgccagcaccctgggcctgagcaccgagagcatccacggctacagcatcagccacgtgaagagagtgctggacgccgagccccccgagatgcccccctgcagaagaggcgtgaacaacatcagcgtgagcctgaagggcctgaaggagaagtgcgtggacagcctggtgttcgagaccctgatccccaagcccatgatgcagcactacatcagcctgctgctgaagcacagaagactggtgctgagcggccccagcggcaccggcaagacctacctgaccaacagactggccgagtacctggtggagagaagcggcagagaggtgaccgagggcatcgtgagcaccttcaacatgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggaccagagcaagctgtaccacctgcccccccccaccgtgggcccccacagcatcgccagcccccccgaggacagaaccgtgaaggacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90873 - DNA, 5634 bp, Artificial Sequence
  Description of Artificial Sequence: Synthetic coding sequence
atgctgggcagcagcgtgaagagcgtgcagcccgaggtggagctgagcagcggcggcggcgacgagggcgccgacgagcccagaggcgccggcagaaaggccgccgccgccgacggcagaggcatgctgcccaagagagccaaggcccccggcggcggcggcggcatggccaaggccagcgccgccgagctgaaggtgttcaagagcggcagcgtggacagcagagtgcccggcggcccccccgccagcaacctgagaaagcagaagagcctgaccaacctgagcttcctgaccgacagcgagaagaagctgcagctgtacgagcccgagtggagcgacgacatggccaaggcccccaagggcctgggcaaggtgggcagcaagggcagagaggcccccctgatgagcaagaccctgagcaagagcgagcacagcctgttccaggccaagggcagccccgccggcggcgccaagacccccctggcccccctggcccccaacctgggcaagcccagcagaatccccagaggcccctacgccgaggtgaagcccctgagcaaggcccccgaggccgccgtgagcgaggacggcaagagcgacgacgagctgctgagcagcaaggccaaggcccagaagagcagcggccccgtgcccagcgccaagggccaggaggagagagccttcctgaaggtggaccccgagctggtggtgaccgtgctgggcgacctggagcagctgctgttcagccagatgctggaccccgagagccagagaaagagaaccgtgcagaacgtgctggacctgagacagaacctggaggagaccatgagcagcctgagaggcagccaggtgacccacagcagcctggagatgacctgctacgacagcgacgacgccaaccccagaagcgtgagcagcctgagcaacagaagcagccccctgagctggagatacggccagagcagccccagactgcaggccggcgacgcccccagcgtgggcggcagctgcagaagcgagggcacccccgcctggtacatgcacggcgagagagcccactacagccacaccatgcccatgagaagccccagcaagctgagccacatcagcagactggagctggtggagagcctggacagcgacgaggtggacctgaagagcggctacatgagcgacagcgacctgatgggcaagaccatgaccgaggacgacgacatcaccaccggctgggacgagagcagcagcatcagcagcggcctgagcgacgccagcgacaacctgagcagcgaggagttcaacgccagcagcagcctgaacagcctgcccagcacccccaccgccagcagaagaaacagcaccatcgtgctgagaaccgacagcgagaagagaagcctggccgagagcggcctgagctggttcagcgagagcgaggagaaggcccccaagaagctggagtacgacagcggcagcctgaagatggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgagccccaccgccgccaccacccccagaatcaccagaagcaacagcatccccacccacgaggccgccttcgagctgtacagcggcagccagatgggcagcaccctgagcctggccgagagacccaagggcatgatcagaagcggcagcttcagagaccccaccgacgacgtgcacggcagcgtgctgagcctggccagcagcgccagcagcacctacagcagcgccgaggagagaatgcagagcgagcagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgccaagaagaagaagaagaagagctgggtgtacgagctgagaagcagcttcaacaaggccttcagcatcaagaagggccccaagagcgccagcagctacagcgacatcgaggagatcgccacccccgacagcagcgcccccagcagccccaagctgcagcacggcagcaccgagaccgccagccccagcatcaagagcagcaccagcagcagcgtgggcaccgacgtgaccgagggccccgcccaccccgccccccacaccagactgttccacgccaacgaggaggaggagcccgagaagaaggaggtgagcgagctgagaagcgagctgtgggagaaggagatgaagctgaccgacatcagactggaggccctgaacagcgcccaccagctggaccagctgagagagaccatgcacaacatgcagctggaggtggacctgctgaaggccgagaacgacagactgaaggtggcccccggccccagcagcggcagcacccccggccaggtgcccggcagcagcgccctgagcagccccagaagaagcctgggcctggccctgacccacagcttcggccccagcctggccgacaccgacctgagccccatggacggcatcagcacctgcggccccaaggaggaggtgaccctgagagtggtggtgagaatgcccccccagcacatcatcaagggcgacctgaagcagcaggagttcttcctgggctgcagcaaggtgagcggcaaggtggactggaagatgctggacgaggccgtgttccaggtgttcaaggactacatcagcaagatggaccccgccagcaccctgggcctgagcaccgagagcatccacggctacagcatcagccacgtgaagagagtgctggacgccgagccccccgagatgcccccctgcagaagaggcgtgaacaacatcagcgtgagcctgaagggcctgaaggagaagtgcgtggacagcctggtgttcgagaccctgatccccaagcccatgatgcagcactacatcagcctgctgctgaagcacagaagactggtgctgagcggccccagcggcaccggcaagacctacctgaccaacagactggccgagtacctggtggagagaagcggcagagaggtgaccgagggcatcgtgagcaccttcaacatgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggaccagagcaagctgtaccacctgcccccccccaccgtgggcccccacagcatcgccagcccccccgaggacagaaccgtgaaggacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90874 - DNA, 5610 bp, Artificial Sequence
  Description of Artificial Sequence: Synthetic coding sequence
atgctgggcagcagcgtgaagagcgtgcagcccgaggtggagctgagcagcggcggcggcgacgagggcgccgacgagcccagaggcgccggcagaaaggccgccgccgccgacggcagaggcatgctgcccaagagagccaaggcccccggcggcggcggcggcatggccaaggccagcgccgccgagctgaaggtgttcaagagcggcagcgtggacagcagagtgcccggcggcccccccgccagcaacctgagaaagcagaagagcctgaccaacctgagcttcctgaccgacagcgagaagaagctgcagctgtacgagcccgagtggagcgacgacatggccaaggcccccaagggcctgggcaaggtgggcagcaagggcagagaggcccccctgatgagcaagaccctgagcaagagcgagcacagcctgttccaggccaagggcagccccgccggcggcgccaagacccccctggcccccctggcccccaacctgggcaagcccagcagaatccccagaggcccctacgccgaggtgaagcccctgagcaaggcccccgaggccgccgtgagcgaggacggcaagagcgacgacgagctgctgagcagcaaggccaaggcccagaagagcagcggccccgtgcccagcgccaagggccaggaggagagagccttcctgaaggtggaccccgagctggtggtgaccgtgctgggcgacctggagcagctgctgttcagccagatgctggaccccgagagccagagaaagagaaccgtgcagaacgtgctggacctgagacagaacctggaggagaccatgagcagcctgagaggcagccaggtgacccacagcagcctggagatgacctgctacgacagcgacgacgccaaccccagaagcgtgagcagcctgagcaacagaagcagccccctgagctggagatacggccagagcagccccagactgcaggccggcgacgcccccagcgtgggcggcagctgcagaagcgagggcacccccgcctggtacatgcacggcgagagagcccactacagccacaccatgcccatgagaagccccagcaagctgagccacatcagcagactggagctggtggagagcctggacagcgacgaggtggacctgaagagcggctacatgagcgacagcgacctgatgggcaagaccatgaccgaggacgacgacatcaccaccggctgggacgagagcagcagcatcagcagcggcctgagcgacgccagcgacaacctgagcagcgaggagttcaacgccagcagcagcctgaacagcctgcccagcacccccaccgccagcagaagaaacagcaccatcgtgctgagaaccgacagcgagaagagaagcctggccgagagcggcctgagctggttcagcgagagcgaggagaaggcccccaagaagctggagtacgacagcggcagcctgaagatggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgagccccaccgccgccaccacccccagaatcaccagaagcaacagcatccccacccacgaggccgccttcgagctgtacagcggcagccagatgggcagcaccctgagcctggccgagagacccaagggcatgatcagaagcggcagcttcagagaccccaccgacgacgtgcacggcagcgtgctgagcctggccagcagcgccagcagcacctacagcagccagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgccaagaagaagaagaagaagagctgggtgtacgagctgagaagcagcttcaacaaggccttcagcatcaagaagggccccaagagcgccagcagctacagcgacatcgaggagatcgccacccccgacagcagcgcccccagcagccccaagctgcagcacggcagcaccgagaccgccagccccagcatcaagagcagcaccagcagcagcgtgggcaccgacgtgaccgagggccccgcccaccccgccccccacaccagactgttccacgccaacgaggaggaggagcccgagaagaaggaggtgagcgagctgagaagcgagctgtgggagaaggagatgaagctgaccgacatcagactggaggccctgaacagcgcccaccagctggaccagctgagagagaccatgcacaacatgcagctggaggtggacctgctgaaggccgagaacgacagactgaaggtggcccccggccccagcagcggcagcacccccggccaggtgcccggcagcagcgccctgagcagccccagaagaagcctgggcctggccctgacccacagcttcggccccagcctggccgacaccgacctgagccccatggacggcatcagcacctgcggccccaaggaggaggtgaccctgagagtggtggtgagaatgcccccccagcacatcatcaagggcgacctgaagcagcaggagttcttcctgggctgcagcaaggtgagcggcaaggtggactggaagatgctggacgaggccgtgttccaggtgttcaaggactacatcagcaagatggaccccgccagcaccctgggcctgagcaccgagagcatccacggctacagcatcagccacgtgaagagagtgctggacgccgagccccccgagatgcccccctgcagaagaggcgtgaacaacatcagcgtgagcctgaagggcctgaaggagaagtgcgtggacagcctggtgttcgagaccctgatccccaagcccatgatgcagcactacatcagcctgctgctgaagcacagaagactggtgctgagcggccccagcggcaccggcaagacctacctgaccaacagactggccgagtacctggtggagagaagcggcagagaggtgaccgagggcatcgtgagcaccttcaacatgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggaccagagcaagctgtaccacctgcccccccccaccgtgggcccccacagcatcgccagcccccccgaggacagaaccgtgaaggacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90875 - DNA, 5454 bp, Artificial Sequence
  Description of Artificial Sequence: Synthetic coding sequence
atgctgggcagcagcgtgaagagcgtgcagcccgaggtggagctgagcagcggcggcggcgacgagggcgccgacgagcccagaggcgccggcagaaaggccgccgccgccgacggcagaggcatgctgcccaagagagccaaggcccccggcggcggcggcggcatggccaaggccagcgccgccgagctgaaggtgttcaagagcggcagcgtggacagcagagtgcccggcggcccccccgccagcaacctgagaaagcagaagagcctgaccaacctgagcttcctgaccgacagcgagaagaagctgcagctgtacgagcccgagtggagcgacgacatggccaaggcccccaagggcctgggcaaggtgggcagcaagggcagagaggcccccctgatgagcaagaccctgagcaagagcgagcacagcctgttccaggccaagggcagccccgccggcggcgccaagacccccctggcccccctggcccccaacctgggcaagcccagcagaatccccagaggcccctacgccgaggtgaagcccctgagcaaggcccccgaggccgccgtgagcgaggacggcaagagcgacgacgagctgctgagcagcaaggccaaggcccagaagagcagcggccccgtgcccagcgccaagggccaggaggagagagccttcctgaaggtggaccccgagctggtggtgaccgtgctgggcgacctggagcagctgctgttcagccagatgctggaccccgagagccagagaaagagaaccgtgcagaacgtgctggacctgagacagaacctggaggagaccatgagcagcctgagaggcagccaggtgacccacagcagcctggagatgacctgctacgacagcgacgacgccaaccccagaagcgtgagcagcctgagcaacagaagcagccccctgagctggagatacggccagagcagccccagactgcaggccggcgacgcccccagcgtgggcggcagctgcagaagcgagggcacccccgcctggtacatgcacggcgagagagcccactacagccacaccatgcccatgagaagccccagcaagctgagccacatcagcagactggagctggtggagagcctggacagcgacgaggtggacctgaagagcggctacatgagcgacagcgacctgatgggcaagaccatgaccgaggacgacgacatcaccaccggctgggacgagagcagcagcatcagcagcggcctgagcgacgccagcgacaacctgagcagcgaggagttcaacgccagcagcagcctgaacagcctgcccagcacccccaccgccagcagaagaaacagcaccatcgtgctgagaaccgacagcgagaagagaagcctggccgagagcggcctgagctggttcagcgagagcgaggagaaggcccccaagaagctggagtacgacagcggcagcctgaagatggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgcacggcagcgtgctgagcctggccagcagcgccagcagcacctacagcagcgccgaggagagaatgcagagcgagcagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgccaagaagaagaagaagaagagctggctgagaagcagcttcaacaaggccttcagcatcaagaagggccccaagagcgccagcagctacagcgacatcgaggagatcgccacccccgacagcagcgcccccagcagccccaagctgcagcacggcagcaccgagaccgccagccccagcatcaagagcagcaccagcagcagcgtgggcaccgacgtgaccgagggccccgcccaccccgccccccacaccagactgttccacgccaacgaggaggaggagcccgagaagaaggaggtgagcgagctgagaagcgagctgtgggagaaggagatgaagctgaccgacatcagactggaggccctgaacagcgcccaccagctggaccagctgagagagaccatgcacaacatgcagctggaggtggacctgctgaaggccgagaacgacagactgaaggtggcccccggccccagcagcggcagcacccccggccaggtgcccggcagcagcgccctgagcagccccagaagaagcctgggcctggccctgacccacagcttcggccccagcctggccgacaccgacctgagccccatggacggcatcagcacctgcggccccaaggaggaggtgaccctgagagtggtggtgagaatgcccccccagcacatcatcaagggcgacctgaagcagcaggagttcttcctgggctgcagcaaggtgagcggcaaggtggactggaagatgctggacgaggccgtgttccaggtgttcaaggactacatcagcaagatggaccccgccagcaccctgggcctgagcaccgagagcatccacggctacagcatcagccacgtgaagagagtgctggacgccgagccccccgagatgcccccctgcagaagaggcgtgaacaacatcagcgtgagcctgaagggcctgaaggagaagtgcgtggacagcctggtgttcgagaccctgatccccaagcccatgatgcagcactacatcagcctgctgctgaagcacagaagactggtgctgagcggccccagcggcaccggcaagacctacctgaccaacagactggccgagtacctggtggagagaagcggcagagaggtgaccgagggcatcgtgagcaccttcaacatgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggaccagagcaagctgtaccacctgcccccccccaccgtgggcccccacagcatcgccagcccccccgaggacagaaccgtgaaggacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90876 - DNA, 783 bp, Artificial Sequence
  Description of Artificial Sequence: Synthetic coding sequence
atgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcagcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggacgacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90877 - DNA, 2193 bp, Artificial Sequence
  Description of Artificial Sequence: Synthetic coding sequence
atggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgagccccaccgccgccaccacccccagaatcaccagaagcaacagcatccccacccacgaggccgccttcgagctgtacagcggcagccagatgggcagcaccctgagcctggccgagagacccaagggcatgatcagaagcggcagcttcagagaccccaccgacgacgtgcacggcagcgtgctgagcctggccagcagcgccagcagcacctacagcagccagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaagatggagttcagaagctgccaccccggctggagcgccctggccagaagctggctgaccgccaacagcgccagccaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgcctag

SEQ ID NO: 90878 - DNA, 4452 bp, Artificial Sequence
  Description of Artificial Sequence: Synthetic coding sequence
atgctgcacctgcccctgcccagaagcggcagaaccgtgaacttccccagaagctgggacgagagcagcagcatcagcagcggcctgagcgacgccagcgacaacctgagcagcgaggagttcaacgccagcagcagcctgaacagcctgcccagcacccccaccgccagcagaagaaacagcaccatcgtgctgagaaccgacagcgagaagagaagcctggccgagagcggcctgagctggttcagcgagagcgaggagaaggcccccaagaagctggagtacgacagcggcagcctgaagatggagcccggcaccagcaagtggagaagagagagacccgagagctgcgacgacagcagcaagggcggcgagctgaagaagcccatcagcctgggccaccccggcagcctgaagaagggcaagaccccccccgtggccgtgaccagccccatcacccacaccgcccagagcgccctgaaggtggccggcaagcccgagggcaaggccaccgacaagggcaagctggccgtgaagaacaccggcctgcagagaagcagcagcgacgccggcagagacagactgagcgacgccaagaagccccccagcggcatcgccagacccagcaccagcggcagcttcggctacaagaagcccccccccgccaccggcaccgccaccgtgatgcagaccggcggcagcgccaccctgagcaagatccagaagagcagcggcatccccgtgaagcccgtgaacggcagaaagaccagcctggacgtgagcaacagcgccgagcccggcttcctggcccccggcgccagaagcaacatccagtacagaagcctgcccagacccgccaagagcagcagcatgagcgtgaccggcggcagaggcggccccagacccgtgagcagcagcatcgaccccagcctgctgagcaccaagcagggcggcctgacccccagcagactgaaggagcccaccaaggtggccagcggcagaaccacccccgcccccgtgaaccagaccgacagagagaaggagaaggccaaggccaaggccgtggccctggacagcgacaacatcagcctgaagagcatcggcagccccgagagcacccccaagaaccaggccagccaccccaccgccaccaagctggccgagctgccccccacccccctgagagccaccgccaagagcttcgtgaagccccccagcctggccaacctggacaaggtgaacagcaacagcctggacctgcccagcagcagcgacaccacccacgccagcaaggtgcccgacctgcacgccaccagcagcgccagcggcggccccctgcccagctgcttcacccccagccccgcccccatcctgaacatcaacagcgccagcttcagccagggcctggagctgatgagcggcttcagcgtgcccaaggagaccagaatgtaccccaagctgagcggcctgcacagaagcatggagagcctgcagatgcccatgagcctgcccagcgccttccccagcagcacccccgtgcccaccccccccgccccccccgccgcccccaccgaggaggagaccgaggagctgacctggagcggcagccccagagccggccagctggacagcaaccagagagacagaaacaccctgcccaagaagggcctgagataccagctgcagagccaggaggagaccaaggagagaagacacagccacaccatcggcggcctgcccgagagcgacgaccagagcgagctgcccagcccccccgccctgcccatgagcctgagcgccaagggccagctgaccaacatcgtgagccccaccgccgccaccacccccagaatcaccagaagcaacagcatccccacccacgaggccgccttcgagctgtacagcggcagccagatgggcagcaccctgagcctggccgagagacccaagggcatgatcagaagcggcagcttcagagaccccaccgacgacgtgcacggcagcgtgctgagcctggccagcagcgccagcagcacctacagcagcgccgaggagagaatgcagagcgagcagatcagaaagctgagaagagagctggagagcagccaggagaaggtggccaccctgaccagccagctgagcgccaacgccaacctggtggccgccttcgagcagagcctggtgaacatgaccagcagactgagacacctggccgagaccgccgaggagaaggacaccgagctgctggacctgagagagaccatcgacttcctgaagaagaagaacagcgaggcccaggccgtgatccagggcgccctgaacgccagcgagaccacccccaaggagctgagaatcaagagacagaacagcagcgacagcatcagcagcctgaacagcatcaccagccacagcagcatcggcagcagcaaggacgccgacgccaagaagaagaagaagaagagctggctgagaagcagcttcaacaaggccttcagcatcaagaagggccccaagagcgccagcagctacagcgacatcgaggagatcgccacccccgacagcagcgcccccagcagccccaagctgcagcacggcagcaccgagaccgccagccccagcatcaagagcagcaccagcagcagcgtgggcaccgacgtgaccgagggccccgcccaccccgccccccacaccagactgttccacgccaacgaggaggaggagcccgagaagaaggaggtgagcgagctgagaagcgagctgtgggagaaggagatgaagctgaccgacatcagactggaggccctgaacagcgcccaccagctggaccagctgagagagaccatgcacaacatgcagctggaggtggacctgctgaaggccgagaacgacagactgaaggtggcccccggccccagcagcggcagcacccccggccaggtgcccggcagcagcgccctgagcagccccagaagaagcctgggcctggccctgacccacagcttcggccccagcctggccgacaccgacctgagccccatggacggcatcagcacctgcggccccaaggaggaggtgaccctgagagtggtggtgagaatgcccccccagcacatcatcaagggcgacctgaagcagcaggagttcttcctgggctgcagcaaggtgagcggcaaggtggactggaagatgctggacgaggccgtgttccaggtgttcaaggactacatcagcaagatggaccccgccagcaccctgggcctgagcaccgagagcatccacggctacagcatcagccacgtgaagagagtgctggacgccgagccccccgagatgcccccctgcagaagaggcgtgaacaacatcagcgtgagcctgaagggcctgaaggagaagtgcgtggacagcctggtgttcgagaccctgatccccaagcccatgatgcagcactacatcagcctgctgctgaagcacagaagactggtgctgagcggccccagcggcaccggcaagacctacctgaccaacagactggccgagtacctggtggagagaagcggcagagaggtgaccgagggcatcgtgagcaccttcaacatgcaccagcagagctgcaaggacctgcagctgtacctgagcaacctggccaaccagatcgacagagagaccggcatcggcgacgtgcccctggtgatcctgctggacgacctgagcgaggccggcagcatcagcgagctggtgaacggcgccctgacctgcaagtaccacaagtgcccctacatcatcggcaccaccaaccagcccgtgaagatgacccccaaccacggcctgcacctgagcttcagaatgctgaccttcagcaacaacgtggagcccgccaacggcttcctggtgagatacctgagaagaaagctggtggagagcgacagcgacatcaacgccaacaaggaggagctgctgagagtgctggactgggtgcccaagctgtggtaccacctgcacaccttcctggagaagcacagcaccagcgacttcctgatcggcccctgcttcttcctgagctgccccatcggcatcgaggacttcagaacctggttcatcgacctgtggaacaacagcatcatcccctacctgcaggagggcgccaaggacggcatcaaggtgcacggccagaaggccgcctgggaggaccccgtggagtgggtgagagacaccctgccctggcccagcgcccagcaggaccagagcaagctgtaccacctgcccccccccaccgtgggcccccacagcatcgccagcccccccgaggacagaaccgtgaaggacagcacccccagcagcctggacagcgaccccctgatggccatgctgctgaagctgcaggaggccgccaactacatcgagagccccgacagagagaccatcctggaccccaacctgcaggccaccctgtag

SEQ ID NO: 90879 - DNA, 4482 bp, Artificial Sequence
  Description of Artificial Sequence: Synthetic coding sequence
atgctgtggcccagaaacctgaccagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactggctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90880 - DNA, 7290 bp, Artificial Sequence
  Description of Artificial Sequence: Synthetic coding sequence
atgcccgccatcctggtggccagcaagatgaagagcggcctgcccaagcccgtgcacagcgccgcccccatcctgcacgtgccccccgccagagccggcccccagccctgctacctgaagctgggcagcaaggtggaggtgagcaagaccacctaccccagccagatccccctgaagagccaggtgctgcagggcctgcaggagcccgccggcgagggcctgcccctgagaaagagcggcagcgtggagaacggcttcgacacccagatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactggctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90881 - DNA, 7299 bp, Artificial Sequence
  Description of Artificial Sequence: Synthetic coding sequence
atgcccgccatcctggtggccagcaagatgaagagcggcctgcccaagcccgtgcacagcgccgcccccatcctgcacgtgccccccgccagagccggcccccagccctgctacctgaagctgggcagcaaggtggaggtgagcaagaccacctaccccagccagatccccctgaagagccaggtgctgcagggcctgcaggagcccgccggcgagggcctgcccctgagaaagagcggcagcgtggagaacggcttcgacacccagatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactgggtgaacgagctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90882 - DNA, 7467 bp, Artificial Sequence
  Description of Artificial Sequence: Synthetic coding sequence
atgcccgccatcctggtggccagcaagatgaagagcggcctgcccaagcccgtgcacagcgccgcccccatcctgcacgtgccccccgccagagccggcccccagccctgctacctgaagctgggcagcaaggtggaggtgagcaagaccacctaccccagccagatccccctgaagagccaggtgctgcagggcctgcaggagcccgccggcgagggcctgcccctgagaaagagcggcagcgtggagaacggcttcgacacccagatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagcgccagcagcaaggacagcagccagagcaagatcatcagattcaccctgggccagaagaagatcagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggagagctgggagaagagcagcgtggacaacttcgtgagcagactgcacagcagcctgcacttcagcctgcccctgttccaccacgccagatacgagctggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactgggtgaacgagctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90883 - DNA, 7254 bp, Artificial Sequence
  Description of Artificial Sequence: Synthetic coding sequence
atgagcgtgatgctgtggagatgggagcagaacaacaccaccatgaagctgcagatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagcgccagcagcaaggacagcagccagagcaagatcatcagattcaccctgggccagaagaagatcagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggagagctgggagaagagcagcgtggacaacttcgtgagcagactgcacagcagcctgcacttcagcctgcccctgttccaccacgccagatacgagctggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactgggtgaacgagctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90884 - DNA, 4482 bp, Artificial Sequence; identical to SEQ ID NO: 90879
  Description of Artificial Sequence: Synthetic coding sequence

SEQ ID NO: 90885 - DNA, 2451 bp, Artificial Sequence
  Description of Artificial Sequence: Synthetic coding sequence
atgctgtggcccagaaacctgaccagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagctag

SEQ ID NO: 90886 - DNA, 7260 bp, Artificial Sequence
  Description of Artificial Sequence: Synthetic coding sequence
atggccatcgacctgtactgcggcctggcctgcctgtggggcatccacgagcccagacagatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagcgccagcagcaaggacagcagccagagcaagatcatcagattcaccctgggccagaagaagatcagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggagagctgggagaagagcagcgtggacaacttcgtgagcagactgcacagcagcctgcacttcagcctgcccctgttccaccacgccagatacgagctggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactgggtgaacgagctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90887 - DNA, 7098 bp, Artificial Sequence
  Description of Artificial Sequence: Synthetic coding sequence
atggagagcgtgagcgagagcagccagcagcagaagagaaagcccgtgatccacggcctggaggaccagaagagaatctacaccgactgggccaaccactacctggccaagagcggccacaagagactgatcagagacctgcagcaggacgtgaccgacggcgtgctgctggcccagatcatccaggtggtggccaacgagaagatcgaggacatcaacggctgccccaagaacagaagccagatgatcgagaacatcgacgcctgcctgaacttcctggccgccaagggcatcaacatccagggcctgagcgccgaggagatcagaaacggcaacctgaaggccatcctgggcctgttcttcagcctgagcagatacaagcagcagcagcagcagccccagaagcagcacctgagcagccccctgccccccgccgtgagccaggtggccggcgcccccagccagtgccaggccggcaccccccagcagcaggtgcccgtgaccccccaggccccctgccagccccaccagcccgccccccaccagcagagcaaggcccaggccgagatgcagagcagactgcccggccccaccgccagagtgagcgccgccggcagcgaggccaagaccagaggcggcagcaccaccgccaacaacagaagaagccagagcttcaacaactacgacaagagcaagcccgtgaccagccccccccccccccccagcagccacgagaaggagcccctggccagcagcgccagcagccaccccggcatgagcgacaacgcccccgccagcctggagagcggcagcagcagcacccccaccaactgcagcaccagcagcgccatcccccagcccggcgccgccaccaagccctggagaagcaagagcctgagcgtgaagcacagcgccaccgtgagcatgctgagcgtgaagccccccggccccgaggcccccagacccacccccgaggccatgaagcccgcccccaacaaccagaagagcatgctggagaagctgaagctgttcaacagcaagggcggcagcaaggccggcgagggccccggcagcagagacaccagctgcgagagactggagaccctgcccagcttcgaggagagcgaggagctggaggccgccagcagaatgctgaccaccgtgggccccgccagcagcagccccaagatcgccctgaagggcatcgcccagagaaccttcagcagagccctgaccaacaagaagagcagcctgaagggcaacgagaaggagaaggagaagcagcagagagagaaggacaaggagaagagcaaggacctggccaagagagccagcgtgaccgagagactggacctgaaggaggagcccaaggaggaccccagcggcgccgccgtgcccgagatgcccaagaagagcagcaagatcgccagcttcatccccaagggcggcaagctgaacagcgccaagaaggagcccatggcccccagccacagcggcatccccaagcccggcatgaagagcatgcccggcaagagccccagcgcccccgcccccagcaaggagggcgagagaagcagaagcggcaagctgagcagcggcctgccccagcagaagccccagctggacggcagacacagcagcagcagcagcagcctggccagcagcgagggcaagggccccggcggcaccaccctgaaccacagcatcagcagccagaccgtgagcggcagcgtgggcaccacccagaccaccggcagcaacaccgtgagcgtgcagctgccccagccccagcagcagtacaaccaccccaacaccgccaccgtggcccccttcctgtacagaagccagaccgacaccgagggcaacgtgaccgccgagagcagcagcaccggcgtgagcgtggagcccagccacttcaccaagaccggccagcccgccctggaggagctgaccggcgaggaccccgaggccagaagactgagaaccgtgaagaacatcgccgacctgagacagaacctggaggagaccatgagcagcctgagaggcacccaggtgacccacagcaccctggagaccaccttcgacaccaacgtgaccaccgagatgagcggcagaagcatcctgagcctgaccggcagacccacccccctgagctggagactgggccagagcagccccagactgcaggccggcgacgcccccagcatgggcaacggctacccccccagagccaacgccagcagattcatcaacaccgagagcggcagatacgtgtacagcgcccccctgagaagacagctggccagcagaggcagcagcgtgtgccacgtggacgtgagcgacaaggccggcgacgagatggacctggagggcatcagcatggacgcccccggctacatgagcgacggcgacgtgctgagcaagaacatcagaaccgacgacatcaccagcggctacatgaccgacggcggcctgggcctgtacaccagaagactgaacagactgcccgacggcatggccgtggtgagagagaccctgcagagaaacaccagcctgggcctgggcgacgccgacagctgggacgacagcagcagcgtgagcagcggcatcagcgacaccatcgacaacctgagcaccgacgacatcaacaccagcagcagcatcagcagctacgccaacacccccgccagcagcagaaagaacctggacgtgcagaccgacgccgagaagcacagccaggtggagagaaacagcctgtggagcggcgacgacgtgaagaagagcgacggcggcagcgacagcggcatcaagatggagcccggcagcaagtggagaagaaaccccagcgacgtgagcgacgagagcgacaagagcaccagcggcaagaagaaccccgtgatcagccagaccggcagctggagaagaggcatgaccgcccaggtgggcatcaccatgcccagaaccaagcccagcgcccccgccggcgccctgaagacccccggcaccggcaagaccgacgacgccaaggtgagcgagaagggcagactgagccccaaggccagccaggtgaagagaagccccagcgacgccggcagaagcagcggcgacgagagcaagaagcccctgcccagcagcagcagaacccccaccgccaacgccaacagcttcggcttcaagaagcagagcggcagcgccgccggcctggccatgatcaccgccagcggcgtgaccgtgaccagcagaagcgccaccctgggcaagatccccaagagcagcgccctggtgagcagaagcgccggcagaaagagcagcatggacggcgcccagaaccaggacgacggctacctggccctgagcagcagaaccaacctgcagtacagaagcctgcccagacccagcaagagcaacagcagaaacggcgccggcaacagaagcagcaccagcagcatcgacagcaacatcagcagcaagagcgccggcctgcccgtgcccaagctgagagagcccagcaagaccgccctgggcagcagcctgcccggcctggtgaaccagaccgacaaggagaagggcatcagcagcgacaacgagagcgtggccagctgcaacagcgtgaaggtgaaccccgccgcccagcccgtgagcagccccgcccagaccagcctgcagcccggcgccaagtaccccgacgtggccagccccaccctgagaagactgttcggcggcaagcccaccaagcaggtgcccatcgccaccgccgagaacatgaagaacagcgtggtgatcagcaacccccacgccaccatgacccagcagggcaacctggacagccccagcggcagcggcgtgctgagcagcggcagcagcagccccctgtacagcaagaacgtggacctgaaccagagccccctggccagcagccccagcagcgcccacagcgcccccagcaacagcctgacctggggcaccaacgccagcagcagcagcgccgtgagcaaggacggcctgggcttccagagcgtgagcagcctgcacaccagctgcgagagcatcgacatcagcctgagcagcggcggcgtgcccagccacaacagcagcaccggcctgatcgccagcagcaaggacgacagcctgacccccttcgtgagaaccaacagcgtgaagaccaccctgagcgagagccccctgagcagccccgccgccagccccaagttctgcagaagcaccctgcccagaaagcaggacagcgacccccacctggacagaaacaccctgcccaagaagggcctgagatacacccccaccagccagctgagaacccaggaggacgccaaggagtggctgagaagccacagcgccggcggcctgcaggacaccgccgccaacagccccttcagcagcggcagcagcgtgaccagccccagcggcaccagattcaacttcagccagctggccagccccaccaccgtgacccagatgagcctgagcaaccccaccatgctgagaacccacagcctgagcaacgccgacggccagtacgacccctacaccgacagcagattcagaaacagcagcatgagcctggacgagaagagcagaaccatgagcagaagcggcagcttcagagacggcttcgaggaggtgcacggcagcagcctgagcctggtgagcagcaccagcagcgtgtacagcacccccgaggagaagtgccagagcgagatcagaaagctgagaagagagctggacgccagccaggagaaggtgagcgccctgaccacccagctgaccgccaacgcccacctggtggccgccttcgagcagagcctgggcaacatgaccatcagactgcagagcctgaccatgaccgccgagcagaaggacagcgagctgaacgagctgagaaagaccatcgagctgctgaagaagcagaacgccgccgcccaggccgccatcaacggcgtgatcaacacccccgagctgaactgcaagggcaacggcaccgcccagagcgccgacctgagaatcagaagacagcacagcagcgacagcgtgagcagcatcaacagcgccaccagccacagcagcgtgggcagcaacatcgagagcgacagcaagaagaagaagagaaagaactggctgagaagcagcttcaagcaggccttcggcaagaagaagagccccaagagcgccagcagccacagcgacatcgaggagatgaccgacagcagcctgcccagcagccccaagctgccccacaacggcagcaccggcagcacccccctgctgagaaacagccacagcaacagcctgatcagcgagtgcatggacagcgaggccgagaccgtgatgcagctgagaaacgagctgagagacaaggagatgaagctgaccgacatcagactggaggccctgagcagcgcccaccagctggaccagctgagagaggccatgaacagaatgcagagcgagatcgagaagctgaaggccgagaacgacagactgaagagcgagagccagggcagcggctgcagcagagcccccagccaggtgagcatcagcgccagccccagacagagcatgggcctgagccagcacagcctgaacctgaccgagagcaccagcctggacatgctgctggacgacaccggcgagtgcagcgccagaaaggagggcggcagacacgtgaagatcgtggtgagcttccaggaggagatgaagtggaaggaggacagcagaccccacctgttcctgatcggctgcatcggcgtgagcggcaagaccaagtgggacgtgctggacggcgtggtgagaagactgttcaaggagtacatcatccacgtggaccccgtgagccagctgggcctgaacagcgacagcgtgctgggctacagcatcggcgagatcaagagaagcaacaccagcgagacccccgagctgctgccctgcggctacctggtgggcgagaacaccaccatcagcgtgaccgtgaagggcctggccgagaacagcctggacagcctggtgttcgagagcctgatccccaagcccatcctgcagagatacgtgagcctgctgatcgagcacagaagaatcatcctgagcggccccagcggcaccggcaagacctacctggccaacagactgagcgagtacatcgtgctgagagagggcagagagctgaccgacggcgtgatcgccaccttcaacgtggaccacaagagcagcaaggagctgagacagtacctgagcaacctggccgaccagtgcaacagcgagaacaacgccgtggacatgcccctggtgatcatcctggacaacctgcaccacgtgagcagcctgggcgagatcttcaacggcctgctgaactgcaagtaccacaagtgcccctacatcatcggcaccatgaaccaggccaccagcagcacccccaacctgcagctgcaccacaacttcagatgggtgctgtgcgccaaccacaccgagcccgtgaagggcttcctgggcagattcctgagaagaaagctgatggagaccgagatcagcggcagagtgagaaacatggagctggtgaagatcatcgactggatccccaaggtgtggcaccacctgaacagattcctggaggcccacagcagcagcgacgtgaccatcggccccagactgttcctgagctgccccatcgacgtggacggcagcagagtgtggttcaccgacctgtggaactacagcatcatcccctacctgctggaggccgtgagagagggcctgcagctgtacggcagaagagccccctgggaggaccccgccaagtgggtgatggacacctacccctgggccgccagcccccagcagcacgagtggccccccctgctgcagctgagacccgaggacgtgggcttcgacggctacagcatgcccagagagggcagcaccagcaagcagatgccccccagcgacgccgagggcgaccccctgatgaacatgctgatgagactgcaggaggccgccaactacagcagcccccagagctacgacagcgacagcaacagcaacagccaccacgacgacatcctggacagcagcctggagagcaccctgtag

SEQ ID NO: 90888 - DNA, 1089 bp, Artificial Sequence
  Description of Artificial Sequence: Synthetic coding sequence
atgttcagcagcgtggcccacctggccagagccaaccccttcaacaccccccacctgcagctggtgcacgacggcctgggcgacctgagaagcagcagccccggccccaccggccagcccagaagacccagaaacctggccgccgccgccgtggaggagcagtacagctgcgactacggcagcggcagattcttcatcctgtgcggcctgggcggcatcatcagctgcggcaccacccacaccgccctggtgcccctggacctggtgaagtgcagaatgcaggtggacccccagaagtacaagggcatcttcaacggcttcagcgtgaccctgaaggaggacggcgtgagaggcctggccaagggctgggcccccaccttcctgggctacagcatgcagggcctgtgcaagttcggcttctacgaggtgttcaaggtgctgtacagcaacatgctgggcgaggagaacacctacctgtggagaaccagcctgtacctggccgccagcgccagcgccgagttcttcgccgacatcgccctggcccccatggaggccgccaaggtgagaatccagacccagcccggctacgccaacaccctgagagacgccgcccccaagatgtacaaggaggagggcctgaaggccttctacaagggcgtggcccccctgtggatgagacagatcccctacaccatgatgaagttcgcctgcttcgagagaaccgtggaggccctgtacaagttcgtggtgcccaagcccagaagcgagtgcagcaagcccgagcagctggtggtgaccttcgtggccggctacatcgccggcgtgttctgcgccatcgtgagccaccccgccgacagcgtggtgagcgtgctgaacaaggagaagggcagcagcgccagcctggtgctgaagagactgggcttcaagggcgtgtggaagggcctgttcgccagaatcatcatgatcggcaccctgaccgccctgcagtggttcatctacgacagcgtgaaggtgtacttcagactgcccagaccccccccccccgagatgcccgagagcctgaagaagaagctgggcctgacccagtag

SEQ ID NO: 90889 - DNA, 6561 bp, Artificial Sequence
  Description of Artificial Sequence: Synthetic coding sequence
atgcccgtgctgggcgtggccagcaagctgagacagcccgccgtgggcagcaagcccgtgcacaccgccctgcccatccccaacctgggcaccaccggcagccagcactgcagcagcagacccctggagctgaccgagaccgagagcagcatgctgagctgccagctggccctgaagagcacctgcgagttcggcgagaagaagcccctgcagggcaaggccaaggagaaggaggacagcaagatctacaccgactgggccaaccactacctggccaagagcggccacaagagactgatcaaggacctgcagcaggacatcgccgacggcgtgctgctggccgagatcatccagatcatcgccaacgagaaggtggaggacatcaacggctgccccagaagccagagccagatgatcgagaacgtggacgtgtgcctgagcttcctggccgccagaggcgtgaacgtgcagggcctgagcgccgaggagatcagaaacggcaacctgaaggccatcctgggcctgttcttcagcctgagcagatacaagcagcagcagcaccaccagcagcagtactaccagagcctggtggagctgcagcagagagtgacccacgccagcccccccagcgaggccagccaggccaagacccagcaggacatgcagagcagcctggccgccagatacgccacccagagcaaccacagcggcatcgccaccagccagaagaagcccaccagactgcccggccccagcagagtgcccgccgccggcagcagcagcaaggtgcagggcgccagcaacctgaacagaagaagccagagcttcaacagcatcgacaagaacaagccccccaactacgccaacggcaacgagaaggacagcagcaagggcccccagagcagcagcggcgtgaacggcaacgtgcagccccccagcaccgccggccagccccccgccagcgccatccccagccccagcgccagcaagccctggagaagcaagagcatgaacgtgaagcacagcgccaccagcaccatgctgaccgtgaagcagagcagcaccgccaccagccccacccccagcagcgacagactgaagccccccgtgagcgagggcgtgaagaccgcccccagcggccagaagagcatgctggagaagttcaagctggtgaacgccagaaccgccctgagacccccccagccccccagcagcggccccagcgacggcggcaaggacgacgacgccttcagcgagagcggcgagatggagggcttcaacagcggcctgaacagcggcggcagcaccaacagcagccccaaggtgagccccaagctggccccccccaaggccggcagcaagaacctgagcaacaagaagagcctgctgcagcccaaggagaaggaggagaagaacagagacaagaacaaggtgtgcaccgagaagcccgtgaaggaggagaaggaccaggtgaccgagatggcccccaagaagaccagcaagatcgccagcctgatccccaagggcagcaagaccaccgccgccaagaaggagagcctgatccccagcagcagcggcatccccaagcccggcagcaaggtgcccaccgtgaagcagaccatcagccccggcagcaccgccagcaaggagagcgagaagttcagaaccaccaagggcagccccagccagagcctgagcaagcccatcaccatggagaaggccagcgccagcagctgccccgcccccctggagggcagagaggccggccaggccagccccagcggcagctgcaccatgaccgtggcccagagcagcggccagagcaccggcaacggcgccgtgcagctgccccagcagcagcagcacagccaccccaacaccgccaccgtggcccccttcatctacagagcccacagcgagaacgagggcaccgccctgcccagcgccgacagctgcaccagccccaccaagatggacctgagctacagcaagaccgccaagcagtgcctggaggagatcagcggcgaggaccccgagaccagaagaatgagaaccgtgaagaacatcgccgacctgagacagaacctggaggagaccatgagcagcctgagaggcacccagatcagccacagcaccctggagaccaccttcgacagcaccgtgaccaccgaggtgaacggcagaaccatccccaacctgaccagcagacccacccccatgacctggagactgggccaggcctgccccagactgcaggccggcgacgcccccagcctgggcgccggctaccccagaagcggcaccagcagattcatccacaccgaccccagcagattcatgtacaccacccccctgagaagagccgccgtgagcagactgggcaacatgagccagatcgacatgagcgagaaggccagcagcgacctggacatgagcagcgaggtggacgtgggcggctacatgagcgacggcgacatcctgggcaagagcctgagaaccgacgacatcaacagcggctacatgaccgacggcggcctgaacctgtacaccagaagcctgaacagaatccccgacaccgccaccagcagagacatcatccagagaggcgtgcacgacgtgaccgtggacgccgacagctgggacgacagcagcagcgtgagcagcggcctgagcgacaccctggacaacatcagcaccgacgacctgaacaccaccagcagcgtgagcagctacagcaacatcaccgtgcccagcagaaagaacacccagctgagaaccgacagcgagaagagaagcaccaccgacgagacctgggacagccccgaggagctgaagaagcccgaggaggacttcgacagccacggcgacgccggcggcaagtggaagaccgtgagcagcggcctgcccgaggaccccgagaaggccggccagaaggccagcctgagcgtgagccagaccggcagctggagaagaggcatgagcgcccagggcggcgcccccagcagacagaaggccggcaccagcgccctgaagacccccggcaagaccgacgacgccaaggccagcgagaagggcaaggcccccctgaagggcagcagcctgcagagaagccccagcgacgccggcaagagcagcggcgacgagggcaagaagccccccagcggcatcggcagaagcaccgccaccagcagcttcggcttcaagaagcccagcggcgtgggcagcagcgccatgatcaccagcagcggcgccaccatcaccagcggcagcgccaccctgggcaagatccccaagagcgccgccatcggcggcaagagcaacgccggcagaaagaccagcctggacggcagccagaaccaggacgacgtggtgctgcacgtgagcagcaagaccaccctgcagtacagaagcctgcccagacccagcaagagcagcaccagcggcatccccggcagaggcggccacagaagcagcaccagcagcatcgacagcaacgtgagcagcaagagcgccggcgccaccaccagcaagctgagagagcccaccaagatcggcagcggcagaagcagccccgtgaccgtgaaccagaccgacaaggagaaggagaaggtggccgtgagcgacagcgagagcgtgagcctgagcggcagccccaagagcagccccaccagcgccagcgcctgcggcgcccagggcctgagacagcccggcagcaagtaccccgacatcgccagccccaccttcagaagatacacccccagcagcagacaggccaaccaggaggagggcaaggagtggctgagaagccacagcaccggcggcctgcaggacaccggcaaccagagccccctggtgagccccagcgccatgagcagcagcgccgccggcaagtaccacttcagcaacctggtgagccccaccaacctgagccagttcaacctgcccggccccagcatgatgagaagcaacagcatccccgcccaggacagcagcttcgacctgtacgacgacagccagctgtgcggcagcgccaccagcctggaggagagacccagagccatcagccacagcggcagcttcagagacagcatggaggaggtgcacggcagcagcctgagcctggtgagcagcaccagcagcctgtacagcaccgccgaggccggcggcagcctggagcagatccacaagctgagaagagagctggtggccagccaggagaaggtggccaccctgaccagccagctgagcgccaacgcccacctggtggccgccttcgagaagagcctgggcaacatgaccggcagactgcagagcctgaccatgaccgccgagcagaaggagagcgagctgatcgagctgagagagaccatcgagatgctgaaggcccagaacagcgccgcccaggccgccatccagggcgccctgaacggccccgaccacccccccaaggacctgagaatcagaagacagcacagcagcgagagcgtgagcagcatcaacagcgccaccagccacagcagcatcggcagcggcaacgacgccgacagcaagaagaagaagaagaagaactgggtgaacagcagaggcagcgagctgagaagcagcttcaagcaggccttcggcaagaagaagagcaccaagccccccagcagccacagcgacatcgaggagctgaccgacagcagcctgcccgccagccccaagctgccccacaacgccggcgactgcggcagcgccagcatgaagcccagccagagcgccagcgccatctgcgagtgcaccgaggccgaggccgagatcatcctgcagctgaagagcgagctgagagagaaggagctgaagctgaccgacatcagactggaggccctgagcagcgcccaccacctggaccagatcagagaggccatgaacagaatgcagaacgagatcgagatcctgaaggccgagaacgacagactgaaggccgagaccggcaacaccgccaagcccaccagaccccccagcgagagcagcagcagcaccagcagcagcagcagcagacagagcctgggcctgagcctgaacaacctgaacatcaccgaggccgtgagcagcgacatcctgctggacgacgccggcgacgccaccggccacaaggacggcagaagcgtgaagatcatcgtgagcatcagcaagggctacggcagagccaaggaccagaagagccaggcctacctgatcggcagcatcggcgtgagcggcaagaccaagtgggacgtgctggacggcgtgatcagaagactgttcaaggagtacgtgttcagaatcgacaccagcaccagcctgggcctgagcagcgactgcatcgccagctactgcatcggcgacctgatcagaagccacaacctggaggtgcccgagctgctgccctgcggctacctggtgggcgacaacaacatcatcaccgtgaacctgaagggcgtggaggagaacagcctggacagcttcgtgttcgacaccctgatccccaagcccatcacccagagatacttcaacctgctgatggagcaccacagaatcatcctgagcggccccagcggcaccggcaagacctacctggccaacaagctggccgagtacgtgatcaccaagagcggcagaaagaagaccgaggacgccatcgccaccttcaacgtggaccacaagagcagcaaggagctgcagcagtacctggccaacctggccgagcagtgcagcgccgacaacaacggcgtggagctgcccgtggtgatcatcctggacaacctgcaccacgtgggcagcctgagcgacatcttcaacggcttcctgaactgcaagtacaacaagtgcccctacatcatcggcaccatgaaccagggcgtgagcagcagccccaacctggagctgcaccacaacttcagatgggtgctgtgcgccaaccacaccgagcccgtgaagggcttcctgggcagatacctgagaagaaagctgatcgagatcgagatcgagagaaacatcagaaacaacgacctggtgaagatcatcgactggatccccaagacctggcaccacctgaacagcttcctggagacccacagcagcagcgacgtgaccatcggccccagactgttcctgccctgccccatggacgtggagggcagcagagtgtggttcatggacctgtggaactacagcctggtgccctacatcctggaggccgtgagagagggcctgcagatgtacggcaagagaaccccctgggaggaccccagcaagtgggtgctggacacctacccctggagcagcgccaccctgccccaggagagccccgccctgctgcagctgagacccgaggacgtgggctacgagagctgcaccagcaccaaggaggccaccaccagcaagcacatcccccagaccgacaccgagggcgaccccctgatgaacatgctgatgaagctgcaggaggccgccaactacagcagcacccagagctgcgacagcgagagcaccagccaccacgaggacatcctggacagcagcctggagagcaccctgtag

SEQ ID NO: 90890 - DNA, 2376 bp, Artificial Sequence
  Description of Artificial Sequence: Synthetic coding sequence
atgaccagcctgcacaccagcagcgagagcatcgacctgcccctgagccaccacggcagcctgagcggcctgaccaccggcacccacgaggtgcagagcctgctgatgagaaccggcagcgtgagaagcaccctgagcgagagatacacccccagcagcagacaggccaaccaggaggagggcaaggagtggctgagaagccacagcaccggcggcctgcaggacaccggcaaccagagccccctggtgagccccagcgccatgagcagcagcgccgccggcaagtaccacttcagcaacctggtgagccccaccaacctgagccagttcaacctgcccggccccagcatgatgagaagcaacagcatccccgcccaggacagcagcttcgacctgtacgacgacagccagctgtgcggcagcgccaccagcctggaggagagacccagagccatcagccacagcggcagcttcagagacagcatggaggaggtgcacggcagcagcctgagcctggtgagcagcaccagcagcctgtacagcaccgccatccagaagcccaacatccagcagatccacaagctgagaagagagctggtggccagccaggagaaggtggccaccctgaccagccagctgagcgccaacgcccacctggtggccgccttcgagaagagcctgggcaacatgaccggcagactgcagagcctgaccatgaccgccgagcagaaggagagcgagctgatcgagctgagagagaccatcgagatgctgaaggcccagaacagcgccgcccaggccgccatccagggcgccctgaacggccccgaccacccccccaaggacctgagaatcagaagacagcacagcagcgagagcgtgagcagcatcaacagcgccaccagccacagcagcatcggcagcggcaacgacgccgacagcaagaagaagaagaagaagaactggctgagaagcagcttcaagcaggccttcggcaagaagaagagcaccaagccccccagcagccacagcgacatcgaggagctgaccgacagcagcctgcccgccagccccaagctgccccacaacgccggcgactgcggcagcgccagcatgaagcccagccagagcgccagcgccatctgcgagtgcaccgaggccgaggccgagatcatcctgcagctgaagagcgagctgagagagaaggagctgaagctgaccgacatcagactggaggccctgagcagcgcccaccacctggaccagatcagagaggccatgaacagaatgcagaacgagatcgagatcctgaaggccgagaacgacagactgaaggccgagaccggcaacaccgccaagcccaccagaccccccagcgagagcagcagcagcaccagcagcagcagcagcagacagagcctgggcctgagcctgaacaacctgaacatcaccgaggccgtgagcagcgacatcctgctggacgacgccggcgacgccaccggccacaaggacggcagaagcgtgaagatcatcgtgagcatcagcaagggctacggcagagccaaggaccagaagagccaggcctacctgatcggcagcatcggcgtgagcggcaagaccaagtgggacgtgctggacggcgtgatcagaagactgttcaaggagtacgtgttcagaatcgacaccagcaccagcctgggcctgagcagcgactgcatcgccagctactgcatcggcgacctgatcagaagccacaacctggaggtgcccgagctgctgccctgcggctacctggtgggcgacaacaacatcatcaccgtgaacctgaagggcgtggaggagaacagcctggacagcttcgtgttcgacaccctgatccccaagcccatcacccagagatacttcaacctgctgatggagcaccacagaatcatcctgagcggccccagcggcaccggcaagacctacctggccaacaagctggccgagtacgtgatcaccaagagcggcagaaagaagaccgaggacgccatcgccaccttcaacgtggaccacaagagcagcaaggagctgcagcagtacctggccaacctggccgagcagtgcagcgccgacaacaacggcgtggagctgcccgtggtgatcatcctggacaacctgcaccacgtgggcagcctgagcgacatcttcaacggcttcctgaactgcaagtacaacaagtgcccctacatcatcggcaccatgaaccagggcgtgagcagcagccccaacctggagctgcaccacaacttcagatgggtgctgtgcgccaaccacaccgagcccgtgaagggcttcctgggcagatacctgagaagaaagctgatcgagatctag

SEQ ID NO: 90891 - DNA, 7158 bp, Artificial Sequence
  Description of Artificial Sequence: Synthetic coding sequence
atgcccgtgctgggcgtggccagcaagctgagacagcccgccgtgggcagcaagcccgtgcacaccgccctgcccatccccaacctgggcaccaccggcagccagcactgcagcagcagacccctggagctgaccgagaccgagagcagcatgctgagctgccagctggccctgaagagcacctgcgagttcggcgagaagaagcccctgcagggcaaggccaaggagaaggaggacagcaagatctacaccgactgggccaaccactacctggccaagagcggccacaagagactgatcaaggacctgcagcaggacatcgccgacggcgtgctgctggccgagatcatccagatcatcgccaacgagaaggtggaggacatcaacggctgccccagaagccagagccagatgatcgagaacgtggacgtgtgcctgagcttcctggccgccagaggcgtgaacgtgcagggcctgagcgccgaggagatcagaaacggcaacctgaaggccatcctgggcctgttcttcagcctgagcagatacaagcagcagcagcaccaccagcagcagtactaccagagcctggtggagctgcagcagagagtgacccacgccagcccccccagcgaggccagccaggccaagacccagcaggacatgcagagcagcctggccgccagatacgccacccagagcaaccacagcggcatcgccaccagccagaagaagcccaccagactgcccggccccagcagagtgcccgccgccggcagcagcagcaaggtgcagggcgccagcaacctgaacagaagaagccagagcttcaacagcatcgacaagaacaagccccccaactacgccaacggcaacgagaaggacagcagcaagggcccccagagcagcagcggcgtgaacggcaacgtgcagccccccagcaccgccggccagccccccgccagcgccatccccagccccagcgccagcaagccctggagaagcaagagcatgaacgtgaagcacagcgccaccagcaccatgctgaccgtgaagcagagcagcaccgccaccagccccacccccagcagcgacagactgaagccccccgtgagcgagggcgtgaagaccgcccccagcggccagaagagcatgctggagaagttcaagctggtgaacgccagaaccgccctgagacccccccagccccccagcagcggccccagcgacggcggcaaggacgacgacgccttcagcgagagcggcgagatggagggcttcaacagcggcctgaacagcggcggcagcaccaacagcagccccaaggtgagccccaagctggccccccccaaggccggcagcaagaacctgagcaacaagaagagcctgctgcagcccaaggagaaggaggagaagaacagagacaagaacaaggtgtgcaccgagaagcccgtgaaggaggagaaggaccaggtgaccgagatggcccccaagaagaccagcaagatcgccagcctgatccccaagggcagcaagaccaccgccgccaagaaggagagcctgatccccagcagcagcggcatccccaagcccggcagcaaggtgcccaccgtgaagcagaccatcagccccggcagcaccgccagcaaggagagcgagaagttcagaaccaccaagggcagccccagccagagcctgagcaagcccatcaccatggagaaggccagcgccagcagctgccccgcccccctggagggcagagaggccggccaggccagccccagcggcagctgcaccatgaccgtggcccagagcagcggccagagcaccggcaacggcgccgtgcagctgccccagcagcagcagcacagccaccccaacaccgccaccgtggcccccttcatctacagagcccacagcgagaacgagggcaccgccctgcccagcgccgacagctgcaccagccccaccaagatggacctgagctacagcaagaccgccaagcagtgcctggaggagatcagcggcgaggaccccgagaccagaagaatgagaaccgtgaagaacatcgccgacctgagacagaacctggaggagaccatgagcagcctgagaggcacccagatcagccacagcaccctggagaccaccttcgacagcaccgtgaccaccgaggtgaacggcagaaccatccccaacctgaccagcagacccacccccatgacctggagactgggccaggcctgccccagactgcaggccggcgacgcccccagcctgggcgccggctaccccagaagcggcaccagcagattcatccacaccgaccccagcagattcatgtacaccacccccctgagaagagccgccgtgagcagactgggcaacatgagccagatcgacatgagcgagaaggccagcagcgacctggacatgagcagcgaggtggacgtgggcggctacatgagcgacggcgacatcctgggcaagagcctgagaaccgacgacatcaacagcggctacatgaccgacggcggcctgaacctgtacaccagaagcctgaacagaatccccgacaccgccaccagcagagacatcatccagagaggcgtgcacgacgtgaccgtggacgccgacagctgggacgacagcagcagcgtgagcagcggcctgagcgacaccctggacaacatcagcaccgacgacctgaacaccaccagcagcgtgagcagctacagcaacatcaccgtgcccagcagaaagaacacccagctgagaaccgacagcgagaagagaagcaccaccgacgagacctgggacagccccgaggagctgaagaagcccgaggaggacttcgacagccacggcgacgccggcggcaagtggaagaccgtgagcagcggcctgcccgaggaccccgagaaggccggccagaaggccagcctgagcgtgagccagaccggcagctggagaagaggcatgagcgcccagggcggcgcccccagcagacagaaggccggcaccagcgccctgaagacccccggcaagaccgacgacgccaaggccagcgagaagggcaaggcccccctgaagggcagcagcctgcagagaagccccagcgacgccggcaagagcagcggcgacgagggcaagaagccccccagcggcatcggcagaagcaccgccaccagcagcttcggcttcaagaagcccagcggcgtgggcagcagcgccatgatcaccagcagcggcgccaccatcaccagcggcagcgccaccctgggcaagatccccaagagcgccgccatcggcggcaagagcaacgccggcagaaagaccagcctggacggcagccagaaccaggacgacgtggtgctgcacgtgagcagcaagaccaccctgcagtacagaagcctgcccagacccagcaagagcagcaccagcggcatccccggcagaggcggccacagaagcagcaccagcagcatcgacagcaacgtgagcagcaagagcgccggcgccaccaccagcaagctgagagagcccaccaagatcggcagcggcagaagcagccccgtgaccgtgaaccagaccgacaaggagaaggagaaggtggccgtgagcgacagcgagagcgtgagcctgagcggcagccccaagagcagccccaccagcgccagcgcctgcggcgcccagggcctgagacagcccggcagcaagtaccccgacatcgccagccccaccttcagaagactgttcggcgccaaggccggcggcaagagcgccagcgcccccaacaccgagggcgtgaagagcagcagcgtgatgcccagccccagcaccaccctggccagacagggcagcctggagagccccagcagcggcaccggcagcatgggcagcgccggcggcctgagcggcagcagcagccccctgttcaacaagcccagcgacctgaccaccgacgtgatcagcctgagccacagcctggccagcagccccgccagcgtgcacagcttcaccagcggcggcctggtgtgggccgccaacatgagcagcagcagcgccggcagcaaggacacccccagctaccagagcatgaccagcctgcacaccagcagcgagagcatcgacctgcccctgagccaccacggcagcctgagcggcctgaccaccggcacccacgaggtgcagagcctgctgatgagaaccggcagcgtgagaagcaccctgagcgagagcatgcagctggacagaaacaccctgcccaagaagggcctgagatacacccccagcagcagacaggccaaccaggaggagggcaaggagtggctgagaagccacagcaccggcggcctgcaggacaccggcaaccagagccccctggtgagccccagcgccatgagcagcagcgccgccggcaagtaccacttcagcaacctggtgagccccaccaacctgagccagttcaacctgcccggccccagcatgatgagaagcaacagcatccccgcccaggacagcagcttcgacctgtacgacgacagccagctgtgcggcagcgccaccagcctggaggagagacccagagccatcagccacagcggcagcttcagagacagcatggaggaggtgcacggcagcagcctgagcctggtgagcagcaccagcagcctgtacagcaccgccgaggagaaggcccacagcgagcagatccacaagctgagaagagagctggtggccagccaggagaaggtggccaccctgaccagccagctgagcgccaacgcccacctggtggccgccttcgagaagagcctgggcaacatgaccggcagactgcagagcctgaccatgaccgccgagcagaaggagagcgagctgatcgagctgagagagaccatcgagatgctgaaggcccagaacagcgccgcccaggccgccatccagggcgccctgaacggccccgaccacccccccaaggacctgagaatcagaagacagcacagcagcgagagcgtgagcagcatcaacagcgccaccagccacagcagcatcggcagcggcaacgacgccgacagcaagaagaagaagaagaagaactgggtgaacagcagaggcagcgagctgagaagcagcttcaagcaggccttcggcaagaagaagagcaccaagccccccagcagccacagcgacatcgaggagctgaccgacagcagcctgcccgccagccccaagctgccccacaacgccggcgactgcggcagcgccagcatgaagcccagccagagcgccagcgccagccccctggtgtggccccccaagaagagacagaacggccccgtgatctacaagcacagaagcagaatctgcgagtgcaccgaggccgaggccgagatcatcctgcagctgaagagcgagctgagagagaaggagctgaagctgaccgacatcagactggaggccctgagcagcgcccaccacctggaccagatcagagaggccatgaacagaatgcagaacgagatcgagatcctgaaggccgagaacgacagactgaaggccgagaccggcaacaccgccaagcccaccagaccccccagcgagagcagcagcagcaccagcagcagcagcagcagacagagcctgggcctgagcctgaacaacctgaacatcaccgaggccgtgagcagcgacatcctgctggacgacgccggcgacgccaccggccacaaggacggcagaagcgtgaagatcatcgtgagcatcagcaagggctacggcagagccaaggaccagaagagccaggcctacctgatcggcagcatcggcgtgagcggcaagaccaagtgggacgtgctggacggcgtgatcagaagactgttcaaggagtacgtgttcagaatcgacaccagcaccagcctgggcctgagcagcgactgcatcgccagctactgcatcggcgacctgatcagaagccacaacctggaggtgcccgagctgctgccctgcggctacctggtgggcgacaacaacatcatcaccgtgaacctgaagggcgtggaggagaacagcctggacagcttcgtgttcgacaccctgatccccaagcccatcacccagagatacttcaacctgctgatggagcaccacagaatcatcctgagcggccccagcggcaccggcaagacctacctggccaacaagctggccgagtacgtgatcaccaagagcggcagaaagaagaccgaggacgccatcgccaccttcaacgtggaccacaagagcagcaaggagctgcagcagtacctggccaacctggccgagcagtgcagcgccgacaacaacggcgtggagctgcccgtggtgatcatcctggacaacctgcaccacgtgggcagcctgagcgacatcttcaacggcttcctgaactgcaagtacaacaagtgcccctacatcatcggcaccatgaaccagggcgtgagcagcagccccaacctggagctgcaccacaacttcagatgggtgctgtgcgccaaccacaccgagcccgtgaagggcttcctgggcagatacctgagaagaaagctgatcgagatcgagatcgagagaaacatcagaaacaacgacctggtgaagatcatcgactggatccccaagacctggcaccacctgaacagcttcctggagacccacagcagcagcgacgtgaccatcggccccagactgttcctgccctgccccatggacgtggagggcagcagagtgtggttcatggacctgtggaactacagcctggtgccctacatcctggaggccgtgagagagggcctgcagatgtacggcaagagaaccccctgggaggaccccagcaagtgggtgctggacacctacccctggagcagcgccaccctgccccaggagagccccgccctgctgcagctgagacccgaggacgtgggctacgagagctgcaccagcaccaaggaggccaccaccagcaagcacatcccccagaccgacaccgagggcgaccccctgatgaacatgctgatgaagctgcaggaggccgccaactacagcagcacccagagctgcgacagcgagagcaccagccaccacgaggacatcctggacagcagcctggagagcaccctgtag

SEQ ID NO: 90892 - DNA, 7092 bp, Artificial Sequence
  Description of Artificial Sequence: Synthetic coding sequence
atgcccgtgctgggcgtggccagcaagctgagacagcccgccgtgggcagcaagcccgtgcacaccgccctgcccatccccaacctgggcaccaccggcagccagcactgcagcagcagacccctggagctgaccgagaccgagagcagcatgctgagctgccagctggccctgaagagcacctgcgagttcggcgagaagaagcccctgcagggcaaggccaaggagaaggaggacagcaagatctacaccgactgggccaaccactacctggccaagagcggccacaagagactgatcaaggacctgcagcaggacatcgccgacggcgtgctgctggccgagatcatccagatcatcgccaacgagaaggtggaggacatcaacggctgccccagaagccagagccagatgatcgagaacgtggacgtgtgcctgagcttcctggccgccagaggcgtgaacgtgcagggcctgagcgccgaggagatcagaaacggcaacctgaaggccatcctgggcctgttcttcagcctgagcagatacaagcagcagcagcaccaccagcagcagtactaccagagcctggtggagctgcagcagagagtgacccacgccagcccccccagcgaggccagccaggccaagacccagcaggacatgcagagcagcctggccgccagatacgccacccagagcaaccacagcggcatcgccaccagccagaagaagcccaccagactgcccggccccagcagagtgcccgccgccggcagcagcagcaaggtgcagggcgccagcaacctgaacagaagaagccagagcttcaacagcatcgacaagaacaagccccccaactacgccaacggcaacgagaaggacagcagcaagggcccccagagcagcagcggcgtgaacggcaacgtgcagccccccagcaccgccggccagccccccgccagcgccatccccagccccagcgccagcaagccctggagaagcaagagcatgaacgtgaagcacagcgccaccagcaccatgctgaccgtgaagcagagcagcaccgccaccagccccacccccagcagcgacagactgaagccccccgtgagcgagggcgtgaagaccgcccccagcggccagaagagcatgctggagaagttcaagctggtgaacgccagaaccgccctgagacccccccagccccccagcagcggccccagcgacggcggcaaggacgacgacgccttcagcgagagcggcgagatggagggcttcaacagcggcctgaacagcggcggcagcaccaacagcagccccaaggtgagccccaagctggccccccccaaggccggcagcaagaacctgagcaacaagaagagcctgctgcagcccaaggagaaggaggagaagaacagagacaagaacaaggtgtgcaccgagaagcccgtgaaggaggagaaggaccaggtgaccgagatggcccccaagaagaccagcaagatcgccagcctgatccccaagggcagcaagaccaccgccgccaagaaggagagcctgatccccagcagcagcggcatccccaagcccggcagcaaggtgcccaccgtgaagcagaccatcagccccggcagcaccgccagcaaggagagcgagaagttcagaaccaccaagggcagccccagccagagcctgagcaagcccatcaccatggagaaggccagcgccagcagctgccccgcccccctggagggcagagaggccggccaggccagccccagcggcagctgcaccatgaccgtggcccagagcagcggccagagcaccggcaacggcgccgtgcagctgccccagcagcagcagcacagccaccccaacaccgccaccgtggcccccttcatctacagagcccacagcgagaacgagggcaccgccctgcccagcgccgacagctgcaccagccccaccaagatggacctgagctacagcaagaccgccaagcagtgcctggaggagatcagcggcgaggaccccgagaccagaagaatgagaaccgtgaagaacatcgccgacctgagacagaacctggaggagaccatgagcagcctgagaggcacccagatcagccacagcaccctggagaccaccttcgacagcaccgtgaccaccgaggtgaacggcagaaccatccccaacctgaccagcagacccacccccatgacctggagactgggccaggcctgccccagactgcaggccggcgacgcccccagcctgggcgccggctaccccagaagcggcaccagcagattcatccacaccgaccccagcagattcatgtacaccacccccctgagaagagccgccgtgagcagactgggcaacatgagccagatcgacatgagcgagaaggccagcagcgacctggacatgagcagcgaggtggacgtgggcggctacatgagcgacggcgacatcctgggcaagagcctgagaaccgacgacatcaacagcggctacatgaccgacggcggcctgaacctgtacaccagaagcctgaacagaatccccgacaccgccaccagcagagacatcatccagagaggcgtgcacgacgtgaccgtggacgccgacagctgggacgacagcagcagcgtgagcagcggcctgagcgacaccctggacaacatcagcaccgacgacctgaacaccaccagcagcgtgagcagctacagcaacatcaccgtgcccagcagaaagaacacccagctgagaaccgacagcgagaagagaagcaccaccgacgagacctgggacagccccgaggagctgaagaagcccgaggaggacttcgacagccacggcgacgccggcggcaagtggaagaccgtgagcagcggcctgcccgaggaccccgagaaggccggccagaaggccagcctgagcgtgagccagaccggcagctggagaagaggcatgagcgcccagggcggcgcccccagcagacagaaggccggcaccagcgccctgaagacccccggcaagaccgacgacgccaaggccagcgagaagggcaaggcccccctgaagggcagcagcctgcagagaagccccagcgacgccggcaagagcagcggcgacgagggcaagaagccccccagcggcatcggcagaagcaccgccaccagcagcttcggcttcaagaagcccagcggcgtgggcagcagcgccatgatcaccagcagcggcgccaccatcaccagcggcagcgccaccctgggcaagatccccaagagcgccgccatcggcggcaagagcaacgccggcagaaagaccagcctggacggcagccagaaccaggacgacgtggtgctgcacgtgagcagcaagaccaccctgcagtacagaagcctgcccagacccagcaagagcagcaccagcggcatccccggcagaggcggccacagaagcagcaccagcagcatcgacagcaacgtgagcagcaagagcgccggcgccaccaccagcaagctgagagagcccaccaagatcggcagcggcagaagcagccccgtgaccgtgaaccagaccgacaaggagaaggagaaggtggccgtgagcgacagcgagagcgtgagcctgagcggcagccccaagagcagccccaccagcgccagcgcctgcggcgcccagggcctgagacagcccggcagcaagtaccccgacatcgccagccccaccttcagaagactgttcggcgccaaggccggcggcaagagcgccagcgcccccaacaccgagggcgtgaagagcagcagcgtgatgcccagccccagcaccaccctggccagacagggcagcctggagagccccagcagcggcaccggcagcatgggcagcgccggcggcctgagcggcagcagcagccccctgttcaacaagcccagcgacctgaccaccgacgtgatcagcctgagccacagcctggccagcagccccgccagcgtgcacagcttcaccagcggcggcctggtgtgggccgccaacatgagcagcagcagcgccggcagcaaggacacccccagctaccagagcatgaccagcctgcacaccagcagcgagagcatcgacctgcccctgagccaccacggcagcctgagcggcctgaccaccggcacccacgaggtgcagagcctgctgatgagaaccggcagcgtgagaagcaccctgagcgagagcatgcagctggacagaaacaccctgcccaagaagggcctgagatacacccccagcagcagacaggccaaccaggaggagggcaaggagtggctgagaagccacagcaccggcggcctgcaggacaccggcaaccagagccccctggtgagccccagcgccatgagcagcagcgccgccggcaagtaccacttcagcaacctggtgagccccaccaacctgagccagttcaacctgcccggccccagcatgatgagaagcaacagcatccccgcccaggacagcagcttcgacctgtacgacgacagccagctgtgcggcagcgccaccagcctggaggagagacccagagccatcagccacagcggcagcttcagagacagcatggaggaggtgcacggcagcagcctgagcctggtgagcagcaccagcagcctgtacagcaccgccgaggagaaggcccacagcgagcagatccacaagctgagaagagagctggtggccagccaggagaaggtggccaccctgaccagccagctgagcgccaacgcccacctggtggccgccttcgagaagagcctgggcaacatgaccggcagactgcagagcctgaccatgaccgccgagcagaaggagagcgagctgatcgagctgagagagaccatcgagatgctgaaggcccagaacagcgccgcccaggccgccatccagggcgccctgaacggccccgaccacccccccaaggacctgagaatcagaagacagcacagcagcgagagcgtgagcagcatcaacagcgccaccagccacagcagcatcggcagcggcaacgacgccgacagcaagaagaagaagaagaagaactgggtgaacagcagaggcagcgagctgagaagcagcttcaagcaggccttcggcaagaagaagagcaccaagccccccagcagccacagcgacatcgaggagctgaccgacagcagcctgcccgccagccccaagctgccccacaacgccggcgactgcggcagcgccagcatgaagcccagccagagcgccagcgccatctgcgagtgcaccgaggccgaggccgagatcatcctgcagctgaagagcgagctgagagagaaggagctgaagctgaccgacatcagactggaggccctgagcagcgcccaccacctggaccagatcagagaggccatgaacagaatgcagaacgagatcgagatcctgaaggccgagaacgacagactgaaggccgagaccggcaacaccgccaagcccaccagaccccccagcgagagcagcagcagcaccagcagcagcagcagcagacagagcctgggcctgagcctgaacaacctgaacatcaccgaggccgtgagcagcgacatcctgctggacgacgccggcgacgccaccggccacaaggacggcagaagcgtgaagatcatcgtgagcatcagcaagggctacggcagagccaaggaccagaagagccaggcctacctgatcggcagcatcggcgtgagcggcaagaccaagtgggacgtgctggacggcgtgatcagaagactgttcaaggagtacgtgttcagaatcgacaccagcaccagcctgggcctgagcagcgactgcatcgccagctactgcatcggcgacctgatcagaagccacaacctggaggtgcccgagctgctgccctgcggctacctggtgggcgacaacaacatcatcaccgtgaacctgaagggcgtggaggagaacagcctggacagcttcgtgttcgacaccctgatccccaagcccatcacccagagatacttcaacctgctgatggagcaccacagaatcatcctgagcggccccagcggcaccggcaagacctacctggccaacaagctggccgagtacgtgatcaccaagagcggcagaaagaagaccgaggacgccatcgccaccttcaacgtggaccacaagagcagcaaggagctgcagcagtacctggccaacctggccgagcagtgcagcgccgacaacaacggcgtggagctgcccgtggtgatcatcctggacaacctgcaccacgtgggcagcctgagcgacatcttcaacggcttcctgaactgcaagtacaacaagtgcccctacatcatcggcaccatgaaccagggcgtgagcagcagccccaacctggagctgcaccacaacttcagatgggtgctgtgcgccaaccacaccgagcccgtgaagggcttcctgggcagatacctgagaagaaagctgatcgagatcgagatcgagagaaacatcagaaacaacgacctggtgaagatcatcgactggatccccaagacctggcaccacctgaacagcttcctggagacccacagcagcagcgacgtgaccatcggccccagactgttcctgccctgccccatggacgtggagggcagcagagtgtggttcatggacctgtggaactacagcctggtgccctacatcctggaggccgtgagagagggcctgcagatgtacggcaagagaaccccctgggaggaccccagcaagtgggtgctggacacctacccctggagcagcgccaccctgccccaggagagccccgccctgctgcagctgagacccgaggacgtgggctacgagagctgcaccagcaccaaggaggccaccaccagcaagcacatcccccagaccgacaccgagggcgaccccctgatgaacatgctgatgaagctgcaggaggccgccaactacagcagcacccagagctgcgacagcgagagcaccagccaccacgaggacatcctggacagcagcctggagagcaccctgtag

SEQ ID NO: 90893 - DNA, 648 bp, Artificial Sequence
  Description of Artificial Sequence: Synthetic coding sequence
atgaagagatgggtgctgtgcgccaaccacaccgagcccgtgaagggcttcctgggcagatacctgagaagaaagctgatcgagatcgagatcgagagaaacatcagaaacaacgacctggtgaagatcatcgactggatccccaagacctggcaccacctgaacagcttcctggagacccacagcagcagcgacgtgaccatcggccccagactgttcctgccctgccccatggacgtggagggcagcagagtgtggttcatggacctgtggaactacagcctggtgccctacatcctggaggccgtgagagagggcctgcagatgtacggcaagagaaccccctgggaggaccccagcaagtgggtgctggacacctacccctggagcagcgccaccctgccccaggagagccccgccctgctgcagctgagacccgaggacgtgggctacgagagctgcaccagcaccaaggaggccaccaccagcaagcacatcccccagaccgacaccgagggcgaccccctgatgaacatgctgatgaagctgcaggaggccgccaactacagcagcacccagagctgcgacagcgagagcaccagccaccacgaggacatcctggacagcagcctggagagcaccctgtag

SEQ ID NO: 90894 - DNA, 573 bp, Artificial Sequence
  Description of Artificial Sequence: Synthetic coding sequence
atgggcaagagcaacagcaagctgaagcccgaggtggtggaggagctgaccagaaagacctacttcaccgagaaggaggtgcagcagtggtacaagggcttcatcaaggactgccccagcggccagctggacgccgccggcttccagaagatctacaagcagttcttccccttcggcgaccccaccaagttcgccaccttcgtgttcaacgtgttcgacgagaacaaggacggcagaatcgagttcagcgagttcatccaggccctgagcgtgaccagcagaggcaccctggacgagaagctgagatgggccttcaagctgtacgacctggacaacgacggctacatcaccagaaacgagatgctggacatcgtggacgccatctaccagatggtgggcaacaccgtggagctgcccgaggaggagaacacccccgagaagagagtggacagaatcttcgccatgatggacaagaacgccgacggcaagctgaccctgcaggagttccaggagggcagcaaggccgaccccagcatcgtgcaggccctgagcctgtacgacggcctggtgtag

SEQ ID NO: 90895 - DNA, 519 bp, Artificial Sequence
  Description of Artificial Sequence: Synthetic coding sequence
atggccaccatcaccgagaaggaggtgcagcagtggtacaagggcttcatcaaggactgccccagcggccagctggacgccgccggcttccagaagatctacaagcagttcttccccttcggcgaccccaccaagttcgccaccttcgtgttcaacgtgttcgacgagaacaaggacggcagaatcgagttcagcgagttcatccaggccctgagcgtgaccagcagaggcaccctggacgagaagctgagatgggccttcaagctgtacgacctggacaacgacggctacatcaccagaaacgagatgctggacatcgtggacgccatctaccagatggtgggcaacaccgtggagctgcccgaggaggagaacacccccgagaagagagtggacagaatcttcgccatgatggacaagaacgccgacggcaagctgaccctgcaggagttccaggagggcagcaaggccgaccccagcatcgtgcaggccctgagcctgtacgacggcctggtgtag

SEQ ID NO: 90896 - DNA, 3552 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90897 - DNA, 3711 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccagaagagcaccgaggtgatggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccggcatcctgccccccgacgtgggcgccggcaaggtgcaggccgtgaaccccagaatcagcaacctgaccgccgccgccgccgagacctacgccaacatcagctgggagtacgagggccccgagcacgtgaacttctacgtggagtacggcgtggccggcagcaaggaggagtggagaaaggagatcgtgaacggcagcagaagcttcttcggcctgaagggcctgatgcccggcaccgcctacaaggtgagagtgggcgccgtgggcgacagcggcttcgtgagcagcgaggacgtgttcgagaccggccccgccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagactgttcagcttcgtgagcagcgccagcttctag

SEQ ID NO: 90898 - DNA, 3579 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccccaagctgctggaggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccggcatcctgccccccgacgtgggcgccggcaaggccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90899 - DNA, 3915 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccccaagctgctggaggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccggcatcctgccccccgacgtgggcgccggcaaggtgcaggccgtgaaccccagaatcagcaacctgaccgccgccgccgccgagacctacgccaacatcagctgggagtacgagggccccgagcacgtgaacttctacgtggagtacggcgtggccggcagcaaggaggagtggagaaaggagatcgtgaacggcagcagaagcttcttcggcctgaagggcctgatgcccggcaccgcctacaaggtgagagtgggcgccgtgggcgacagcggcttcgtgagcagcgaggacgtgttcgagaccggccccgccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90900 - DNA, 3927 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccagaagagcaccgaggtgatggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccggcatcctgccccccgacgtgggcgccggcaaggtgcaggccgtgaaccccagaatcagcaacctgaccgccgccgccgccgagacctacgccaacatcagctgggagtacgagggccccgagcacgtgaacttctacgtggagtacggcgtggccggcagcaaggaggagtggagaaaggagatcgtgaacggcagcagaagcttcttcggcctgaagggcctgatgcccggcaccgcctacaaggtgagagtgggcgccgtgggcgacagcggcttcgtgagcagcgaggacgtgttcgagaccggccccgccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcagcctgaagaacgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90901 - DNA, 3543 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccagaagagcaccgaggtgatggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90902 - DNA, 1296 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtag

SEQ ID NO: 90903 - DNA, 186 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccccaagctgctggaggacctggtgcagccccccaccatcacccagcagagccccaaggactacatcatcgaccccagatag

SEQ ID NO: 90904 - DNA, 321 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggctag

SEQ ID NO: 90905 - DNA, 3915 bp, Artificial Sequence; identical to SEQ ID NO: 90899
  Description of Artificial Sequence: Synthetic coding sequence

SEQ ID NO: 90906 - DNA, 447 bp, Artificial Sequence
  Description of Artificial Sequence: Synthetic coding sequence
atggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgaagaaggaggacagcgacgacagcctggtggactacggcgagggcgtgaacggccagttcaacgaggacggcagcttcatcggccagtacagcggcaagaaggagaaggagcccgccgagggcaacgagagcagcgaggcccccagccccgtgaacgccatgaacagcttcgtgtag

SEQ ID NO: 90907 - DNA, 357 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccccaagctgctggaggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagtag

SEQ ID NO: 90908 - DNA, 2316 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggacctggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagaccagcaccgccagcttctag

SEQ ID NO: 90909 - DNA, 321 bp, Artificial Sequence; identical to SEQ ID NO: 90904
  Description of Artificial Sequence: Synthetic coding sequence

SEQ ID NO: 90910 - DNA, 3462 bp, Artificial Sequence
  Description of Artificial Sequence: Synthetic coding sequence
atgcagctgaagatcatgcccaagaagaagagactgagcgccggcagagtgcccctgatcctgttcctgtgccagatgatcagcgccctggaggtgcccctggaccagaagagcaccgaggtgatggtgcagccccccaccatcacccagcagagccccaaggactacatcatcgaccccagagagaacatcgtgatccagtgcgaggccaagggcaagcccccccccagcttcagctggaccagaaacggcacccacttcgacatcgacaaggaccccctggtgaccatgaagcccggcaccggcaccctgatcatcaacatcatgagcgagggcaaggccgagacctacgagggcgtgtaccagtgcaccgccagaaacgagagaggcgccgccgtgagcaacaacatcgtggtgagacccagcagaagccccctgtggaccaaggagaagctggagcccatcaccctgcagagcggccagagcctggtgctgccctgcagaccccccatcggcctgcccccccccatcatcttctggatggacaacagcttccagagactgccccagagcgagagagtgagccagggcctgaacggcgacctgtacttcagcaacgtgctgcccgaggacaccagagaggactacatctgctacgccagattcaaccacacccagaccatccagcagaagcagcccatcagcgtgaaggtgatcagcgtggacgagctgaacgacaccatcgccgccaacctgagcgacaccgagttctacggcgccaagagcagcagagagagaccccccaccttcctgacccccgagggcaacgccagcaacaaggaggagctgagaggcaacgtgctgagcctggagtgcatcgccgagggcctgcccacccccatcatctactgggccaaggaggacggcatgctgcccaagaacagaaccgtgtacaagaacttcgagaagaccctgcagatcatccacgtgagcgaggccgacagcggcaactaccagtgcatcgccaagaacgccctgggcgccatccaccacaccatcagcgtgagagtgaaggccgccccctactggatcaccgccccccagaacctggtgctgagccccggcgaggacggcaccctgatctgcagagccaacggcaaccccaagcccagaatcagctggctgaccaacggcgtgcccatcgagatcgcccccgacgaccccagcagaaagatcgacggcgacaccatcatcttcagcaacgtgcaggagagaagcagcgccgtgtaccagtgcaacgccagcaacgagtacggctacctgctggccaacgccttcgtgaacgtgctggccgagccccccagaatcctgacccccgccaacaccctgtaccaggtgatcgccaacagacccgccctgctggactgcgccttcttcggcagccccctgcccaccatcgagtggttcaagggcgccaagggcagcgccctgcacgaggacatctacgtgctgcacgagaacggcaccctggagatccccgtggcccagaaggacagcaccggcacctacacctgcgtggccagaaacaagctgggcatggccaagaacgaggtgcacctggagatcaaggaccccacctggatcgtgaagcagcccgagtacgccgtggtgcagagaggcagcatggtgagcttcgagtgcaaggtgaagcacgaccacaccctgagcctgaccgtgctgtggctgaaggacaacagagagctgcccagcgacgagagattcaccgtggacaaggaccacctggtggtggccgacgtgagcgacgacgacagcggcacctacacctgcgtggccaacaccaccctggacagcgtgagcgccagcgccgtgctgagcgtggtggcccccacccccacccccgcccccgtgtacgacgtgcccaacccccccttcgacctggagctgaccgaccagctggacaagagcgtgcagctgagctggacccccggcgacgacaacaacagccccatcaccaagttcatcatcgagtacgaggacgccatgcacaagcccggcctgtggcaccaccagaccgaggtgagcggcacccagaccaccgcccagctgaagctgagcccctacgtgaactacagcttcagagtgatggccgtgaacagcatcggcaagagcctgcccagcgaggccagcgagcagtacctgaccaaggccagcgagcccgacaagaaccccaccgccgtggagggcctgggcagcgagcccgacaacctggtgatcacctggaagcccctgaacggcttcgagagcaacggccccggcctgcagtacaaggtgagctggagacagaaggacggcgacgacgagtggaccagcgtggtggtggccaacgtgagcaagtacatcgtgagcggcacccccaccttcgtgccctacctgatcaaggtgcaggccctgaacgacatgggcttcgcccccgagcccgccgtggtgatgggccacagcggcgaggacctgcccatggtggcccccggcaacgtgagagtgaacgtggtgaacagcaccctggccgaggtgcactgggaccccgtgcccctgaagagcatcagaggccacctgcagggctacagaatctactactggaagacccagagcagcagcaagagaaacagaagacacatcgagaagaagatcctgaccttccagggcagcaagacccacggcatgctgcccggcctggagcccttcagccactacaccctgaacgtgagagtggtgaacggcaagggcgagggccccgccagccccgacagagtgttcaacacccccgagggcgtgcccagcgcccccagcagcctgaagatcgtgaaccccaccctggacagcctgaccctggagtgggacccccccagccaccccaacggcatcctgaccgagtacaccctgaagtaccagcccatcaacagcacccacgagctgggccccctggtggacctgaagatccccgccaacaagaccagatggaccctgaagaacctgaacttcagcaccagatacaagttctacttctacgcccagaccagcgccggcagcggcagccagatcaccgaggaggccgtgaccaccgtggacgaggccggcatcctgccccccgacgtgggcgccggcaaggccatggccagcagacaggtggacatcgccacccagggctggttcatcggcctgatgtgcgccgtggccctgctgatcctgatcctgctgatcgtgtgcttcatcagaagaaacaagggcggcaagtaccccgtgaaggagaaggaggacgcccacgccgaccccgagatccagcccatgaaggaggacgacggcaccttcggcgagtacagcgacgccgaggaccacaagcccctgaagaagggcagcagaacccccagcgacagaaccgtgtag

SEQ ID NO: 90911 - DNA, 681 bp, Artificial Sequence
  Description of Artificial Sequence: Synthetic coding sequence
atgcaggtgcacctgaccgtgcaggtgccccccaagatctacgacatcagcaacgacatgaccgtgaacgagggcaccaacgtgaccctgacctgcctggccaccggcaagcccgagcccagcatcagctggagacacatcagccccagcgccaagcccttcgagaacggccagtacctggacatctacggcatcaccagagaccaggccggcgagtacgagtgcagcgccgagaacgacgtgagcttccccgacgtgagaaaggtgaaggtggtggtgaacttcgcccccaccatccaggagatcaagagcggcaccgtgacccccggcagaagcggcctgatcagatgcgagggcgccggcgtgcccccccccgccttcgagtggtacaagggcgagaagaagctgttcaacggccagcagggcatcatcatccagaacttcagcaccagaagcatcctgaccgtgaccaacgtgacccaggagcacttcggcaactacacctgcgtggccgccaacaagctgggcaccaccaacgccagcctgcccctgaacccccccagcaccgcccagtacggcatcaccggcagcgccgacgtgctgttcagctgctggtacctggtgctgaccctgagcagcttcaccagcatcttctacctgaagaacgccatcctgcagtag

SEQ ID NO: 90912 - DNA, 1065 bp, Artificial Sequence
  Description of Artificial Sequence: Synthetic coding sequence
atggacatgatgctgctggtgcagggcgcctgctgcagcaaccagtggctggccgccgtgctgctgagcctgtgctgcctgctgcccagctgcctgcccgccggccagagcgtggacttcccctgggccgccgtggacaacatgatggtgagaaagggcgacaccgccgtgctgagatgctacctggaggacggcgccagcaagggcgcctggctgaacagaagcagcatcatcttcgccggcggcgacaagtggagcgtggaccccagagtgagcatcagcaccctgaacaagagagactacagcctgcagatccagaacgtggacgtgaccgacgacggcccctacacctgcagcgtgcagacccagcacacccccagaaccatgcaggtgcacctgaccgtgcaggtgccccccaagatctacgacatcagcaacgacatgaccgtgaacgagggcaccaacgtgaccctgacctgcctggccaccggcaagcccgagcccagcatcagctggagacacatcagccccagcgccaagcccttcgagaacggccagtacctggacatctacggcatcaccagagaccaggccggcgagtacgagtgcagcgccgagaacgacgtgagcttccccgacgtgagaaaggtgaaggtggtggtgaacttcgcccccaccatccaggagatcaagagcggcaccgtgacccccggcagaagcggcctgatcagatgcgagggcgccggcgtgcccccccccgccttcgagtggtacaagggcgagaagaagctgttcaacggccagcagggcatcatcatccagaacttcagcaccagaagcatcctgaccgtgaccaacgtgacccaggagcacttcggcaactacacctgcgtggccgccaacaagctgggcaccaccaacgccagcctgcccctgaacccccccagcaccgcccagtacggcatcaccggcagcgccgacgtgctgttcagctgctggtacctggtgctgaccctgagcagcttcaccagcatcttctacctgaagaacgccatcctgcagtag

SEQ ID NO: 90913 - DNA, 927 bp, Artificial Sequence
  Description of Artificial Sequence: Synthetic coding sequence
atgatgctgctggtgcagggcgcctgctgcagcaaccagtggctggccgccgtgctgctgagcctgtgctgcctgctgcccagctgcctgcccgccggccagagcgtggacttcccctgggccgccgtggacaacatgatggtgagaaagggcgacaccgccgtgctgagatgctacctggaggacggcgccagcaagggcgcctggctgaacagaagcagcatcatcttcgccggcggcgacaagtggagcgtggaccccagagtgagcatcagcaccctgaacaagagagactacagcctgcagatccagaacgtggacgtgaccgacgacggcccctacacctgcagcgtgcagacccagcacacccccagaaccatgcaggtgcacctgaccgtgcaggtgccccccaagatctacgacatcagcaacgacatgaccgtgaacgagggcaccaacgtgaccctgacctgcctggccaccggcaagcccgagcccagcatcagctggagacacatcagccccagcgtggcccccaccatccaggagatcaagagcggcaccgtgacccccggcagaagcggcctgatcagatgcgagggcgccggcgtgcccccccccgccttcgagtggtacaagggcgagaagaagctgttcaacggccagcagggcatcatcatccagaacttcagcaccagaagcatcctgaccgtgaccaacgtgacccaggagcacttcggcaactacacctgcgtggccgccaacaagctgggcaccaccaacgccagcctgcccctgaacccccccagcaccgcccagtacggcatcaccggcagcgccgacgtgctgttcagctgctggtacctggtgctgaccctgagcagcttcaccagcatcttctacctgaagaacgccatcctgcagtag

SEQ ID NO: 90914 - DNA, 2133 bp, Artificial Sequence
  Description of Artificial Sequence: Synthetic coding sequence
atggagaccagagagagcgaggacctggagaagaccagaagaaagagcgccagcgaccagtggaacaccgacaacgagcccgccaaggtgaagcccgagctgctgcccgagaaggaggagaccagccaggccgaccaggacatccaggacaaggagccccactgccacatccccatcaagagaaacagcatcttcaacagaagcatcagaagaaagagcaaggccaaggccagagacaaccccgagagaaacgccagctgcctggccgacagccaggacaacggcaagagcgtgaacgagcccctgaccctgaacatcccctggagcagaatgcccccctgcagaaccgccatgcagaccgaccccggcgcccaggagatgagcgagagcagcagcacccccggcaacggcgccacccccgaggagtggcccgccctggccgacagccccaccaccctgaccgaggccctgagaatgatccaccccatccccgccgacagctggagaaacctgatcgagcagatcggcctgctgtaccaggagtacagagacaagagcaccctgcaggagatcgagaccagaagacagcaggacgccgagatcgaggacaacaccaacggcagccccgccagcgaggacacccccgaggaggaggaggaggaggaggaggaggaggagcccgccagcccccccgagagaaagaccctgccccagatctgcctgctgagcaacccccacagcagattcaacctgtggcaggacctgcccgagatcagaagcagcggcgtgctggagatcctgcagcccgaggagatcaagctgcaggaggccatgttcgagctggtgaccagcgaggccagctactacaagagcctgaacctgctggtgagccacttcatggagaacgagagaatcagaaagatcctgcaccccagcgaggcccacatcctgttcagcaacgtgctggacgtgctggccgtgagcgagagattcctgctggagctggagcacagaatggaggagaacatcgtgatcagcgacgtgtgcgacatcgtgtacagatacgccgccgaccacttcagcgtgtacatcacctacgtgagcaaccagacctaccaggagagaacctacaagcagctgctgcaggagaaggccgccttcagagagctgatcgcccagctggagctggaccccaagtgcagaggcctgcccttcagcagcttcctgatcctgcccttccagagaatcaccagactgaagctgctggtgcagaacatcctgaagagagtggaggagagaagcgagagagagtgcaccgccctggacgcccacaaggagctggagatggtggtgaaggcctgcaacgagggcgtgagaaagatgagcagaaccgagcagatgatcagcatccagaagaagatggagttcaagatcaagagcgtgcccatcatcagccacagcagatggctgctgaagcagggcgagctgcagcagatgagcggccccaagaccagcagaaccctgagaaccaagaagctgttccacgagatctacctgttcctgttcaacgacctgctggtgatctgcagacagatccccggcgacaagtaccaggtgttcgacagcgcccccagaggcctgctgagagtggaggagctggaggaccagggccagaccctggccaacgtgttcatcctgagactgctggagaacgccgacgacagagaggccacctacatgctgaaggccagcagccagagcgagatgaagagatggatgaccagcctggcccccaacagaagaaccaagttcgtgagcttcaccagcagactgctggactgcccccaggtgcagtgcgtgcacccctacgtggcccagcagcccgacgagctgaccctggagctggccgacatcctgaacatcctggacaagaccgacgacggctggatcttcggcgagagactgcacgaccaggagagaggctggttccccagcagcatgaccgaggagatcctgaaccccaagatcagaagccagaacctgaaggagtgcttcagagtgcacaagatggacgacccccagagaagccagaacaaggacagaagaaagctgggcagcagaaacagacagtag

SEQ ID NO: 90915 - DNA, 1857 bp, Artificial Sequence
  Description of Artificial Sequence: Synthetic coding sequence
atggagctgctggccgccgccttcagcgccgcctgcgccgtggaccacgacagcagcaccagcgagagcgacgccagagacagcgccgccggccacctgcccggcagcgagagcagcagcacccccggcaacggcgccacccccgaggagtggcccgccctggccgacagccccaccaccctgaccgaggccctgagaatgatccaccccatccccgccgacagctggagaaacctgatcgagcagatcggcctgctgtaccaggagtacagagacaagagcaccctgcaggagatcgagaccagaagacagcaggacgccgagatcgaggacaacaccaacggcagccccgccagcgaggacacccccgaggaggaggaggaggaggaggaggaggaggagcccgccagcccccccgagagaaagaccctgccccagatctgcctgctgagcaacccccacagcagattcaacctgtggcaggacctgcccgagatcagaagcagcggcgtgctggagatcctgcagcccgaggagatcaagctgcaggaggccatgttcgagctggtgaccagcgaggccagctactacaagagcctgaacctgctggtgagccacttcatggagaacgagagaatcagaaagatcctgcaccccagcgaggcccacatcctgttcagcaacgtgctggacgtgctggccgtgagcgagagattcctgctggagctggagcacagaatggaggagaacatcgtgatcagcgacgtgtgcgacatcgtgtacagatacgccgccgaccacttcagcgtgtacatcacctacgtgagcaaccagacctaccaggagagaacctacaagcagctgctgcaggagaaggccgccttcagagagctgatcgcccagctggagctggaccccaagtgcagaggcctgcccttcagcagcttcctgatcctgcccttccagagaatcaccagactgaagctgctggtgcagaacatcctgaagagagtggaggagagaagcgagagagagtgcaccgccctggacgcccacaaggagctggagatggtggtgaaggcctgcaacgagggcgtgagaaagatgagcagaaccgagcagatgatcagcatccagaagaagatggagttcaagatcaagagcgtgcccatcatcagccacagcagatggctgctgaagcagggcgagctgcagcagatgagcggccccaagaccagcagaaccctgagaaccaagaagctgttccacgagatctacctgttcctgttcaacgacctgctggtgatctgcagacagatccccggcgacaagtaccaggtgttcgacagcgcccccagaggcctgctgagagtggaggagctggaggaccagggccagaccctggccaacgtgttcatcctgagactgctggagaacgccgacgacagagaggccacctacatgctgaaggccagcagccagagcgagatgaagagatggatgaccagcctggcccccaacagaagaaccaagttcgtgagcttcaccagcagactgctggactgcccccaggtgcagtgcgtgcacccctacgtggcccagcagcccgacgagctgaccctggagctggccgacatcctgaacatcctggacaagaccgacgacggctggatcttcggcgagagactgcacgaccaggagagaggctggttccccagcagcatgaccgaggagatcctgaaccccaagatcagaagccagaacctgaaggagtgcttcagagtgcacaagatggacgacccccagagaagccagaacaaggacagaagaaagctgggcagcagaaacagacagtag

SEQ ID NO: 90916 - DNA, 717 bp, Artificial Sequence
  Description of Artificial Sequence: Synthetic coding sequence
atggagctgctggccgccgccttcagcgccgcctgcgccgtggaccacgacagcagcaccagcgagagcgacgccagagacagcgccgccggccacctgcccggcagcgagagcagcagcacccccggcaacggcgccacccccgaggagtggcccgccctggccgacagccccaccaccctgaccgaggccctgagaatgatccaccccatccccgccgacagctggagaaacctgatcgagcagatcggcctgctgtaccaggagtacagagacaagagcaccctgcaggagatcgagaccagaagacagcaggacgccgagatcgaggacaacaccaacggcagccccgccagcgaggacacccccgaggaggaggaggaggaggaggaggaggaggagcccgccagcccccccgagagaaagaccctgccccagatctgcctgctgagcaacccccacagcagattcaacctgtggcaggacctgcccgagatcagaagcagcggcgtgctggagatcctgcagcccgaggagatcaagctgcaggaggccatgttcgagctggtgaccagcgaggccagctactacaagagcctgaacctgctggtgagccacttcatggagaacgagagaatcagaaagatcctgcaccccagcgaggcccacatcctgttcagcaacgtgctggacgtgctggccgtgagcgagagatag

SEQ ID NO: 90917 - DNA, 1302 bp, Artificial Sequence
  Description of Artificial Sequence: Synthetic coding sequence
atgttcgagctggtgaccagcgaggccagctactacaagagcctgaacctgctggtgagccacttcatggagaacgagagaatcagaaagatcctgcaccccagcgaggcccacatcctgttcagcaacgtgctggacgtgctggccgtgagcgagagattcctgctggagctggagcacagaatggaggagaacatcgtgatcagcgacgtgtgcgacatcgtgtacagatacgccgccgaccacttcagcgtgtacatcacctacgtgagcaaccagacctaccaggagagaacctacaagcagctgctgcaggagaaggccgccttcagagagctgatcgcccagctggagctggaccccaagtgcagaggcctgcccttcagcagcttcctgatcctgcccttccagagaatcaccagactgaagctgctggtgcagaacatcctgaagagagtggaggagagaagcgagagagagtgcaccgccctggacgcccacaaggagctggagatggtggtgaaggcctgcaacgagggcgtgagaaagatgagcagaaccgagcagatgatcagcatccagaagaagatggagttcaagatcaagagcgtgcccatcatcagccacagcagatggctgctgaagcagggcgagctgcagcagatgagcggccccaagaccagcagaaccctgagaaccaagaagctgttccacgagatctacctgttcctgttcaacgacctgctggtgatctgcagacagatccccggcgacaagtaccaggtgttcgacagcgcccccagaggcctgctgagagtggaggagctggaggaccagggccagaccctggccaacgtgttcatcctgagactgctggagaacgccgacgacagagaggccacctacatgctgaaggccagcagccagagcgagatgaagagatggatgaccagcctggcccccaacagaagaaccaagttcgtgagcttcaccagcagactgctggactgcccccaggtgcagtgcgtgcacccctacgtggcccagcagcccgacgagctgaccctggagctggccgacatcctgaacatcctggacaagaccgacgacggctggatcttcggcgagagactgcacgaccaggagagaggctggttccccagcagcatgaccgaggagatcctgaaccccaagatcagaagccagaacctgaaggagtgcttcagagtgcacaagatggacgacccccagagaagccagaacaaggacagaagaaagctgggcagcagaaacagacagtag

SEQ ID NO: 90918 - DNA, 1803 bp, Artificial Sequence
  Description of Artificial Sequence: Synthetic coding sequence
atgcccccctgcagaaccgccatgcagaccgaccccggcgcccaggagatgagcgagagcagcagcacccccggcaacggcgccacccccgaggagtggcccgccctggccgacagccccaccaccctgaccgaggccctgagaatgatccaccccatccccgccgacagctggagaaacctgatcgagcagatcggcctgctgtaccaggagtacagagacaagagcaccctgcaggagatcgagaccagaagacagcaggacgccgagatcgaggacaacaccaacggcagccccgccagcgaggacacccccgaggaggaggaggaggaggaggaggaggaggagcccgccagcccccccgagagaaagaccctgccccagatctgcctgctgagcaacccccacagcagattcaacctgtggcaggacctgcccgagatcagaagcagcggcgtgctggagatcctgcagcccgaggagatcaagctgcaggaggccatgttcgagctggtgaccagcgaggccagctactacaagagcctgaacctgctggtgagccacttcatggagaacgagagaatcagaaagatcctgcaccccagcgaggcccacatcctgttcagcaacgtgctggacgtgctggccgtgagcgagagattcctgctggagctggagcacagaatggaggagaacatcgtgatcagcgacgtgtgcgacatcgtgtacagatacgccgccgaccacttcagcgtgtacatcacctacgtgagcaaccagacctaccaggagagaacctacaagcagctgctgcaggagaaggccgccttcagagagctgatcgcccagctggagctggaccccaagtgcagaggcctgcccttcagcagcttcctgatcctgcccttccagagaatcaccagactgaagctgctggtgcagaacatcctgaagagagtggaggagagaagcgagagagagtgcaccgccctggacgcccacaaggagctggagatggtggtgaaggcctgcaacgagggcgtgagaaagatgagcagaaccgagcagatgatcagcatccagaagaagatggagttcaagatcaagagcgtgcccatcatcagccacagcagatggctgctgaagcagggcgagctgcagcagatgagcggccccaagaccagcagaaccctgagaaccaagaagctgttccacgagatctacctgttcctgttcaacgacctgctggtgatctgcagacagatccccggcgacaagtaccaggtgttcgacagcgcccccagaggcctgctgagagtggaggagctggaggaccagggccagaccctggccaacgtgttcatcctgagactgctggagaacgccgacgacagagaggccacctacatgctgaaggccagcagccagagcgagatgaagagatggatgaccagcctggcccccaacagaagaaccaagttcgtgagcttcaccagcagactgctggactgcccccaggtgcagtgcgtgcacccctacgtggcccagcagcccgacgagctgaccctggagctggccgacatcctgaacatcctggacaagaccgacgacggctggatcttcggcgagagactgcacgaccaggagagaggctggttccccagcagcatgaccgaggagatcctgaaccccaagatcagaagccagaacctgaaggagtgcttcagagtgcacaagatggacgacccccagagaagccagaacaaggacagaagaaagctgggcagcagaaacagacagtag

SEQ ID NO: 90919 - DNA, 705 bp, Artificial Sequence
  Description of Artificial Sequence: Synthetic coding sequence
atgaccggcagcagcgtgttcgactacatccaccccggcgaccacagcgaggtgctggagcagctgggcctgagaacccccacccccggcccccccaccccccccagcgtgagcagcagcagcagcagcagcagcagcctggccgacacccccgagatcgaggccagcctgaccaaggtgccccccagcagcctggtgcaggagagaagcttcttcgtgagaatgaagagcaccctgaccaagagaggcctgcacgtgaaggccagcggctacaaggtgatccacgtgaccggcagactgagagcccacgccctgggcctggtggccctgggccacaccctgccccccgcccccctggccgagctgcccctgcacggccacatgatcgtgttcagactgagcctgggcctgaccatcctggcctgcgagagcagagtgagcgaccacatggacctgggccccagcgagctggtgggcagaagctgctaccagttcgtgcacggccaggacgccaccagaatcagacagagccacgtggacagctgcagaggcctgagagtggccgccgtgtgcggccacagcggctgggagagagaggagcccagaggcgccccctgcgccctgggccagcccagagcccagcccagcagaggctggcccaacagcttcggctgcctgcccgccagcagccagagaggcctgtag

SEQ ID NO: 90920 - DNA, 1773 bp, Artificial Sequence
  Description of Artificial Sequence: Synthetic coding sequence
atggccgccccctaccccggcagcggcggcggcagcgaggtgaagtgcgtgggcggcagaggcgccagcgtgccctgggacttcctgcccggcctgatggtgaaggcccccagcggcccctgcctgcaggcccagagaaaggagaagagcagaaacgccgccagaagcagaagaggcaaggagaacctggagttcttcgagctggccaagctgctgcccctgcccggcgccatcagcagccagctggacaaggccagcatcgtgagactgagcgtgacctacctgagactgagaagattcgccgccctgggcgcccccccctggggcctgagagccgccggcccccccgccggcctggcccccggcagaagaggccccgccgccctggtgagcgaggtgttcgagcagcacctgggcggccacatcctgcagagcctggacggcttcgtgttcgccctgaaccaggagggcaagttcctgtacatcagcgagaccgtgagcatctacctgggcctgagccaggtggagatgaccggcagcagcgtgttcgactacatccaccccggcgaccacagcgaggtgctggagcagctgggcctgagaacccccacccccggcccccccaccccccccagcgtgagcagcagcagcagcagcagcagcagcctggccgacacccccgagatcgaggccagcctgaccaaggtgccccccagcagcctggtgcaggagagaagcttcttcgtgagaatgaagagcaccctgaccaagagaggcctgcacgtgaaggccagcggctacaaggtgatccacgtgaccggcagactgagagcccacgccctgggcctggtggccctgggccacaccctgccccccgcccccctggccgagctgcccctgcacggccacatgatcgtgttcagactgagcctgggcctgaccatcctggcctgcgagagcagagtgagcgaccacatggacctgggccccagcgagctggtgggcagaagctgctaccagttcgtgcacggccaggacgccaccagaatcagacagagccacgtggacctgctggacaagggccaggtgatgaccggctactacagatggctgcagagagccggcggcttcgtgtggctgcagagcgtggccaccgtggccggcagcggcaagagccccggcgagcaccacgtgctgtgggtgagccacgtgctgagccaggccgagggcggccagacccccctggacgccttccagctgcccgccagcgtggcctgcgaggaggccagcagccccggccccgagcccaccgagcccgagccccccaccgagggcaagcaggccgcccccgccgagaacgaggccccccagacccagggcaagagaatcaaggtggagcccggccccagagagaccaagggcagcgaggacagcggcgacgaggaccccagcagccaccccgccacccccagacccgagttcaccagcgtgatcagagccggcgtgctgaagcaggaccccgtgagaccctggggcctggccccccccggcgaccccccccccaccctgctgcacgccggcttcctgccccccgtggtgagaggcctgtgcacccccggcaccatcagatacggccccgccgagctgggcctggtgtacccccacctgcagagactgggccccggccccgccctgcccgaggccttctacccccccctgggcctgccctaccccggccccgccggcaccagactgcccagaaagggcgactag

SEQ ID NO: 90921 - DNA, 2475 bp, Artificial Sequence
  Description of Artificial Sequence: Synthetic coding sequence
atggacgaggacgagaaggacagagccaagagagccagcagaaacaagagcgagaagaagagaagagaccagttcaacgtgctgatcaaggagctgagcagcatgctgcccggcaacaccagaaagatggacaagaccaccgtgctggagaaggtgatcggcttcctgcagaagcacaacgaggtgagcgcccagaccgagatctgcgacatccagcaggactggaagcccagcttcctgagcaacgaggagttcacccagctgatgctggaggccctggacggcttcatcatcgccgtgaccaccgacggcagcatcatctacgtgagcgacagcatcacccccctgctgggccacctgcccagcgacgtgatggaccagaacctgctgaacttcctgcccgagcaggagcacagcgaggtgtacaagatcctgagcagccacatgctggtgaccgacagccccagccccgagtacctgaagagcgacagcgacctggagttctactgccacctgctgagaggcagcctgaaccccaaggagttccccacctacgagtacatcaagttcgtgggcaacttcagaagctacaacaacgtgcccagccccagctgcaacggcttcgacaacaccctgagcagaccctgcagagtgcccctgggcaaggaggtgtgcttcatcgccaccgtgagactggccaccccccagttcctgaaggagatgtgcatcgtggacgagcccctggaggagttcaccagcagacacagcctggagtggaagttcctgttcctggaccacagagccccccccatcatcggctacctgcccttcgaggtgctgggcaccagcggctacgactactaccacatcgacgacctggagctgctggccagatgccaccagcacctgatgcagttcggcaagggcaagagctgctgctacagattcctgaccaagggccagcagtggatctggctgcagacccactactacatcacctaccaccagtggaacagcaagcccgagttcatcgtgtgcacccacagcgtggtgagctacgccgacgtgagagtggagagaagacaggagctggccctggaggacccccccagcgaggccctgcacagcagcgccctgaaggacaagggcagcagcctggagcccagacagcacttcaacaccctggacgtgggcgccagcggcctgaacaccagccacagccccagcgccagcagcagaagcagccacaagagcagccacaccgccatgagcgagcccaccagcacccccaccaagctgatggccgaggccagcacccccgccctgcccagaagcgccaccctgccccaggagctgcccgtgcccggcctgagccaggccgccaccatgcccgcccccctgcccagccccagcagctgcgacctgacccagcagctgctgccccagaccgtgctgcagagcacccccgcccccatggcccagttcagcgcccagttcagcatgttccagaccatcaaggaccagctggagcagagaaccagaatcctgcaggccaacatcagatggcagcaggaggagctgcacaagatccaggagcagctgtgcctggtgcaggacagcaacgtgcagatgttcctgcagcagcccgccgtgagcctgagcttcagcagcacccagagacccgaggcccagcagcagctgcagcagagaagcgccgccgtgacccagccccagctgggcgccggcccccagctgcccggccagatcagcagcgcccaggtgaccagccagcacctgctgagagagagcagcgtgatcagcacccagggccccaagcccatgagaagcagccagctgatgcagagcagcggcagaagcggcagcagcctggtgagccccttcagcagcgccaccgccgccctgccccccagcctgaacctgaccacccccgccagcaccagccaggacgccagccagtgccagcccagccccgacttcagccacgacagacagctgagactgctgctgagccagcccatccagcccatgatgcccggcagctgcgacgccagacagcccagcgaggtgagcagaaccggcagacaggtgaagtacgcccagagccagaccgtgttccagaaccccgacgcccaccccgccaacagcagcagcgcccccatgcccgtgctgctgatgggccaggccgtgctgcaccccagcttccccgccagccagcccagccccctgcagcccgcccaggccagacagcagcccccccagcactacctgcaggtgcaggcccccaccagcctgcacagcgagcagcaggacagcctgctgctgagcacctacagccagcagcccggcaccctgggctacccccagcccccccccgcccagccccagcccctgagaccccccagaagagtgagcagcctgagcgagagcagcggcctgcagcagccccccagatag

SEQ ID NO: 90922 - DNA, 2670 bp, Artificial Sequence
  Description of Artificial Sequence: Synthetic coding sequence
atgtacgcctacggcttcgtgggcagatgcgcccccttccccgccgaggagggcagaaccttcgacctgagcgaggagctgggcagaagcgtgaccagagagggcaccggcaccaccagactgaacagcgagcccgtgcccctgctgtgcctgcccctgctgaactgcagcagaaagaactgcatcgagaacctgatggacgaggacgagaaggacagagccaagagagccagcagaaacaagagcgagaagaagagaagagaccagttcaacgtgctgatcaaggagctgagcagcatgctgcccggcaacaccagaaagatggacaagaccaccgtgctggagaaggtgatcggcttcctgcagaagcacaacgaggtgagcgcccagaccgagatctgcgacatccagcaggactggaagcccagcttcctgagcaacgaggagttcacccagctgatgctggaggccctggacggcttcatcatcgccgtgaccaccgacggcagcatcatctacgtgagcgacagcatcacccccctgctgggccacctgcccagcgacgtgatggaccagaacctgctgaacttcctgcccgagcaggagcacagcgaggtgtacaagatcctgagcagccacatgctggtgaccgacagccccagccccgagtacctgaagagcgacagcgacctggagttctactgccacctgctgagaggcagcctgaaccccaaggagttccccacctacgagtacatcaagttcgtgggcaacttcagaagctacaacaacgtgcccagccccagctgcaacggcttcgacaacaccctgagcagaccctgcagagtgcccctgggcaaggaggtgtgcttcatcgccaccgtgagactggccaccccccagttcctgaaggagatgtgcatcgtggacgagcccctggaggagttcaccagcagacacagcctggagtggaagttcctgttcctggaccacagagccccccccatcatcggctacctgcccttcgaggtgctgggcaccagcggctacgactactaccacatcgacgacctggagctgctggccagatgccaccagcacctgatgcagttcggcaagggcaagagctgctgctacagattcctgaccaagggccagcagtggatctggctgcagacccactactacatcacctaccaccagtggaacagcaagcccgagttcatcgtgtgcacccacagcgtggtgagctacgccgacgtgagagtggagagaagacaggagctggccctggaggacccccccagcgaggccctgcacagcagcgccctgaaggacaagggcagcagcctggagcccagacagcacttcaacaccctggacgtgggcgccagcggcctgaacaccagccacagccccagcgccagcagcagaagcagccacaagagcagccacaccgccatgagcgagcccaccagcacccccaccaagctgatggccgaggccagcacccccgccctgcccagaagcgccaccctgccccaggagctgcccgtgcccggcctgagccaggccgccaccatgcccgcccccctgcccagccccagcagctgcgacctgacccagcagctgctgccccagaccgtgctgcagagcacccccgcccccatggcccagttcagcgcccagttcagcatgttccagaccatcaaggaccagctggagcagagaaccagaatcctgcaggccaacatcagatggcagcaggaggagctgcacaagatccaggagcagctgtgcctggtgcaggacagcaacgtgcagatgttcctgcagcagcccgccgtgagcctgagcttcagcagcacccagagacccgaggcccagcagcagctgcagcagagaagcgccgccgtgacccagccccagctgggcgccggcccccagctgcccggccagatcagcagcgcccaggtgaccagccagcacctgctgagagagagcagcgtgatcagcacccagggccccaagcccatgagaagcagccagctgatgcagagcagcggcagaagcggcagcagcctggtgagccccttcagcagcgccaccgccgccctgccccccagcctgaacctgaccacccccgccagcaccagccaggacgccagccagtgccagcccagccccgacttcagccacgacagacagctgagactgctgctgagccagcccatccagcccatgatgcccggcagctgcgacgccagacagcccagcgaggtgagcagaaccggcagacaggtgaagtacgcccagagccagaccgtgttccagaaccccgacgcccaccccgccaacagcagcagcgcccccatgcccgtgctgctgatgggccaggccgtgctgcaccccagcttccccgccagccagcccagccccctgcagcccgcccaggccagacagcagcccccccagcactacctgcaggtgcaggcccccaccagcctgcacagcgagcagcaggacagcctgctgctgagcacctacagccagcagcccggcaccctgggctacccccagcccccccccgcccagccccagcccctgagaccccccagaagagtgagcagcctgagcgagagcagcggcctgcagcagccccccagatag

SEQ ID NO: 90923 - DNA, 774 bp, Artificial Sequence
  Description of Artificial Sequence: Synthetic coding sequence
atggcccccaccaagcccagcttccagcaggaccccagcagaagagagagaatcaccgcccagcaccccctgcccaaccagagcgagtgcagaaagatctacagatacgacggcatctactgcgagagcacctaccagaacctgcaggccctgagaaaggagaagagcagagacgccgccagaagcagaagaggcaaggagaacttcgagttctacgagctggccaagctgctgcccctgcccgccgccatcaccagccagctggacaaggccagcatcatcagactgaccatcagctacctgaagatgagagacttcgccaaccagggcgaccccccctggaacctgagaatggagggccccccccccaacaccagcgtgaaggtgatcggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggtgtgcttcccccccgccagcgaccagttcctgctgtag

SEQ ID NO: 90924 - DNA, 2706 bp, Artificial Sequence
  Description of Artificial Sequence: Synthetic coding sequence
atggcccccaccaagcccagcttccagcaggaccccagcagaagagagagactgcaggccctgagaaaggagaagagcagagacgccgccagaagcagaagaggcaaggagaacttcgagttctacgagctggccaagctgctgcccctgcccgccgccatcaccagccagctggacaaggccagcatcatcagactgaccatcagctacctgaagatgagagacttcgccaaccagggcgaccccccctggaacctgagaatggagggccccccccccaacaccagcgtgaagggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggagagcaccagccccagcctgctgaccaccgacaacaccctggagagaagcttcttcatcagaatgaagagcaccctgaccaagagaggcgtgcacatcaagagcagcggctacaaggtgatccacatcaccggcagactgagactgagagtgagcctgagccacggcagaaccgtgcccagccagatcatgggcctggtggtggtggcccacgccctgcccccccccaccatcaacgaggtgagaatcgactgccacatgttcgtgaccagagtgaacatggacctgaacatcatctactgcgagaacagaatcagcgactacatggacctgacccccgtggacatcgtgggcaagagatgctaccacttcatccacgccgaggacgtggagggcatcagacacagccacctggacctgctgaacaagggccagtgcgtgaccaagtactacagatggatgcagaagaacggcggctacatctggatccagagcagcgccaccatcgccatcaacgccaagaacgccaacgagaagaacatcatctgggtgaactacctgctgagcaaccccgagtacaaggacacccccatggacatcgcccagctgccccacctgcccgagaagaccagcgagagcagcgagaccagcgacagcgagagcgacagcaaggacaccagcggcatcaccgaggacaacgagaacagcaagagcgacgagaagggcaaccagagcgagaacagcgaggaccccgagcccgacagaaagaagagcggcaacgcctgcgacaacgacatgaactgcaacgacgacggccacagcagcagcaaccccgacagcagagacagcgacgacagcttcgagcacagcgacttcgagaaccccaaggccggcgaggacggcttcggcgccctgggcgccatgcagatcaaggtggagagatacgtggagagcgagagcgacctgagactgcagaactgcgagagcctgaccagcgacagcgccaaggacagcgacagcgccggcgaggccggcgcccaggccagcagcaagcaccagaagagaaagaagagaagaaagagacagaagggcggcagcgccagcagaagaagactgagcagcgccagcagccccggcggcctggacgccggcctggtggagccccccagactgctgagcagccccaacagcgccagcgtgctgaagatcaagaccgagatcagcgagcccatcaacttcgacaacgacagcagcatctggaactacccccccaacagagagatcagcagaaacgagagcccctacagcatgaccaagccccccagcagcgagcacttccccagcccccagggcggcggcggcggcggcggcggcggcggcggcctgcacgtggccatccccgacagcgtgctgaccccccccggcgccgacggcgccgccgccagaaagacccagttcggcgccagcgccaccgccgccctggcccccgtggccagcgaccccctgagcccccccctgagcgccagccccagagacaagcaccccggcaacggcggcggcggcggcggcggcggcggcggcgccggcggcggcggccccagcgccagcaacagcctgctgtacaccggcgacctggaggccctgcagagactgcaggccggcaacgtggtgctgcccctggtgcacagagtgaccggcaccctggccgccaccagcaccgccgcccagagagtgtacaccaccggcaccatcagatacgcccccgccgaggtgaccctggccatgcagagcaacctgctgcccaacgcccacgccgtgaacttcgtggacgtgaacagccccggcttcggcctggaccccaagacccccatggagatgctgtaccaccacgtgcacagactgaacatgagcggccccttcggcggcgccgtgagcgccgccagcctgacccagatgcccgccggcaacgtgttcaccaccgccgagggcctgttcagcaccctgcccttccccgtgtacagcaacggcatccacgccgcccagaccctggagagaaaggaggactag

SEQ ID NO: 90925 - DNA, 2802 bp, Artificial Sequence
  Description of Artificial Sequence: Synthetic coding sequence
atggcccccaccaagcccagcttccagcaggaccccagcagaagagagagaatcaccgcccagcaccccctgcccaaccagagcgagtgcagaaagatctacagatacgacggcatctactgcgagagcacctaccagaacctgcaggccctgagaaaggagaagagcagagacgccgccagaagcagaagaggcaaggagaacttcgagttctacgagctggccaagctgctgcccctgcccgccgccatcaccagccagctggacaaggccagcatcatcagactgaccatcagctacctgaagatgagagacttcgccaaccagggcgaccccccctggaacctgagaatggagggccccccccccaacaccagcgtgaaggtgatcggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggagagcaccagccccagcctgctgaccaccgacaacaccctggagagaagcttcttcatcagaatgaagagcaccctgaccaagagaggcgtgcacatcaagagcagcggctacaaggtgatccacatcaccggcagactgagactgagagtgagcctgagccacggcagaaccgtgcccagccagatcatgggcctggtggtggtggcccacgccctgcccccccccaccatcaacgaggtgagaatcgactgccacatgttcgtgaccagagtgaacatggacctgaacatcatctactgcgagaacagaatcagcgactacatggacctgacccccgtggacatcgtgggcaagagatgctaccacttcatccacgccgaggacgtggagggcatcagacacagccacctggacctgctgaacaagggccagtgcgtgaccaagtactacagatggatgcagaagaacggcggctacatctggatccagagcagcgccaccatcgccatcaacgccaagaacgccaacgagaagaacatcatctgggtgaactacctgctgagcaaccccgagtacaaggacacccccatggacatcgcccagctgccccacctgcccgagaagaccagcgagagcagcgagaccagcgacagcgagagcgacagcaaggacaccagcggcatcaccgaggacaacgagaacagcaagagcgacgagaagggcaaccagagcgagaacagcgaggaccccgagcccgacagaaagaagagcggcaacgcctgcgacaacgacatgaactgcaacgacgacggccacagcagcagcaaccccgacagcagagacagcgacgacagcttcgagcacagcgacttcgagaaccccaaggccggcgaggacggcttcggcgccctgggcgccatgcagatcaaggtggagagatacgtggagagcgagagcgacctgagactgcagaactgcgagagcctgaccagcgacagcgccaaggacagcgacagcgccggcgaggccggcgcccaggccagcagcaagcaccagaagagaaagaagagaagaaagagacagaagggcggcagcgccagcagaagaagactgagcagcgccagcagccccggcggcctggacgccggcctggtggagccccccagactgctgagcagccccaacagcgccagcgtgctgaagatcaagaccgagatcagcgagcccatcaacttcgacaacgacagcagcatctggaactacccccccaacagagagatcagcagaaacgagagcccctacagcatgaccaagccccccagcagcgagcacttccccagcccccagggcggcggcggcggcggcggcggcggcggcggcctgcacgtggccatccccgacagcgtgctgaccccccccggcgccgacggcgccgccgccagaaagacccagttcggcgccagcgccaccgccgccctggcccccgtggccagcgaccccctgagcccccccctgagcgccagccccagagacaagcaccccggcaacggcggcggcggcggcggcggcggcggcggcgccggcggcggcggccccagcgccagcaacagcctgctgtacaccggcgacctggaggccctgcagagactgcaggccggcaacgtggtgctgcccctggtgcacagagtgaccggcaccctggccgccaccagcaccgccgcccagagagtgtacaccaccggcaccatcagatacgcccccgccgaggtgaccctggccatgcagagcaacctgctgcccaacgcccacgccgtgaacttcgtggacgtgaacagccccggcttcggcctggaccccaagacccccatggagatgctgtaccaccacgtgcacagactgaacatgagcggccccttcggcggcgccgtgagcgccgccagcctgacccagatgcccgccggcaacgtgttcaccaccgccgagggcctgttcagcaccctgcccttccccgtgtacagcaacggcatccacgccgcccagaccctggagagaaaggaggactag

SEQ ID NO: 90926 - DNA, 2763 bp, Artificial Sequence
  Description of Artificial Sequence: Synthetic coding sequence
atggcccccaccaagcccagcttccagcaggaccccagcagaagagagagactgcaggccctgagaaaggagaagagcagagacgccgccagaagcagaagaggcaaggagaacttcgagttctacgagctggccaagctgctgcccctgcccgccgccatcaccagccagctggacaaggccagcatcatcagactgaccatcagctacctgaagatgagagacttcgccaaccagggcgaccccccctggaacctgagaatggagggccccccccccaacaccagcgtgaagggcatccagatgtggaagagcgagctgtgcatgagaaagaccccctgcgaggtgatcggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggagagcaccagccccagcctgctgaccaccgacaacaccctggagagaagcttcttcatcagaatgaagagcaccctgaccaagagaggcgtgcacatcaagagcagcggctacaaggtgatccacatcaccggcagactgagactgagagtgagcctgagccacggcagaaccgtgcccagccagatcatgggcctggtggtggtggcccacgccctgcccccccccaccatcaacgaggtgagaatcgactgccacatgttcgtgaccagagtgaacatggacctgaacatcatctactgcgagaacagaatcagcgactacatggacctgacccccgtggacatcgtgggcaagagatgctaccacttcatccacgccgaggacgtggagggcatcagacacagccacctggacctgctgaacaagggccagtgcgtgaccaagtactacagatggatgcagaagaacggcggctacatctggatccagagcagcgccaccatcgccatcaacgccaagaacgccaacgagaagaacatcatctgggtgaactacctgctgagcaaccccgagtacaaggacacccccatggacatcgcccagctgccccacctgcccgagaagaccagcgagagcagcgagaccagcgacagcgagagcgacagcaaggacaccagcggcatcaccgaggacaacgagaacagcaagagcgacgagaagggcaaccagagcgagaacagcgaggaccccgagcccgacagaaagaagagcggcaacgcctgcgacaacgacatgaactgcaacgacgacggccacagcagcagcaaccccgacagcagagacagcgacgacagcttcgagcacagcgacttcgagaaccccaaggccggcgaggacggcttcggcgccctgggcgccatgcagatcaaggtggagagatacgtggagagcgagagcgacctgagactgcagaactgcgagagcctgaccagcgacagcgccaaggacagcgacagcgccggcgaggccggcgcccaggccagcagcaagcaccagaagagaaagaagagaagaaagagacagaagggcggcagcgccagcagaagaagactgagcagcgccagcagccccggcggcctggacgccggcctggtggagccccccagactgctgagcagccccaacagcgccagcgtgctgaagatcaagaccgagatcagcgagcccatcaacttcgacaacgacagcagcatctggaactacccccccaacagagagatcagcagaaacgagagcccctacagcatgaccaagccccccagcagcgagcacttccccagcccccagggcggcggcggcggcggcggcggcggcggcggcctgcacgtggccatccccgacagcgtgctgaccccccccggcgccgacggcgccgccgccagaaagacccagttcggcgccagcgccaccgccgccctggcccccgtggccagcgaccccctgagcccccccctgagcgccagccccagagacaagcaccccggcaacggcggcggcggcggcggcggcggcggcggcgccggcggcggcggccccagcgccagcaacagcctgctgtacaccggcgacctggaggccctgcagagactgcaggccggcaacgtggtgctgcccctggtgcacagagtgaccggcaccctggccgccaccagcaccgccgcccagagagtgtacaccaccggcaccatcagatacgcccccgccgaggtgaccctggccatgcagagcaacctgctgcccaacgcccacgccgtgaacttcgtggacgtgaacagccccggcttcggcctggaccccaagacccccatggagatgctgtaccaccacgtgcacagactgaacatgagcggccccttcggcggcgccgtgagcgccgccagcctgacccagatgcccgccggcaacgtgttcaccaccgccgagggcctgttcagcaccctgcccttccccgtgtacagcaacggcatccacgccgcccagaccctggagagaaaggaggactag

SEQ ID NO: 90927 - DNA, 462 bp, Artificial Sequence
  Description of Artificial Sequence: Synthetic coding sequence
atgagagacttcgccaaccagggcgaccccccctggaacctgagaatggagggccccccccccaacaccagcgtgaagggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggtgtgcttcccccccgccagcgaccagttcctgctgtag

SEQ ID NO: 90928 - DNA, 2712 bp, Artificial Sequence
  Description of Artificial Sequence: Synthetic coding sequence
atggcccccaccaagcccagcttccagcaggaccccagcagaagagagagactgcaggccctgagaaaggagaagagcagagacgccgccagaagcagaagaggcaaggagaacttcgagttctacgagctggccaagctgctgcccctgcccgccgccatcaccagccagctggacaaggccagcatcatcagactgaccatcagctacctgaagatgagagacttcgccaaccagggcgaccccccctggaacctgagaatggagggccccccccccaacaccagcgtgaaggtgatcggcgcccagagaagaagaagccccagcgccctggccatcgaggtgttcgaggcccacctgggcagccacatcctgcagagcctggacggcttcgtgttcgccctgaaccaggagggcaagttcctgtacatcagcgagaccgtgagcatctacctgggcctgagccaggtggagctgaccggcagcagcgtgttcgactacgtgcaccccggcgaccacgtggagatggccgagcagctgggcatgaagctgccccccggcagaggcctgctgagccagggcaccgccgaggacggcgccagcagcgccagcagcagcagccagagcgagacccccgagcccgtggagagcaccagccccagcctgctgaccaccgacaacaccctggagagaagcttcttcatcagaatgaagagcaccctgaccaagagaggcgtgcacatcaagagcagcggctacaaggtgatccacatcaccggcagactgagactgagagtgagcctgagccacggcagaaccgtgcccagccagatcatgggcctggtggtggtggcccacgccctgcccccccccaccatcaacgaggtgagaatcgactgccacatgttcgtgaccagagtgaacatggacctgaacatcatctactgcgagaacagaatcagcgactacatggacctgacccccgtggacatcgtgggcaagagatgctaccacttcatccacgccgaggacgtggagggcatcagacacagccacctggacctgctgaacaagggccagtgcgtgaccaagtactacagatggatgcagaagaacggcggctacatctggatccagagcagcgccaccatcgccatcaacgccaagaacgccaacgagaagaacatcatctgggtgaactacctgctgagcaaccccgagtacaaggacacccccatggacatcgcccagctgccccacctgcccgagaagaccagcgagagcagcgagaccagcgacagcgagagcgacagcaaggacaccagcggcatcaccgaggacaacgagaacagcaagagcgacgagaagggcaaccagagcgagaacagcgaggaccccgagcccgacagaaagaagagcggcaacgcctgcgacaacgacatgaactgcaacgacgacggccacagcagcagcaaccccgacagcagagacagcgacgacagcttcgagcacagcgacttcgagaaccccaaggccggcgaggacggcttcggcgccctgggcgccatgcagatcaaggtggagagatacgtggagagcgagagcgacctgagactgcagaactgcgagagcctgaccagcgacagcgccaaggacagcgacagcgccggcgaggccggcgcccaggccagcagcaagcaccagaagagaaagaagagaagaaagagacagaagggcggcagcgccagcagaagaagactgagcagcgccagcagccccggcggcctggacgccggcctggtggagccccccagactgctgagcagccccaacagcgccagcgtgctgaagatcaagaccgagatcagcgagcccatcaacttcgacaacgacagcagcatctggaactacccccccaacagagagatcagcagaaacgagagcccctacagcatgaccaagccccccagcagcgagcacttccccagcccccagggcggcggcggcggcggcggcggcggcggcggcctgcacgtggccatccccgacagcgtgctgaccccccccggcgccgacggcgccgccgccagaaagacccagttcggcgccagcgccaccgccgccctggcccccgtggccagcgaccccctgagcccccccctgagcgccagccccagagacaagcaccccggcaacggcggcggcggcggcggcggcggcggcggcgccggcggcggcggccccagcgccagcaacagcctgctgtacaccggcgacctggaggccctgcagagactgcaggccggcaacgtggtgctgcccctggtgcacagagtgaccggcaccctggccgccaccagcaccgccgcccagagagtgtacaccaccggcaccatcagatacgcccccgccgaggtgaccctggccatgcagagcaacctgctgcccaacgcccacgccgtgaacttcgtggacgtgaacagccccggcttcggcctggaccccaagacccccatggagatgctgtaccaccacgtgcacagactgaacatgagcggccccttcggcggcgccgtgagcgccgccagcctgacccagatgcccgccggcaacgtgttcaccaccgccgagggcctgttcagcaccctgcccttccccgtgtacagcaacggcatccacgccgcccagaccctggagagaaaggaggactag

SEQ ID NO: 90929 - DNA, 2409 bp, Artificial Sequence
  Description of Artificial Sequence: Synthetic coding sequence
atgtacagaagcaccaagggcgccagcaaggccagaagagaccagatcaacgccgagatcagaaacctgaaggagctgctgcccctggccgaggccgacaaggtgagactgagctacctgcacatcatgagcctggcctgcatctacaccagaaagggcgtgttcttcgccggcggcacccccctggccggccccaccggcctgctgagcgcccaggagctggaggacatcgtggccgccctgcccggcttcctgctggtgttcaccgccgagggcaagctgctgtacctgagcgagagcgtgagcgagcacctgggccacagcatggtggacctggtggcccagggcgacagcatctacgacatcatcgaccccgccgaccacctgaccgtgagacagcagctgaccctgcccagcgccctggacaccgacagactgttcagatgcagattcaacaccagcaagagcctgagaagacagagcgccggcaacaagctggtgctgatcagaggcagattccacgcccacccccccggcgcctactgggccggcaaccccgtgttcaccgccttctgcgcccccctggagcccagacccagacccggccccggccccggccccggccccgccagcctgttcctggccatgttccagagcagacacgccaaggacctggccctgctggacatcagcgagagcgtgctgatctacctgggcttcgagagaagcgagctgctgtgcaagagctggtacggcctgctgcaccccgaggacctggcccacgccagcgcccagcactacagactgctggccgagagcggcgacatccaggccgagatggtggtgagactgcaggccaagaccggcggctgggcctggatctactgcctgctgtacagcgagggccccgagggccccatcaccgccaacaactaccccatcagcgacatggaggcctggagcctgagacagcagctgaacagcgaggacacccaggccgcctacgtgctgggcacccccaccatgctgcccagcttccccgagaacatcctgagccaggaggagtgcagcagcaccaaccccctgttcaccgccgccctgggcgcccccagaagcaccagcttccccagcgcccccgagctgagcgtggtgagcgccagcgaggagctgcccagacccagcaaggagctggacttcagctacctgaccttccccagcggccccgagcccagcctgcaggccgagctgagcaaggacctggtgtgcacccccccctacaccccccaccagcccggcggctgcgccttcctgttcagcctgcacgagcccttccagacccacctgcccacccccagcagcaccctgcaggagcagctgacccccagcaccgccaccttcagcgaccagctgacccccagcagcgccaccttccccgaccccctgaccagccccctgcagggccagctgaccgagaccagcgtgagaagctacgaggaccagctgaccccctgcaccagcaccttccccgaccagctgctgcccagcaccgccaccttccccgagcccctgggcagccccgcccacgagcagctgaccccccccagcaccgccttccaggcccacctggacagccccagccagaccttccccgagcagctgagccccaaccccaccaagacctacttcgcccaggagggctgcagcttcctgtacgagaagctgccccccagccccagcagccccggcaacggcgactgcaccctgctggccctggcccagctgagaggccccctgagcgtggacgtgcccctggtgcccgagggcctgctgacccccgaggccagccccgtgaagcagagcttcttccactacagcgagaaggagcagaacgagatcgacagactgatccagcagatcagccagctggcccagggcatggacagacccttcagcgccgaggccggcaccggcggcctggagcccctgggcggcctggagcccctggacagcaacctgagcctgagcggcgccggcccccccgtgctgagcctggacctgaagccctggaagtgccaggagctggacttcctggccgaccccgacaacatgttcctggaggagacccccgtggaggacatcttcatggacctgagcacccccgaccccagcgaggagtggggcagcggcgaccccgaggccgagggccccggcggcgcccccagcccctgcaacaacctgagccccgaggaccacagcttcctggaggacctggccacctacgagaccgccttcgagaccggcgtgagcgccttcccctacgacggcttcaccgacgagctgcaccagctgcagagccaggtgcaggacagcttccacgaggacggcagcggcggcgagcccaccttctag

SEQ ID NO: 90930 - DNA, 705 bp, Artificial Sequence
  Description of Artificial Sequence: Synthetic coding sequence
atgtacagaagcaccaagggcgccagcaaggccagaagagaccagatcaacgccgagatcagaaacctgaaggagctgctgcccctggccgaggccgacaaggtgagactgagctacctgcacatcatgagcctggcctgcatctacaccagaaagggcgtgttcttcgccggcggcacccccctggccggccccaccggcctgctgagcgcccaggagctggaggacatcgtggccgccctgcccggcttcctgctggtgttcaccgccgagggcaagctgctgtacctgagcgagagcgtgagcgagcacctgggccacagcatggtggacctggtggcccagggcgacagcatctacgacatcatcgaccccgccgaccacctgaccgtgagacagcagctgaccctgcccagcgccctggacaccgacagactgttcagatgcagattcaacaccagcaagagcctgagaagacagagcgccggcaacaagctggtgctgatcagaggcagattccacgcccacccccccggcgcctactgggccggcaaccccgtgttcaccgccttctgcgcccccctggagcccagacccagacccggccccggccccggccccggccccgccagcctgttcctggccatgttccagagcagacacgccaaggacctggccctgctggacatcagcgagagcggctag

SEQ ID NO: 90931 - DNA, 1299 bp, Artificial Sequence
  Description of Artificial Sequence: Synthetic coding sequence
atgcccgccggcagagccgccagaacctgcgccctgctggccctgtgcctgctgggcgccggcgcccaggacttcggccccaccagattcatctgcaccagcgtgcccgtggacgccgacatgtgcgccgccagcgtggccgccggcggcgccgaggagctgagaagcagcgtgctgcagctgagagagaccgtgctgcagcagaaggagaccatcctgagccagaaggagaccatcagagagctgaccgccaagctgggcagatgcgagagccagagcaccctggaccccggcgccggcgaggccagagccggcggcggcagaaagcagcccggcagcggcaagaacaccatgggcgacctgagcagaacccccgccgccgagaccctgagccagctgggccagaccctgcagagcctgaagaccagactggagaacctggagcagtacagcagactgaacagcagcagccagaccaacagcctgaaggacctgctgcagagcaagatcgacgagctggagagacaggtgctgagcagagtgaacaccctggaggagggcaagggcggccccagaaacgacaccgaggagagagtgaagatcgagaccgccctgaccagcctgcaccagagaatcagcgagctggagaagggccagaaggacaacagacccggcgacaagttccagctgaccttccccctgagaaccaactacatgtacgccaaggtgaagaagagcctgcccgagatgtacgccttcaccgtgtgcatgtggctgaagagcagcgccacccccggcgtgggcacccccttcagctacgccgtgcccggccaggccaacgagctggtgctgatcgagtggggcaacaaccccatggagatcctgatcaacgacaaggtggccaagctgcccttcgtgatcaacgacggcaagtggcaccacatctgcgtgacctggaccaccagagacggcgtgtgggaggcctaccaggacggcacccagggcggcagcggcgagaacctggccccctaccaccccatcaagccccagggcgtgctggtgctgggccaggagcaggacaccctgggcggcggcttcgacgccacccaggccttcgtgggcgagctggcccacttcaacatctgggacagaaagctgacccccggcgaggtgtacaacctggccacctgcagcaccaaggccctgagcggcaacgtgatcgcctgggccgagagccacatcgagatctacggcggcgccaccaagtggaccttcgaggcctgcagacagatcaactag

SEQ ID NO: 90932 - DNA, 585 bp, Artificial Sequence
  Description of Artificial Sequence: Synthetic coding sequence
atgtacgccaaggtgaagaagagcctgcccgagatgtacgccttcaccgtgtgcatgtggctgaagagcagcgccacccccggcgtgggcacccccttcagctacgccgtgcccggccaggccaacgagctggtgctgatcgagtggggcaacaaccccatggagatcctgatcaacgacaaggtggccaagctgcccttcgtgatcaacgacggcaagtggcaccacatctgcgtgacctggaccaccagagacggcgtgtgggaggcctaccaggacggcacccagggcggcagcggcgagaacctggccccctaccaccccatcaagccccagggcgtgctggtgctgggccaggagcaggacaccctgggcggcggcttcgacgccacccaggccttcgtgggcgagctggcccacttcaacatctgggacagaaagctgacccccggcgaggtgtacaacctggccacctgcagcaccaaggccctgagcggcaacgtgatcgcctgggccgagagccacatcgagatctacggcggcgccaccaagtggaccttcgaggcctgcagacagatcaactag

SEQ ID NO: 90933 - DNA, 1296 bp, Artificial Sequence
  Description of Artificial Sequence: Synthetic coding sequence
atgctggccctgctggccgccagcgtggccctggccgtggccgccggcgcccaggacagccccgcccccggcagcagattcgtgtgcaccgccctgccccccgaggccgtgcacgccggctgccccctgcccgccatgcccatgcagggcggcgcccagagccccgaggaggagctgagagccgccgtgctgcagctgagagagaccgtggtgcagcagaaggagaccctgggcgcccagagagaggccatcagagagctgaccggcaagctggccagatgcgagggcctggccggcggcaaggccagaggcgccggcgccaccggcaaggacaccatgggcgacctgcccagagaccccggccacgtggtggagcagctgagcagaagcctgcagaccctgaaggacagactggagagcctggagcaccagctgagagccaacgtgagcaacgccggcctgcccggcgacttcagagaggtgctgcagcagagactgggcgagctggagagacagctgctgagaaaggtggccgagctggaggacgagaagagcctgctgcacaacgagaccagcgcccacagacagaagaccgagagcaccctgaacgccctgctgcagagagtgaccgagctggagagaggcaacagcgccttcaagagccccgacgccttcaaggtgagcctgcccctgagaaccaactacctgtacggcaagatcaagaagaccctgcccgagctgtacgccttcaccatctgcctgtggctgagaagcagcgccagccccggcatcggcacccccttcagctacgccgtgcccggccaggccaacgagatcgtgctgatcgagtggggcaacaaccccatcgagctgctgatcaacgacaaggtggcccagctgcccctgttcgtgagcgacggcaagtggcaccacatctgcgtgacctggaccaccagagacggcatgtgggaggccttccaggacggcgagaagctgggcaccggcgagaacctggccccctggcaccccatcaagcccggcggcgtgctgatcctgggccaggagcaggacaccgtgggcggcagattcgacgccacccaggccttcgtgggcgagctgagccagttcaacatctgggacagagtgctgagagcccaggagatcgtgaacatcgccaactgcagcaccaacatgcccggcaacatcatcccctgggtggacaacaacgtggacgtgttcggcggcgccagcaagtggcccgtggagacctgcgaggagagactgctggacctgtag

SEQ ID NO: 90934 - DNA, 246 bp, Artificial Sequence
  Description of Artificial Sequence: Synthetic coding sequence
atggccgccgtggccgccgccagcgccgagctgctgatcatcggctggtacatcttcagagtgctgctgcaggtgttcctggagtgctgcatctactgggtgggcttcgccttcagaaacccccccggcacccagcccatcgccagaagcgaggtgttcagatacagcctgcagaagctggcctacaccgtgagcagaaccggcagacaggtgctgggcgagagaagacagagagcccccaactag

SEQ ID NO: 90935 - DNA, 165 bp, Artificial Sequence
  Description of Artificial Sequence: Synthetic coding sequence
atggccgccgtggccgccgccagcgccgagctgctgatcatcggctggtacatcttcagagtgctgctgcaggtgttcagatacagcctgcagaagctggcctacaccgtgagcagaaccggcagacaggtgctgggcgagagaagacagagagcccccaactag

SEQ ID NO: 90936 - DNA, 270 bp, Artificial Sequence
  Description of Artificial Sequence: Synthetic coding sequence
atgatcagcagcgtgaagctgaacctgatcctggtgctgagcctgagcaccatgcacgtgttctggtgctaccccgtgcccagcagcaaggtgagcggcaagagcgactacttcctgatcctgctgaacagctgccccaccagactggacagaagcaaggagctggccttcctgaagcccatcctggagaagatgttcgtgaagagaagcttcagaaacggcgtgggcaccggcatgaagaagaccagcttccagagagccaagagctag

SEQ ID NO: 90937 - DNA, 525 bp, Artificial Sequence
  Description of Artificial Sequence: Synthetic coding sequence
gtggtgctgctgtacgccagcacctacgtgctggtgagcctgagcatcgacagataccacgccatcgtgtaccccatgaaggtgctgatcgtgatcgcctggagcctgagcttcctgttcagcatccccaccctgatcatcttcggcaagagaaccctgagcaacggcgaggtgcagtgctgggccctgtggcccgacgacagctactggaccccctacatgaccatcgtggccttcctgggcagcctgatcaccttcatctgctgctggagcccctacttcctgttcgacatcctggacaacttcaacctgctgcccgacacccaggagagattctacgccagcgtgatcatccagaacctgcccgccctgaacagcgccatcaaccccctgatctactgcgtgttcagcagcagcatcagcttcccctgcagagagcagagaagccaggacagcagaatgaccttcagagagagaaccgagagacacgagatgcagatcctgagcaagcccgagttcatctag

SEQ ID NO: 90938 - DNA, 1134 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgacagcttcaccggcctggtgaacatcctgaccgacatcaactggagattcaccggcgacttcaccgcccccgacctggtgtgcagagtggtgagatacctgcaggtggtgctgctgtacgccagcacctacgtgctggtgagcctgagcatcgacagataccacgccatcgtgtaccccatgaagttcctgcagggcgagaagcaggccagagtgctgatcgtgatcgcctggagcctgagcttcctgttcagcatccccaccctgatcatcttcggcaagagaaccctgagcaacggcgaggtgcagtgctgggccctgtggcccgacgacagctactggaccccctacatgaccatcgtggccttcctggtgtacttcatccccctgaccatcatcagcatcatgtacggcatcgtgatcagaaccatctggatcaagagcaagacctacgagaccgtgatcagcaactgcagcgacggcaagctgtgcagcagctacaacagaggcctgatcagcaaggccaagatcaaggccatcaagtacagcatcatcatcatcctggccttcatctgctgctggagcccctacttcctgttcgacatcctggacaacttcaacctgctgcccgacacccaggagagattctacgccagcgtgatcatccagaacctgcccgccctgaacagcgccatcaaccccctgatctactgcgtgttcagcagcagcatcagcttcccctgcagagtgatcagactgagacagctgcaggaggccgccctgatgctgtgcccccagagagagaactggaagggcacctggcccggcgtgcccagctgggccctgcccagatag

SEQ ID NO: 90939 - DNA, 1116 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgacagcttcaccggcctggtgaacatcctgaccgacatcaactggagattcaccggcgacttcaccgcccccgacctggtgtgcagagtggtgagatacctgcaggtggtgctgctgtacgccagcacctacgtgctggtgagcctgagcatcgacagataccacgccatcgtgtaccccatgaagttcctgcagggcgagaagcaggccagagtgctgatcgtgatcgcctggagcctgagcttcctgttcagcatccccaccctgatcatcttcggcaagagaaccctgagcaacggcgaggtgcagtgctgggccctgtggcccgacgacagctactggaccccctacatgaccatcgtggccttcctggtgtacttcatccccctgaccatcatcagcatcatgtacggcatcgtgatcagaaccatctggatcaagagcaagacctacgagaccgtgatcagcaactgcagcgacggcaagctgtgcagcagctacaacagaggcctgatcagcaaggccaagatcaaggccatcaagtacagcatcatcatcatcctggccttcatctgctgctggagcccctacttcctgttcgacatcctggacaacttcaacctgctgcccgacacccaggagagattctacgccagcgtgatcatccagaacctgcccgccctgaacagcgccatcaaccccctgatctactgcgtgttcagcagcagcatcagcttcccctgcagagagcagagaagccaggacagcagaatgaccttcagagagagaaccgagagacacgagatgcagatcctgagcaagcccgagttcatctag

SEQ ID NO: 90940 - DNA, 1173 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgacagcttcaccggcctggtgaacatcctgaccgacatcaactggagattcaccggcgacttcaccgcccccgacctggtgtgcagagtggtgagatacctgcaggtggtgctgctgtacgccagcacctacgtgctggtgagcctgagcatcgacagataccacgccatcgtgtaccccatgaagttcctgcagggcgagaagcaggccagagtgctgatcgtgatcgcctggagcctgagcttcctgttcagcatccccaccctgatcatcttcggcaagagaaccctgagcaacggcgaggtgcagtgctgggccctgtggcccgacgacagctactggaccccctacatgaccatcgtggccttcctggtgtacttcatccccctgaccatcatcagcatcatgtacggcatcgtgatcagaaccatctggatcaagagcaagacctacgagaccgtgatcagcaactgcagcgacggcaagctgtgcagcagctacaacagaggcctgatcagcaaggccaagatcaaggccatcaagtacagcatcatcatcatcctggccttcatctgctgctggagcccctacttcctgttcgacatcctggacaacttcaacctgctgcccgacacccaggagagattctacgccagcgtgatcatccagaacctgcccgccctgaacagcgccatcaaccccctgatctactgcgtgttcagcagcagcatcagcttcccctgcagagccaacagcagcgtgtacctgctggcctgcgacgtgagcgtgctgtgggccctggtgctgaccagcgagaaggagagctgcgagagctggagaagaaagggcgccaagatcaccggcttccagaacgacgtgcccggcgagaactag

SEQ ID NO: 90941 - DNA, 918 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgagaagcaggccagagtgctgatcgtgatcgcctggagcctgagcttcctgttcagcatccccaccctgatcatcttcggcaagagaaccctgagcaacggcgaggtgcagtgctgggccctgtggcccgacgacagctactggaccccctacatgaccatcgtggccttcctggtgtacttcatccccctgaccatcatcagcatcatgtacggcatcgtgatcagaaccatctggatcaagagcaagacctacgagaccgtgatcagcaactgcagcgacggcaagctgtgcagcagctacaacagaggcctgatcagcaaggccaagatcaaggccatcaagtacagcatcatcatcatcctggccttcatctgctgctggagcccctacttcctgttcgacatcctggacaacttcaacctgctgcccgacacccaggagagattctacgccagcgtgatcatccagaacctgcccgccctgaacagcgccatcaaccccctgatctactgcgtgttcagcagcagcatcagcttcccctgcagagagcagagaagccaggacagcagaatgaccttcagagagagaaccgagagacacgagatgcagatcctgagcaagcccgagttcatctag

SEQ ID NO: 90942 - DNA, 432 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgacagcttcaccggcctggtgaacatcctgaccgacatcaactggagattcaccggcgacttcaccgcccccgacctggtgtgcagagtggtgagatacctgcaggtgatggtgatgaagctgttccacatccagaagatgaacatggagtag

SEQ ID NO: 90943 - DNA, 285 bp, Artificial Sequence
  Description of Artificial Sequence: Synthetic coding sequence
atgcccgccaacttcaccgagggcagcttcgacagcagcggcaccggccagaccctggacagcagccccgtggcctgcaccgagaccgtgaccttcaccgaggtggtggagggcaaggagtggggcagcttctactacagcttcaagaccgagcagctgatcaccctgtgggtgctgttcgtgttcaccatcgtgggcaacagcgtggtgctgttcagcacctggagaagaaagaagaagagcagaatgaccttcttcgtgacccagctggccatcaccgtgtag

SEQ ID NO: 90944 - DNA, 294 bp, Artificial Sequence
  Description of Artificial Sequence: Synthetic coding sequence
atgctgggcaacaagagactgggcctgagcggcctgaccctggccctgagcctgctggtgtgcctgggcgccctggccgaggcctaccccagcaagcccgacaaccccggcgaggacgcccccgccgaggacatggccagatactacagcgccctgagacactacatcaacctgatcaccagacagagatacggcaagagaagcagccccgagaccctgatcagcgacctgctgatgagagagagcaccgagaacgtgcccagaaccagactggaggaccccgccatgtggtag

SEQ ID NO: 90945 - DNA, 294 bp, Artificial Sequence; identical to SEQ ID NO: 90944
  Description of Artificial Sequence: Synthetic coding sequence

SEQ ID NO: 90946 - DNA, 294 bp, Artificial Sequence; identical to SEQ ID NO: 90944
  Description of Artificial Sequence: Synthetic coding sequence

SEQ ID NO: 90947 - DNA, 1155 bp, Artificial Sequence
  Description of Artificial Sequence: Synthetic coding sequence
atgaacagcaccctgttcagccaggtggagaaccacagcgtgcacagcaacttcagcgagaagaacgcccagctgctggccttcgagaacgacgactgccacctgcccctggccatgatcttcaccctggccctggcctacggcgccgtgatcatcctgggcgtgagcggcaacctggccctgatcatcatcatcctgaagcagaaggagatgagaaacgtgaccaacatcctgatcgtgaacctgagcttcagcgacctgctggtggccatcatgtgcctgcccttcaccttcgtgtacaccctgatggaccactgggtgttcggcgaggccatgtgcaagctgaaccccttcgtgcagtgcgtgagcatcaccgtgagcatcttcagcctggtgctgatcgccgtggagagacaccagctgatcatcaaccccagaggctggagacccaacaacagacacgcctacgtgggcatcgccgtgatctgggtgctggccgtggccagcagcctgcccttcctgatctaccaggtgatgaccgacgagcccttccagaacgtgaccctggacgcctacaaggacaagtacgtgtgcttcgaccagttccccagcgacagccacagactgagctacaccaccctgctgctggtgctgcagtacttcggccccctgtgcttcatcttcatctgctacttcaagatctacatcagactgaagagaagaaacaacatgatggacaagatgagagacaacaagtacagaagcagcgagaccaagagaatcaacatcatgctgctgagcatcgtggtggccttcgccgtgtgctggctgcccctgaccatcttcaacaccgtgttcgactggaaccaccagatcatcgccacctgcaaccacaacctgctgttcctgctgtgccacctgaccgccatgatcagcacctgcgtgaaccccatcttctacggcttcctgaacaagaacttccagagagacctgcagttcttcttcaacttctgcgacttcagaagcagagacgacgactacgagaccatcgccatgagcaccatgcacaccgacgtgagcaagaccagcctgaagcaggccagccccgtggccttcaagaagatcaacaacaacgacgacaacgagaagatctag

SEQ ID NO: 90948 - DNA, 186 bp, Artificial Sequence
  Description of Artificial Sequence: Synthetic coding sequence
atgaacagcaccctgttcagccaggtggagaaccacagcgtgcacagcaacttcagcgagaagaacgcccagctgctggccttcgagaacgacgactgccacctgcccctggccatgatcttcaccctggccctggcctacggcgccgtgatcatcctgggcgtgagcggcaacctggccctgtag

SEQ ID NO: 90949 - DNA, 426 bp, Artificial Sequence
  Description of Artificial Sequence: Synthetic coding sequence
atgatggacaagatgagagacaacaagtacagaagcagcgagaccaagagaatcaacatcatgctgctgagcatcgtggtggccttcgccgtgtgctggctgcccctgaccatcttcaacaccgtgttcgactggaaccaccagatcatcgccacctgcaaccacaacctgctgttcctgctgtgccacctgaccgccatgatcagcacctgcgtgaaccccatcttctacggcttcctgaacaagaacttccagagagacctgcagttcttcttcaacttctgcgacttcagaagcagagacgacgactacgagaccatcgccatgagcaccatgcacaccgacgtgagcaagaccagcctgaagcaggccagccccgtggccttcaagaagatcaacaacaacgacgacaacgagaagatctag

SEQ ID NO: 90950 - DNA, 78 bp, Artificial Sequence
  Description of Artificial Sequence: Synthetic coding sequence
atgaacagcaccctgttcagccaggtggagaaccacagcgtgcacagcaacttcagcgagaagaacgcccagctgtag

SEQ ID NO: 90951 - DNA, 183 bp, Artificial Sequence
  Description of Artificial Sequence: Synthetic coding sequence
atgaacagcaccctgttcagccaggtggagaaccacagcgtgcacagcaacttcagcgagaagaacgcccagctgctggccttcgagaacgacgactgccacctgcccctggccatgatcttcaccctggccctggcctacggcgccgtgatcatcctgggcgtgagcggcaacctggcctag

SEQ ID NO: 90952 - DNA, 1146 bp, Artificial Sequence
  Description of Artificial Sequence: Synthetic coding sequence
atgggccccatcggcgccgaggccgacgagaaccagaccgtggaggagatgaaggtggagcagtacggcccccagaccacccccagaggcgagctggtgcccgaccccgagcccgagctgatcgacagcaccaagctgatcgaggtgcaggtggtgctgatcctggcctactgcagcatcatcctgctgggcgtgatcggcaacagcctggtgatccacgtggtgatcaagttcaagagcatgagaaccgtgaccaacttcttcatcgccaacctggccgtggccgacctgctggtgaacaccctgtgcctgcccttcaccctgacctacaccctgatgggcgagtggaagatgggccccgtgctgtgccacctggtgccctacgcccagggcctggccgtgcaggtgagcaccatcaccctgaccgtgatcgccctggacagacacagatgcatcgtgtaccacctggagagcaagatcagcaagagaatcagcttcctgatcatcggcctggcctggggcatcagcgccctgctggccagccccctggccatcttcagagagtacagcctgatcgagatcatccccgacttcgagatcgtggcctgcaccgagaagtggcccggcgaggagaagagcatctacggcaccgtgtacagcctgagcagcctgctgatcctgtacgtgctgcccctgggcatcatcagcttcagctacaccagaatctggagcaagctgaagaaccacgtgagccccggcgccgccaacgaccactaccaccagagaagacagaagaccaccaagatgctggtgtgcgtggtggtggtgttcgccgtgagctggctgcccctgcacgccttccagctggccgtggacatcgacagccaggtgctggacctgaaggagtacaagctgatcttcaccgtgttccacatcatcgccatgtgcagcaccttcgccaaccccctgctgtacggctggatgaacagcaactacagaaaggccttcctgagcgccttcagatgcgagcagagactggacgccatccacagcgaggtgagcgtgaccttcaaggccaagaagaacctggaggtgagaaagaacagcggccccaacgacagcttcaccgaggccaccaacgtgtag

SEQ ID NO: 90953 - DNA, 1146 bp, Artificial Sequence; identical to SEQ ID NO: 90952
  Description of Artificial Sequence: Synthetic coding sequence

SEQ ID NO: 90954 - DNA, 1338 bp, Artificial Sequence
  Description of Artificial Sequence: Synthetic coding sequence
atggacctggagctggacgagtactacaacaagaccctggccaccgagaacaacaccgccgccaccagaaacagcgacttccccgtgtgggacgactacaagagcagcgtggacgacctgcagtacttcctgatcggcctgtacaccttcgtgagcctgctgggcttcatgggcaacctgctgatcctgatggccctgatgaagaagagaaaccagaagaccaccgtgaacttcctgatcggcaacctggccttcagcgacatcctggtggtgctgttctgcagccccttcaccctgaccagcgtgctgctggaccagtggatgttcggcaaggtgatgtgccacatcatgcccttcctgcagtgcgtgagcgtgctggtgagcaccctgatcctgatcagcatcgccatcgtgagataccacatgatcaagcaccccatcagcaacaacctgaccgccaaccacggctacttcctgatcgccaccgtgtggaccctgggcttcgccatctgcagccccctgcccgtgttccacagcctggtggagctgcaggagaccttcggcagcgccctgctgagcagcagatacctgtgcgtggagagctggcccagcgacagctacagaatcgccttcaccatcagcctgctgctggtgcagtacatcctgcccctggtgtgcctgaccgtgagccacaccagcgtgtgcagaagcatcagctgcggcctgagcaacaaggagaacagactggaggagaacgagatgatcaacctgaccctgcaccccagcaagaagagcggcccccaggtgaagctgagcggcagccacaagtggagctacagcttcatcaagaagcacagaagaagatacagcaagaagaccgcctgcgtgctgcccgcccccgagagacccagccaggagaaccacagcagaatcctgcccgagaacttcggcagcgtgagaagccagctgagcagcagcagcaagttcatccccggcgtgcccacctgcttcgagatcaagcccgaggagaacagcgacgtgcacgagctgagagtgaagagaagcgtgaccagaatcaagaagagaagcagaagcgtgttctacagactgaccatcctgatcctggtgttcgccgtgagctggatgcccctgcacctgttccacgtggtgaccgacttcaacgacaacctgatcagcaacagacacttcaagctggtgtactgcatctgccacctgctgggcatgatgagctgctgcctgaaccccatcctgtacggcttcctgaacaacggcatcaaggccgacctggtgagcctgatccactgcctgcacatgtag

SEQ ID NO: 90955 - DNA, 1338 bp, Artificial Sequence; identical to SEQ ID NO: 90954
  Description of Artificial Sequence: Synthetic coding sequence

SEQ ID NO: 90956 - DNA, 1338 bp, Artificial Sequence; identical to SEQ ID NO: 90954
  Description of Artificial Sequence: Synthetic coding sequence

SEQ ID NO: 90957 - DNA, 987 bp, Artificial Sequence
  Description of Artificial Sequence: Synthetic coding sequence
atggacaacgccagcttcagcgagccctggcccgccaacgccagcggccccgaccccgccctgagctgcagcaacgccagcaccctggcccccctgcccgcccccctggccgtggccgtgcccgtggtgtacgccgtgatctgcgccgtgggcctggccggcaacagcgccgtgctgtacgtgctgctgagagcccccagaatgaagaccgtgaccaacctgttcatcctgaacctggccatcgccgacgagctgttcaccctggtgctgcccatcaacatcgccgacttcctgctgagacagtggcccttcggcgagctgatgtgcaagctgatcgtggccatcgaccagtacaacaccttcagcagcctgtacttcctgaccgtgatgagcgccgacagatacctggtggtgctggccaccgccgagagcagaagagtggccggcagaacctacagcgccgccagagccgtgagcctggccgtgtggggcatcgtgaccctggtggtgctgcccttcgccgtgttcgccagactggacgacgagcagggcagaagacagtgcgtgctggtgttcccccagcccgaggccttctggtggagagccagcagactgtacaccctggtgctgggcttcgccatccccgtgagcaccatctgcgtgctgtacaccaccctgctgtgcagactgcacgccatgagactggacagccacgccaaggccctggagagagccaagaagagagtgaccttcctggtggtggccatcctggccgtgtgcctgctgtgctggaccccctaccacctgagcaccgtggtggccctgaccaccgacctgccccagacccccctggtgatcgccatcagctacttcatcaccagcctgagctacgccaacagctgcctgaaccccttcctgtacgccttcctggacgccagcttcagaagaaacctgagacagctgatcacctgcagagccgccgcctag

SEQ ID NO: 90958 - DNA, 1599 bp, Artificial Sequence
  Description of Artificial Sequence: Synthetic coding sequence
atgctggccgagcccttccccaaggtggtggccagcctgatcatcctgcacctgagcggcgccaccaagaagggcaccgagaagcagaccaccagcgagacccagaagagcgtgcagtgcggcacctggaccaagcacgccgagggcggcatcttcaccagccccaactaccccagcaagtacccccccgacagagagtgcatctacatcatcgaggccgcccccagacagtgcatcgagctgtacttcgacgagaagtacagcatcgagcccagctgggagtgcaagttcgaccacatcgaggtgagagacggccccttcggcttcagccccatcatcggcagattctgcggccagcagaacccccccgtgatcaagagcagcggcagattcctgtggatcaagttcttcgccgacggcgagctggagagcatgggcttcagcgccagatacaacttcacccccgaccccgacttcaaggacctgggcgccctgaagcccctgcccgcctgcgagttcgagatgggcggcagcgagggcatcgtggagagcatccagatcatgaaggagggcaaggccaccgccagcgaggccgtggactgcaagtggtacatcagagccccccccagaagcaagatctacctgagattcctggactacgagatgcagaacagcaacgagtgcaagagaaacttcgtggccgtgtacgacggcagcagcagcgtggaggacctgaaggccaagttctgcagcaccgtggccaacgacgtgatgctgagaaccggcctgggcgtgatcagaatgtgggccgacgagggcagcagaaacagcagattccagatgctgttcaccagcttccaggagcccccctgcgagggcaacaccttcttctgccacagcaacatgtgcatcaacaacaccctggtgtgcaacggcctgcagaactgcgtgtacccctgggacgagaaccactgcaaggagaagagaaagaccagcctgctggaccagctgaccaacaccagcggcaccgtgatcggcgtgaccagctgcatcgtgatcatcctgatcatcatcagcgtgatcgtgcagatcaagcagcccagaaagaagtacgtgcagagaaagagcgacttcgaccagaccgtgttccaggaggtgttcgagcccccccactacgagctgtgcaccctgagaggcaccggcgccaccgccgacttcgccgacgtggccgacgacttcgagaactaccacaagctgagaagaagcagcagcaagtgcatccacgaccaccactgcggcagccagctgagcagcaccaagggcagcagaagcaacctgagcaccagagacgccagcatcctgaccgagatgcccacccagcccggcaagcccctgatcccccccatgaacagaagaaacatcctggtgatgaagcacagctacagccaggacgccgccgacgcctgcgacatcgacgagatcgaggaggtgcccaccaccagccacagactgagcagacacgacaaggccgtgcagagattctgcctgatcggcagcctgagcaagcacgagagcgagtacaacaccaccagagtgtag

SEQ ID NO: 90959 - DNA, 1602 bp, Artificial Sequence
  Description of Artificial Sequence: Synthetic coding sequence
atgatccacggcagaagcgtgctgcacatcgtggccagcctgatcatcctgcacctgagcggcgccaccaagaagggcaccgagaagcagaccaccagcgagacccagaagagcgtgcagtgcggcacctggaccaagcacgccgagggcggcatcttcaccagccccaactaccccagcaagtacccccccgacagagagtgcatctacatcatcgaggccgcccccagacagtgcatcgagctgtacttcgacgagaagtacagcatcgagcccagctgggagtgcaagttcgaccacatcgaggtgagagacggccccttcggcttcagccccatcatcggcagattctgcggccagcagaacccccccgtgatcaagagcagcggcagattcctgtggatcaagttcttcgccgacggcgagctggagagcatgggcttcagcgccagatacaacttcacccccgaccccgacttcaaggacctgggcgccctgaagcccctgcccgcctgcgagttcgagatgggcggcagcgagggcatcgtggagagcatccagatcatgaaggagggcaaggccaccgccagcgaggccgtggactgcaagtggtacatcagagccccccccagaagcaagatctacctgagattcctggactacgagatgcagaacagcaacgagtgcaagagaaacttcgtggccgtgtacgacggcagcagcagcgtggaggacctgaaggccaagttctgcagcaccgtggccaacgacgtgatgctgagaaccggcctgggcgtgatcagaatgtgggccgacgagggcagcagaaacagcagattccagatgctgttcaccagcttccaggagcccccctgcgagggcaacaccttcttctgccacagcaacatgtgcatcaacaacaccctggtgtgcaacggcctgcagaactgcgtgtacccctgggacgagaaccactgcaaggagaagagaaagaccagcctgctggaccagctgaccaacaccagcggcaccgtgatcggcgtgaccagctgcatcgtgatcatcctgatcatcatcagcgtgatcgtgcagatcaagcagcccagaaagaagtacgtgcagagaaagagcgacttcgaccagaccgtgttccaggaggtgttcgagcccccccactacgagctgtgcaccctgagaggcaccggcgccaccgccgacttcgccgacgtggccgacgacttcgagaactaccacaagctgagaagaagcagcagcaagtgcatccacgaccaccactgcggcagccagctgagcagcaccaagggcagcagaagcaacctgagcaccagagacgccagcatcctgaccgagatgcccacccagcccggcaagcccctgatcccccccatgaacagaagaaacatcctggtgatgaagcacagctacagccaggacgccgccgacgcctgcgacatcgacgagatcgaggaggtgcccaccaccagccacagactgagcagacacgacaaggccgtgcagagattctgcctgatcggcagcctgagcaagcacgagagcgagtacaacaccaccagagtgtag

SEQ ID NO: 90960 - DNA, 471 bp, Artificial Sequence
  Description of Artificial Sequence: Synthetic coding sequence
atgctggccgagcccttccccaaggtggtggccagcctgatcatcctgcacctgagcggcgccaccaagaagggcaccgagaagcagaccaccagcgagacccagaagagcgtgcagtgcggcacctggaccaagcacgccgagggcggcatcttcaccagccccaactaccccagcaagtacccccccgacagagagtgcatctacatcatcgaggccgcccccagacagtgcatcgagctgtacttcgacgagaagtacagcatcgagcccagctgggagtgcaagttcgaccacatcgaggtgagagacggccccttcggcttcagccccatcatcggcagattctgcggccagcagaacccccccgtgatcaagagcagcggcagattcctgtggatcaagttcttcgccgacggcgagctggagagcatgggcttcagcgccagatacaacttcacccccgagtag

SEQ ID NO: 90961 - DNA, 1602 bp, Artificial Sequence; identical to SEQ ID NO: 90959
  Description of Artificial Sequence: Synthetic coding sequence

SEQ ID NO: 90962 - DNA, 1017 bp, Artificial Sequence
  Description of Artificial Sequence: Synthetic coding sequence
atgagcggcagcagcctgcccagcgccctggccctgagcctgctgctggtgagcggcagcctgctgcccggccccggcgccgcccagaacgccggcttcgtgaagagccccatgagcgagaccaagctgaccggcgacgccttcgagctgtactgcgacgtggtgggcagccccacccccgagatccagtggtggtacgccgaggtgaacagagccgagagcttcagacagctgtgggacggcgccagaaagagaagagtgaccgtgaacaccgcctacggcagcaacggcgtgagcgtgctgagaatcaccagactgaccctggaggacagcggcacctacgagtgcagagccagcaacgaccccaagagaaacgacctgagacagaaccccagcatcacctggatcagagcccaggccaccatcagcgtgctgcagaagcccagaatcgtgaccagcgaggaggtgatcatcagagacagccccgtgctgcccgtgaccctgcagtgcaacctgaccagcagcagccacaccctgacctacagctactggaccaagaacggcgtggagctgagcgccaccagaaagaacgccagcaacatggagtacagaatcaacaagcccagagccgaggacagcggcgagtaccactgcgtgtaccacttcgtgagcgcccccaaggccaacgccaccatcgaggtgaaggccgcccccgacatcaccggccacaagagaagcgagaacaagaacgagggccaggacgccaccatgtactgcaagagcgtgggctacccccaccccgactggatctggagaaagaaggagaacggcatgcccatggacatcgtgaacaccagcggcagattcttcatcatcaacaaggagaactacaccgagctgaacatcgtgaacctgcagatcaccgaggaccccggcgagtacgagtggtgcggcgccacctggccccacagcggcctgagctgggagttctggctgaagctgagcagcctgtggtag

SEQ ID NO: 90963 - DNA, 1197 bp, Artificial Sequence
  Description of Artificial Sequence: Synthetic coding sequence
atgagcggcagcagcctgcccagcgccctggccctgagcctgctgctggtgagcggcagcctgctgcccggccccggcgccgcccagaacgccggcttcgtgaagagccccatgagcgagaccaagctgaccggcgacgccttcgagctgtactgcgacgtggtgggcagccccacccccgagatccagtggtggtacgccgaggtgaacagagccgagagcttcagacagctgtgggacggcgccagaaagagaagagtgaccgtgaacaccgcctacggcagcaacggcgtgagcgtgctgagaatcaccagactgaccctggaggacagcggcacctacgagtgcagagccagcaacgaccccaagagaaacgacctgagacagaaccccagcatcacctggatcagagcccaggccaccatcagcgtgctgcagaagcccagaatcgtgaccagcgaggaggtgatcatcagagacagccccgtgctgcccgtgaccctgcagtgcaacctgaccagcagcagccacaccctgacctacagctactggaccaagaacggcgtggagctgagcgccaccagaaagaacgccagcaacatggagtacagaatcaacaagcccagagccgaggacagcggcgagtaccactgcgtgtaccacttcgtgagcgcccccaaggccaacgccaccatcgaggtgaaggccgcccccgacatcaccggccacaagagaagcgagaacaagaacgagggccaggacgccaccatgtactgcaagagcgtgggctacccccaccccgactggatctggagaaagaaggagaacggcatgcccatggacatcgtgaacaccagcggcagattcttcatcatcaacaaggagaactacaccgagctgaacatcgtgaacctgcagatcaccgaggaccccggcgagtacgagtgcaacgccaccaacgccatcggcagcgccagcgtggtgaccgtgctgagagtgagaagccacctggcccccctgtggcccttcctgggcatcctggccgagatcatcatcctggtggtgatcatcgtggtgtacgagaagagaaagagacccgacgaggtgcccgacgacgacgagcccgccggccccatgaagaccaacagcaccaacaaccacaaggacaagaacctgagacagagaaacaccaactag

SEQ ID NO: 90964 - DNA, 849 bp, Artificial Sequence
  Description of Artificial Sequence: Synthetic coding sequence
atgagcggcagcagcctgcccagcgccctggccctgagcctgctgctggtgagcggcagcctgctgcccggccccggcgccgcccagaacgagcccagaatcgtgaccagcgaggaggtgatcatcagagacagccccgtgctgcccgtgaccctgcagtgcaacctgaccagcagcagccacaccctgacctacagctactggaccaagaacggcgtggagctgagcgccaccagaaagaacgccagcaacatggagtacagaatcaacaagcccagagccgaggacagcggcgagtaccactgcgtgtaccacttcgtgagcgcccccaaggccaacgccaccatcgaggtgaaggccgcccccgacatcaccggccacaagagaagcgagaacaagaacgagggccaggacgccaccatgtactgcaagagcgtgggctacccccaccccgactggatctggagaaagaaggagaacggcatgcccatggacatcgtgaacaccagcggcagattcttcatcatcaacaaggagaactacaccgagctgaacatcgtgaacctgcagatcaccgaggaccccggcgagtacgagtgcaacgccaccaacgccatcggcagcgccagcgtggtgaccgtgctgagagtgagaagccacctggcccccctgtggcccttcctgggcatcctggccgagatcatcatcctggtggtgatcatcgtggtgtacgagaagagaaagagacccgacgaggtgcccgacgacgacgagcccgccggccccatgaagaccaacagcaccaacaaccacaaggacaagaacctgagacagagaaacaccaactag

SEQ ID NO: 90965 - DNA, 582 bp, Artificial Sequence
  Description of Artificial Sequence: Synthetic coding sequence
atgagcggcagcagcctgcccagcgccctggccctgagcctgctgctggtgagcggcagcctgctgcccggccccggcgccgcccagaacgccgcccccgacatcaccggccacaagagaagcgagaacaagaacgagggccaggacgccaccatgtactgcaagagcgtgggctacccccaccccgactggatctggagaaagaaggagaacggcatgcccatggacatcgtgaacaccagcggcagattcttcatcatcaacaaggagaactacaccgagctgaacatcgtgaacctgcagatcaccgaggaccccggcgagtacgagtgcaacgccaccaacgccatcggcagcgccagcgtggtgaccgtgctgagagtgagaagccacctggcccccctgtggcccttcctgggcatcctggccgagatcatcatcctggtggtgatcatcgtggtgtacgagaagagaaagagacccgacgaggtgcccgacgacgacgagcccgccggccccatgaagaccaacagcaccaacaaccacaaggacaagaacctgagacagagaaacaccaactag

SEQ ID NO: 90966 - DNA, 1185 bp, Artificial Sequence
  Description of Artificial Sequence: Synthetic coding sequence
atgagcggcagcagcctgcccagcgccctggccctgagcctgctgctggtgagcggcagcctgctgcccggccccggcgccgcccagaacgccggcttcgtgaagagccccatgagcgagaccaagctgaccggcgacgccttcgagctgtactgcgacgtggtgggcagccccacccccgagatccagtggtggtacgccgaggtgaacagagccgagagcttcagacagctgtgggacggcgccagaaagagaagagtgaccgtgaacaccgcctacggcagcaacggcgtgagcgtgctgagaatcaccagactgaccctggaggacagcggcacctacgagtgcagagccagcaacgaccccaagagaaacgacctgagacagaaccccagcatcacctggatcagagcccaggccaccatcagcgtgctgcagaagcccagaatcgtgaccagcgaggaggtgatcatcagagacagccccgtgctgcccgtgaccctgcagtgcaacctgaccagcagcagccacaccctgacctacagctactggaccaagaacggcgtggagctgagcgccaccagaaagaacgccagcaacatggagtacagaatcaacaagcccagagccgaggacagcggcgagtaccactgcgtgtaccacttcgtgagcgcccccaaggccaacgccaccatcgaggtgaaggccgcccccgacatcaccggccacaagagaagcgagaacaagaacgagggccaggacgccaccatgtactgcaagagcgtgggctacccccaccccgactggatctggagaaagaaggagaacggcatgcccatggacatcgtgaacaccagcggcagattcttcatcatcaacaaggagaactacaccgagctgaacatcgtgaacctgcagatcaccgaggaccccggcgagtacgagtgcaacgccaccaacgccatcggcagcgccagcgtggtgaccgtgctgagagtgagaagccacctggcccccctgtggcccttcctgggcatcctggccgagatcatcatcctggtggtgatcatcgtggtgtacgagaagagaaagagacccgacgaggtgcccgacgtgccccccagaaagaccaacagcaccaacaaccacaaggacaagaacctgagacagagaaacaccaactag

SEQ ID NO: 90967 - DNA, 513 bp, Artificial Sequence
  Description of Artificial Sequence: Synthetic coding sequence
atgatggccggcatgaagatccagctggtgtgcatgctgctgctggccttcagcagctggagcctgtgcagcgacagcgaggaggagatgaaggccctggaggccgacttcctgaccaacatgcacaccagcaagatcagcaaggcccacgtgcccagctggaagatgaccctgctgaacgtgtgcagcctggtgaacaacctgaacagccccgccgaggagaccggcgaggtgcacgaggaggagctggtggccagaagaaagctgcccaccgccctggacggcttcagcctggaggccatgctgaccatctaccagctgcacaagatctgccacagcagagccttccagcactgggagctgatccaggaggacatcctggacaccggcaacgacaagaacggcaaggaggaggtgatcaagagaaagatcccctacatcctgaagagacagctgtacgagaacaagcccagaagaccctacatcctgaagagagacagctactactactag

SEQ ID NO: 90968 - DNA, 348 bp, Artificial Sequence
  Description of Artificial Sequence: Synthetic coding sequence
atgaccctgctgaacgtgtgcagcctggtgaacaacctgaacagccccgccgaggagaccggcgaggtgcacgaggaggagctggtggccagaagaaagctgcccaccgccctggacggcttcagcctggaggccatgctgaccatctaccagctgcacaagatctgccacagcagagccttccagcactgggagctgatccaggaggacatcctggacaccggcaacgacaagaacggcaaggaggaggtgatcaagagaaagatcccctacatcctgaagagacagctgtacgagaacaagcccagaagaccctacatcctgaagagagacagctactactactag

SEQ ID NO: 90969 - DNA, 288 bp, Artificial Sequence
  Description of Artificial Sequence: Synthetic coding sequence
atgatggccggcatgaagatccagctggtgtgcatgctgctgctggccttcagcagctggagcctgtgcagcgacagcgaggaggagatgaaggccctggaggccgacttcctgaccaacatgcacaccagcaagctgatccaggaggacatcctggacaccggcaacgacaagaacggcaaggaggaggtgatcaagagaaagatcccctacatcctgaagagacagctgtacgagaacaagcccagaagaccctacatcctgaagagagacagctactactactag

SEQ ID NO: 90970 - DNA, 1257 bp, Artificial Sequence
  Description of Artificial Sequence: Synthetic coding sequence
atgagactgaacagcagcgcccccggcacccccggcacccccgccgccgaccccttccagagagcccaggccggcctggaggaggccctgctggcccccggcttcggcaacgccagcggcaacgccagcgagagagtgctggccgcccccagcagcgagctggacgtgaacaccgacatctacagcaaggtgctggtgaccgccgtgtacctggccctgttcgtggtgggcaccgtgggcaacaccgtgaccgccttcaccctggccagaaagaagagcctgcagagcctgcagagcaccgtgcactaccacctgggcagcctggccctgagcgacctgctgaccctgctgctggccatgcccgtggagctgtacaacttcatctgggtgcaccacccctgggccttcggcgacgccggctgcagaggctactacttcctgagagacgcctgcacctacgccaccgccctgaacgtggccagcctgagcgtggagagatacctggccatctgccaccccttcaaggccaagaccctgatgagcagaagcagaaccaagaagttcatcagcgccatctggctggccagcgccctgctggccgtgcccatgctgttcaccatgggcgagcagaacagaagcgccgacggccagcacgccggcggcctggtgtgcacccccaccatccacaccgccaccgtgaaggtggtgatccaggtgaacaccttcatgagcttcatcttccccatggtggtgatcagcgtgctgaacaccatcatcgccaacaagctgaccgtgatggtgagacaggccgccgagcagggccaggtgtgcaccgtgggcggcgagcacagcaccttcagcatggccatcgagcccggcagagtgcaggccctgagacacggcgtgagagtgctgagagccgtggtgatcgccttcgtggtgtgctggctgccctaccacgtgagaagactgatgttctgctacatcagcgacgagcagtggacccccttcctgtacgacttctaccactacttctacatggtgaccaacgccctgttctacgtgagcagcaccatcaaccccatcctgtacaacctggtgagcgccaacttcagacacatcttcctggccaccctggcctgcctgtgccccgtgtggagaagaagaagaaagagacccgccttcagcagaaaggccgacagcgtgagcagcaaccacaccctgagcagcaacgccaccagagagaccctgtactag

SEQ ID NO: 90971 - DNA, 951 bp, Artificial Sequence
  Description of Artificial Sequence: Synthetic coding sequence
atgggcgtgtgcggctacctgttcctgccctggaagtgcctggtggtggtgagcctgagactgctgttcctggtgcccaccggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcggcgagaccgtgctgtag

SEQ ID NO: 90972 - DNA, 1035 bp, Artificial Sequence
  Description of Artificial Sequence: Synthetic coding sequence
atgggcgtgtgcggctacctgttcctgccctggaagtgcctggtggtggtgagcctgagactgctgttcctggtgcccaccggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcggccccggcgccgtgagcgaggtgagcaacggcaccagcagaagagccggctgcgtgtggctgctgcccctgctggtgctgcacctgctgctgaagttctag

SEQ ID NO: 90973 - DNA, 1035 bp, Artificial Sequence
  Description of Artificial Sequence: Synthetic coding sequence
atgaagaccatccagcccaagatgcacaacagcatcagctgggccatcttcaccggcctggccgccctgtgcctgttccagggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcggccccggcgccgtgagcgaggtgagcaacggcaccagcagaagagccggctgcgtgtggctgctgcccctgctggtgctgcacctgctgctgaagttctag

SEQ ID NO: 90974 - DNA, 1041 bp, Artificial Sequence
  Description of Artificial Sequence: Synthetic coding sequence
atgaacggcaagagaaacggcgagggcggcaagagatggaagtggaagggcaccggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcgaggtgaagaccaccgccctgaccccctggaagggccccggcgccgtgagcgaggtgagcaacggcaccagcagaagagccggctgcgtgtggctgctgcccctgctggtgctgcacctgctgctgaagttctag

SEQ ID NO: 90975 - DNA, 1068 bp, Artificial Sequence
  Description of Artificial Sequence: Synthetic coding sequence
atgaagaccatccagcccaagatgcacaacagcatcagctgggccatcttcaccggcctggccgccctgtgcctgttccagggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcgaggtgaagaccaccgccctgaccccctggaagggccccggcgccgtgagcgaggtgagcaacggcaccagcagaagagccggctgcgtgtggctgctgcccctgctggtgctgcacctgctgctgaagttctag

SEQ ID NO: 90976 - DNA, 1068 bp, Artificial Sequence
  Description of Artificial Sequence: Synthetic coding sequence
atgggcgtgtgcggctacctgttcctgccctggaagtgcctggtggtggtgagcctgagactgctgttcctggtgcccaccggcgtgcccgtgagaagcggcgacgccaccttccccaaggccatggacaacgtgaccgtgagacagggcgagagcgccaccctgagatgcaccatcgacaacagagtgaccagagtggcctggctgaacagaagcaccatcctgtacgccggcaacgacaagtggtgcctggaccccagagtggtgctgctgagcaacacccagacccagtacagcatcgagatccagaacgtggacgtgtacgacgagggcccctacacctgcagcgtgcagaccgacaaccaccccaagaccagcagagtgcacctgatcgtgcaggtgagccccaagatcgtggagatcagcagcgacatcagcatcaacgagggcaacaacatcagcctgacctgcatcgccaccggcagacccgagcccaccgtgacctggagacacatcagccccaaggccgtgggcttcgtgagcgaggacgagtacctggagatccagggcatcaccagagagcagagcggcgactacgagtgcagcgccagcaacgacgtggccgcccccgtggtgagaagagtgaaggtgaccgtgaactaccccccctacatcagcgaggccaagggcaccggcgtgcccgtgggccagaagggcaccctgcagtgcgaggccagcgccgtgcccagcgccgagttccagtggtacaaggacgacaagagactgatcgagggcaagaagggcgtgaaggtggagaacagacccttcctgagcaagctgatcttcttcaacgtgagcgagcacgactacggcaactacacctgcgtggccagcaacaagctgggccacaccaacgccagcatcatgctgttcgaggtgaagaccaccgccctgaccccctggaagggccccggcgccgtgagcgaggtgagcaacggcaccagcagaagagccggctgcgtgtggctgctgcccctgctggtgctgcacctgctgctgaagttctag

SEQ ID NO: 90977 - DNA, 2373 bp, Artificial Sequence
  Description of Artificial Sequence: Synthetic coding sequence
atgctgagaggcggcagaagaggccagctgggctggcacagctgggccgccggccccggcagcctgctggcctggctgatcctggccagcgccggcgccgccccctgccccgacgcctgctgcccccacggcagcagcggcctgagatgcaccagagacggcgccctggacagcctgcaccacctgcccggcgccgagaacctgaccgagctgtacatcgagaaccagcagcacctgcagcacctggagctgagagacctgagaggcctgggcgagctgagaaacctgaccatcgtgaagagcggcctgagattcgtggcccccgacgccttccacttcacccccagactgagcagactgaacctgagcttcaacgccctggagagcctgagctggaagaccgtgcagggcctgagcctgcaggagctggtgctgagcggcaaccccctgcactgcagctgcgccctgagatggctgcagagatgggaggaggagggcctgggcggcgtgcccgagcagaagctgcagtgccacggccagggccccctggcccacatgcccaacgccagctgcggcgtgcccaccctgaaggtgcaggtgcccaacgccagcgtggacgtgggcgacgacgtgctgctgagatgccaggtggagggcagaggcctggagcaggccggctggatcctgaccgagctggagcagagcgccaccgtgatgaagagcggcggcctgcccagcctgggcctgaccctggccaacgtgaccagcgacctgaacagaaagaacgtgacctgctgggccgagaacgacgtgggcagagccgaggtgagcgtgcaggtgaacgtgagcttccccgccagcgtgcagctgcacaccgccgtggagatgcaccactggtgcatccccttcagcgtggacggccagcccgcccccagcctgagatggctgttcaacggcagcgtgctgaacgagaccagcttcatcttcaccgagttcctggagcccgccgccaacgagaccgtgagacacggctgcctgagactgaaccagcccacccacgtgaacaacggcaactacaccctgctggccgccaaccccttcggccaggccagcgccagcatcatggccgccttcatggacaaccccttcgagttcaaccccgaggaccccatccccgacaccaacagcaccagcggcgaccccgtggagaagaaggacgagacccccttcggcgtgagcgtggccgtgggcctggccgtgttcgcctgcctgttcctgagcaccctgctgctggtgctgaacaagtgcggcagaagaaacaagttcggcatcaacagacccgccgtgctggcccccgaggacggcctggccatgagcctgcacttcatgaccctgggcggcagcagcctgagccccaccgagggcaagggcagcggcctgcagggccacatcatcgagaacccccagtacttcagcgacgcctgcgtgcaccacatcaagagaagagacatcgtgctgaagtgggagctgggcgagggcgccttcggcaaggtgttcctggccgagtgccacaacctgctgcccgagcaggacaagatgctggtggccgtgaaggccctgaaggaggccagcgagagcgccagacaggacttccagagagaggccgagctgctgaccatgctgcagcaccagcacatcgtgagattcttcggcgtgtgcaccgagggcagacccctgctgatggtgttcgagtacatgagacacggcgacctgaacagattcctgagaagccacggccccgacgccaagctgctggccggcggcgaggacgtggcccccggccccctgggcctgggccagctgctggccgtggccagccaggtggccgccggcatggtgtacctggccggcctgcacttcgtgcacagagacctggccaccagaaactgcctggtgggccagggcctggtggtgaagatcggcgacttcggcatgagcagagacatctacagcaccgactactacagagtgggcggcagaaccatgctgcccatcagatggatgccccccgagagcatcctgtacagaaagttcaccaccgagagcgacgtgtggagcttcggcgtggtgctgtgggagatcttcacctacggcaagcagccctggtaccagctgagcaacaccgaggccatcgactgcatcacccagggcagagagctggagagacccagagcctgcccccccgaggtgtacgccatcatgagaggctgctggcagagagagccccagcagagacacagcatcaaggacgtgcacgccagactgcaggccctggcccaggccccccccgtgtacctggacgtgctgggctag

SEQ ID NO: 90978 - DNA, 2283 bp, Artificial Sequence
  Description of Artificial Sequence: Synthetic coding sequence
atgaaggaggccgccctgatctgcctggcccccagcgtgccccccatcctgaccgtgaagagctgggacaccatgcagctgagagccgccagaagcagatgcaccaacctgctggccgccagctacatcgagaaccagcagcacctgcagcacctggagctgagagacctgagaggcctgggcgagctgagaaacctgaccatcgtgaagagcggcctgagattcgtggcccccgacgccttccacttcacccccagactgagcagactgaacctgagcttcaacgccctggagagcctgagctggaagaccgtgcagggcctgagcctgcaggagctggtgctgagcggcaaccccctgcactgcagctgcgccctgagatggctgcagagatgggaggaggagggcctgggcggcgtgcccgagcagaagctgcagtgccacggccagggccccctggcccacatgcccaacgccagctgcggcgtgcccaccctgaaggtgcaggtgcccaacgccagcgtggacgtgggcgacgacgtgctgctgagatgccaggtggagggcagaggcctggagcaggccggctggatcctgaccgagctggagcagagcgccaccgtgatgaagagcggcggcctgcccagcctgggcctgaccctggccaacgtgaccagcgacctgaacagaaagaacgtgacctgctgggccgagaacgacgtgggcagagccgaggtgagcgtgcaggtgaacgtgagcttccccgccagcgtgcagctgcacaccgccgtggagatgcaccactggtgcatccccttcagcgtggacggccagcccgcccccagcctgagatggctgttcaacggcagcgtgctgaacgagaccagcttcatcttcaccgagttcctggagcccgccgccaacgagaccgtgagacacggctgcctgagactgaaccagcccacccacgtgaacaacggcaactacaccctgctggccgccaaccccttcggccaggccagcgccagcatcatggccgccttcatggacaaccccttcgagttcaaccccgaggaccccatccccgacaccaacagcaccagcggcgaccccgtggagaagaaggacgagacccccttcggcgtgagcgtggccgtgggcctggccgtgttcgcctgcctgttcctgagcaccctgctgctggtgctgaacaagtgcggcagaagaaacaagttcggcatcaacagacccgccgtgctggcccccgaggacggcctggccatgagcctgcacttcatgaccctgggcggcagcagcctgagccccaccgagggcaagggcagcggcctgcagggccacatcatcgagaacccccagtacttcagcgacgcctgcgtgcaccacatcaagagaagagacatcgtgctgaagtgggagctgggcgagggcgccttcggcaaggtgttcctggccgagtgccacaacctgctgcccgagcaggacaagatgctggtggccgtgaaggccctgaaggaggccagcgagagcgccagacaggacttccagagagaggccgagctgctgaccatgctgcagcaccagcacatcgtgagattcttcggcgtgtgcaccgagggcagacccctgctgatggtgttcgagtacatgagacacggcgacctgaacagattcctgagaagccacggccccgacgccaagctgctggccggcggcgaggacgtggcccccggccccctgggcctgggccagctgctggccgtggccagccaggtggccgccggcatggtgtacctggccggcctgcacttcgtgcacagagacctggccaccagaaactgcctggtgggccagggcctggtggtgaagatcggcgacttcggcatgagcagagacatctacagcaccgactactacagagtgggcggcagaaccatgctgcccatcagatggatgccccccgagagcatcctgtacagaaagttcaccaccgagagcgacgtgtggagcttcggcgtggtgctgtgggagatcttcacctacggcaagcagccctggtaccagctgagcaacaccgaggccatcgactgcatcacccagggcagagagctggagagacccagagcctgcccccccgaggtgtacgccatcatgagaggctgctggcagagagagccccagcagagacacagcatcaaggacgtgcacgccagactgcaggccctggcccaggccccccccgtgtacctggacgtgctgggctag

SEQ ID NO: 90979 - DNA, 2391 bp, Artificial Sequence
  Description of Artificial Sequence: Synthetic coding sequence
atgctgagaggcggcagaagaggccagctgggctggcacagctgggccgccggccccggcagcctgctggcctggctgatcctggccagcgccggcgccgccccctgccccgacgcctgctgcccccacggcagcagcggcctgagatgcaccagagacggcgccctggacagcctgcaccacctgcccggcgccgagaacctgaccgagctgtacatcgagaaccagcagcacctgcagcacctggagctgagagacctgagaggcctgggcgagctgagaaacctgaccatcgtgaagagcggcctgagattcgtggcccccgacgccttccacttcacccccagactgagcagactgaacctgagcttcaacgccctggagagcctgagctggaagaccgtgcagggcctgagcctgcaggagctggtgctgagcggcaaccccctgcactgcagctgcgccctgagatggctgcagagatgggaggaggagggcctgggcggcgtgcccgagcagaagctgcagtgccacggccagggccccctggcccacatgcccaacgccagctgcggcgtgcccaccctgaaggtgcaggtgcccaacgccagcgtggacgtgggcgacgacgtgctgctgagatgccaggtggagggcagaggcctggagcaggccggctggatcctgaccgagctggagcagagcgccaccgtgatgaagagcggcggcctgcccagcctgggcctgaccctggccaacgtgaccagcgacctgaacagaaagaacgtgacctgctgggccgagaacgacgtgggcagagccgaggtgagcgtgcaggtgaacgtgagcttccccgccagcgtgcagctgcacaccgccgtggagatgcaccactggtgcatccccttcagcgtggacggccagcccgcccccagcctgagatggctgttcaacggcagcgtgctgaacgagaccagcttcatcttcaccgagttcctggagcccgccgccaacgagaccgtgagacacggctgcctgagactgaaccagcccacccacgtgaacaacggcaactacaccctgctggccgccaaccccttcggccaggccagcgccagcatcatggccgccttcatggacaaccccttcgagttcaaccccgaggaccccatccccgtgagcttcagccccgtggacaccaacagcaccagcggcgaccccgtggagaagaaggacgagacccccttcggcgtgagcgtggccgtgggcctggccgtgttcgcctgcctgttcctgagcaccctgctgctggtgctgaacaagtgcggcagaagaaacaagttcggcatcaacagacccgccgtgctggcccccgaggacggcctggccatgagcctgcacttcatgaccctgggcggcagcagcctgagccccaccgagggcaagggcagcggcctgcagggccacatcatcgagaacccccagtacttcagcgacgcctgcgtgcaccacatcaagagaagagacatcgtgctgaagtgggagctgggcgagggcgccttcggcaaggtgttcctggccgagtgccacaacctgctgcccgagcaggacaagatgctggtggccgtgaaggccctgaaggaggccagcgagagcgccagacaggacttccagagagaggccgagctgctgaccatgctgcagcaccagcacatcgtgagattcttcggcgtgtgcaccgagggcagacccctgctgatggtgttcgagtacatgagacacggcgacctgaacagattcctgagaagccacggccccgacgccaagctgctggccggcggcgaggacgtggcccccggccccctgggcctgggccagctgctggccgtggccagccaggtggccgccggcatggtgtacctggccggcctgcacttcgtgcacagagacctggccaccagaaactgcctggtgggccagggcctggtggtgaagatcggcgacttcggcatgagcagagacatctacagcaccgactactacagagtgggcggcagaaccatgctgcccatcagatggatgccccccgagagcatcctgtacagaaagttcaccaccgagagcgacgtgtggagcttcggcgtggtgctgtgggagatcttcacctacggcaagcagccctggtaccagctgagcaacaccgaggccatcgactgcatcacccagggcagagagctggagagacccagagcctgcccccccgaggtgtacgccatcatgagaggctgctggcagagagagccccagcagagacacagcatcaaggacgtgcacgccagactgcaggccctggcccaggccccccccgtgtacctggacgtgctgggctag

SEQ ID NO: 90980 - DNA, 2517 bp, Artificial Sequence
  Description of Artificial Sequence: Synthetic coding sequence
atgagcagctggatcagatggcacggccccgccatggccagactgtggggcttctgctggctggtggtgggcttctggagagccgccttcgcctgccccaccagctgcaagtgcagcgccagcagaatctggtgcagcgaccccagccccggcatcgtggccttccccagactggagcccaacagcgtggaccccgagaacatcaccgagatcttcatcgccaaccagaagagactggagatcatcaacgaggacgacgtggaggcctacgtgggcctgagaaacctgaccatcgtggacagcggcctgaagttcgtggcccacaaggccttcctgaagaacagcaacctgcagcacatcaacttcaccagaaacaagctgaccagcctgagcagaaagcacttcagacacctggacctgagcgagctgatcctggtgggcaaccccttcacctgcagctgcgacatcatgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaaggacttcagctggttcggcttcggcaaggtgaagagcagacagggcgtgggccccgccagcgtgatcagcaacgacgacgacagcgccagccccctgcaccacatcagcaacggcagcaacacccccagcagcagcgagggcggccccgacgccgtgatcatcggcatgaccaagatccccgtgatcgagaacccccagtacttcggcatcaccaacagccagctgaagcccgacaccttcgtgcagcacatcaagagacacaacatcgtgctgaagagagagctgggcgagggcgccttcggcaaggtgttcctggccgagtgctacaacctgtgccccgagcaggacaagatcctggtggccgtgaagaccctgaaggacgccagcgacaacgccagaaaggacttccacagagaggccgagctgctgaccaacctgcagcacgagcacatcgtgaagttctacggcgtgtgcgtggagggcgaccccctgatcatggtgttcgagtacatgaagcacggcgacctgaacaagttcctgagagcccacggccccgacgccgtgctgatggccgagggcaacccccccaccgagctgacccagagccagatgctgcacatcgcccagcagatcgccgccggcatggtgtacctggccagccagcacttcgtgcacagagacctggccaccagaaactgcctggtgggcgagaacctgctggtgaagatcggcgacttcggcatgagcagagacgtgtacagcaccgactactacagagtgggcggccacaccatgctgcccatcagatggatgccccccgagagcatcatgtacagaaagttcaccaccgagagcgacgtgtggagcctgggcgtggtgctgtgggagatcttcacctacggcaagcagccctggtaccagctgagcaacaacgaggtgatcgagtgcatcacccagggcagagtgctgcagagacccagaacctgcccccaggaggtgtacgagctgatgctgggctgctggcagagagagccccacatgagaaagaacatcaagggcatccacaccctgctgcagaacctggccaaggccagccccgtgtacctggacatcctgggctag

SEQ ID NO: 90981 - DNA, 1662 bp, Artificial Sequence
  Description of Artificial Sequence: Synthetic coding sequence
atgagcagctggatcagatggcacggccccgccatggccagactgtggggcttctgctggctggtggtgggcttctggagagccgccttcgcctgccccaccagctgcaagtgcagcgccagcagaatctggtgcagcgaccccagccccggcatcgtggccttccccagactggagcccaacagcgtggaccccgagaacatcaccgagatcttcatcgccaaccagaagagactggagatcatcaacgaggacgacgtggaggcctacgtgggcctgagaaacctgaccatcgtggacagcggcctgaagttcgtggcccacaaggccttcctgaagaacagcaacctgcagcacatcaacttcaccagaaacaagctgaccagcctgagcagaaagcacttcagacacctggacctgagcgagctgatcctggtgggcaaccccttcacctgcagctgcgacatcatgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaaggacttcagctggttcggcttcggcaaggtgaagagcagacagggcgtgggccccgccagcgtgatcagcaacgacgacgacagcgccagccccctgcaccacatcagcaacggcagcaacacccccagcagcagcgagggcggccccgacgccgtgatcatcggcatgaccaagatccccgtgatcgagaacccccagtacttcggcatcaccaacagccagctgaagcccgacacctggcccagaggcagccccaagaccgcctag

SEQ ID NO: 90982 - DNA, 2469 bp, Artificial Sequence
  Description of Artificial Sequence: Synthetic coding sequence
atgagcagctggatcagatggcacggccccgccatggccagactgtggggcttctgctggctggtggtgggcttctggagagccgccttcgcctgccccaccagctgcaagtgcagcgccagcagaatctggtgcagcgaccccagccccggcatcgtggccttccccagactggagcccaacagcgtggaccccgagaacatcaccgagatcttcatcgccaaccagaagagactggagatcatcaacgaggacgacgtggaggcctacgtgggcctgagaaacctgaccatcgtggacagcggcctgaagttcgtggcccacaaggccttcctgaagaacagcaacctgcagcacatcaacttcaccagaaacaagctgaccagcctgagcagaaagcacttcagacacctggacctgagcgagctgatcctggtgggcaaccccttcacctgcagctgcgacatcatgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaagggccccgccagcgtgatcagcaacgacgacgacagcgccagccccctgcaccacatcagcaacggcagcaacacccccagcagcagcgagggcggccccgacgccgtgatcatcggcatgaccaagatccccgtgatcgagaacccccagtacttcggcatcaccaacagccagctgaagcccgacaccttcgtgcagcacatcaagagacacaacatcgtgctgaagagagagctgggcgagggcgccttcggcaaggtgttcctggccgagtgctacaacctgtgccccgagcaggacaagatcctggtggccgtgaagaccctgaaggacgccagcgacaacgccagaaaggacttccacagagaggccgagctgctgaccaacctgcagcacgagcacatcgtgaagttctacggcgtgtgcgtggagggcgaccccctgatcatggtgttcgagtacatgaagcacggcgacctgaacaagttcctgagagcccacggccccgacgccgtgctgatggccgagggcaacccccccaccgagctgacccagagccagatgctgcacatcgcccagcagatcgccgccggcatggtgtacctggccagccagcacttcgtgcacagagacctggccaccagaaactgcctggtgggcgagaacctgctggtgaagatcggcgacttcggcatgagcagagacgtgtacagcaccgactactacagagtgggcggccacaccatgctgcccatcagatggatgccccccgagagcatcatgtacagaaagttcaccaccgagagcgacgtgtggagcctgggcgtggtgctgtgggagatcttcacctacggcaagcagccctggtaccagctgagcaacaacgaggtgatcgagtgcatcacccagggcagagtgctgcagagacccagaacctgcccccaggaggtgtacgagctgatgctgggctgctggcagagagagccccacatgagaaagaacatcaagggcatccacaccctgctgcagaacctggccaaggccagccccgtgtacctggacatcctgggctag

SEQ ID NO: 90983 - DNA, 1434 bp, Artificial Sequence
  Description of Artificial Sequence: Synthetic coding sequence
atgagcagctggatcagatggcacggccccgccatggccagactgtggggcttctgctggctggtggtgggcttctggagagccgccttcgcctgccccaccagctgcaagtgcagcgccagcagaatctggtgcagcgaccccagccccggcatcgtggccttccccagactggagcccaacagcgtggaccccgagaacatcaccgagatcttcatcgccaaccagaagagactggagatcatcaacgaggacgacgtggaggcctacgtgggcctgagaaacctgaccatcgtggacagcggcctgaagttcgtggcccacaaggccttcctgaagaacagcaacctgcagcacatcaacttcaccagaaacaagctgaccagcctgagcagaaagcacttcagacacctggacctgagcgagctgatcctggtgggcaaccccttcacctgcagctgcgacatcatgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaagggcttcgtgctgttccacaagatccccctggacggctag

SEQ ID NO: 90984 - DNA, 1614 bp, Artificial Sequence
  Description of Artificial Sequence: Synthetic coding sequence
atgagcagctggatcagatggcacggccccgccatggccagactgtggggcttctgctggctggtggtgggcttctggagagccgccttcgcctgccccaccagctgcaagtgcagcgccagcagaatctggtgcagcgaccccagccccggcatcgtggccttccccagactggagcccaacagcgtggaccccgagaacatcaccgagatcttcatcgccaaccagaagagactggagatcatcaacgaggacgacgtggaggcctacgtgggcctgagaaacctgaccatcgtggacagcggcctgaagttcgtggcccacaaggccttcctgaagaacagcaacctgcagcacatcaacttcaccagaaacaagctgaccagcctgagcagaaagcacttcagacacctggacctgagcgagctgatcctggtgggcaaccccttcacctgcagctgcgacatcatgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaagggccccgccagcgtgatcagcaacgacgacgacagcgccagccccctgcaccacatcagcaacggcagcaacacccccagcagcagcgagggcggccccgacgccgtgatcatcggcatgaccaagatccccgtgatcgagaacccccagtacttcggcatcaccaacagccagctgaagcccgacacctggcccagaggcagccccaagaccgcctag

SEQ ID NO: 90985 - DNA, 2469 bp, Artificial Sequence; identical to SEQ ID NO: 90982
  Description of Artificial Sequence: Synthetic coding sequence

SEQ ID NO: 90986 - DNA, 2517 bp, Artificial Sequence; identical to SEQ ID NO: 90980
  Description of Artificial Sequence: Synthetic coding sequence

SEQ ID NO: 90987 - DNA, 966 bp, Artificial Sequence
  Description of Artificial Sequence: Synthetic coding sequence
atgtggatcaagaccctgcaggaggccaagagcagccccgacacccaggacctgtactgcctgaacgagagcagcaagaacatccccctggccaacctgcagatccccaactgcggcctgcccagcgccaacctggccgcccccaacctgaccgtggaggagggcaagagcatcaccctgagctgcagcgtggccggcgaccccgtgcccaacatgtactgggacgtgggcaacctggtgagcaagcacatgaacgagaccagccacacccagggcagcctgagaatcaccaacatcagcagcgacgacagcggcaagcagatcagctgcgtggccgagaacctggtgggcgaggaccaggacagcgtgaacctgaccgtgcacttcgcccccaccatcaccttcctggagagccccaccagcgaccaccactggtgcatccccttcaccgtgaagggcaaccccaagcccgccctgcagtggttctacaacggcgccatcctgaacgagagcaagtacatctgcaccaagatccacgtgaccaaccacaccgagtaccacggctgcctgcagctggacaaccccacccacatgaacaacggcgactacaccctgatcgccaagaacgagtacggcaaggacgagaagcagatcagcgcccacttcatgggctggcccggcatcgacgacggcgccaaccccaactaccccgacgtgatctacgaggactacggcaccgccgccaacgacatcggcgacaccaccaacagaagcaacgagatccccagcaccgacgtgaccgacaagaccggcagagagcacctgagcgtgtacgccgtggtggtgatcgccagcgtggtgggcttctgcctgctggtgatgctgttcctgctgaagctggccagacacagcaagttcggcatgaagggcttcgtgctgttccacaagatccccctggacggctag

SEQ ID NO: 90988 - DNA, 1434 bp, Artificial Sequence; identical to SEQ ID NO: 90983
  Description of Artificial Sequence: Synthetic coding sequence

SEQ ID NO: 90989 - DNA, 1839 bp, Artificial Sequence
  Description of Artificial Sequence: Synthetic coding sequence
atggacgtgagcctgtgccccgccaagtgcagcttctggagaatcttcctgctgggcagcgtgtggctggactacgtgggcagcgtgctggcctgccccgccaactgcgtgtgcagcaagaccgagatcaactgcagaagacccgacgacggcaacctgttccccctgctggagggccaggacagcggcaacagcaacggcaacgccagcatcaacatcaccgacatcagcagaaacatcaccagcatccacatcgagaactggagaagcctgcacaccctgaacgccgtggacatggagctgtacaccggcctgcagaagctgaccatcaagaacagcggcctgagaagcatccagcccagagccttcgccaagaacccccacctgagatacatcaacctgagcagcaacagactgaccaccctgagctggcagctgttccagaccctgagcctgagagagctgcagctggagcagaacttcttcaactgcagctgcgacatcagatggatgcagctgtggcaggagcagggcgaggccaagctgaacagccagaacctgtactgcatcaacgccgacggcagccagctgcccctgttcagaatgaacatcagccagtgcgacctgcccgagatcagcgtgagccacgtgaacctgaccgtgagagagggcgacaacgccgtgatcacctgcaacggcagcggcagccccctgcccgacgtggactggatcgtgaccggcctgcagagcatcaacacccaccagaccaacctgaactggaccaacgtgcacgccatcaacctgaccctggtgaacgtgaccagcgaggacaacggcttcaccctgacctgcatcgccgagaacgtggtgggcatgagcaacgccagcgtggccctgaccgtgtactacccccccagagtggtgagcctggaggagcccgagctgagactggagcactgcatcgagttcgtggtgagaggcaaccccccccccaccctgcactggctgcacaacggccagcccctgagagagagcaagatcatccacgtggagtactaccaggagggcgagatcagcgagggctgcctgctgttcaacaagcccacccactacaacaacggcaactacaccctgatcgccaagaaccccctgggcaccgccaaccagaccatcaacggccacttcctgaaggagcccttccccgagagcaccgacaacttcatcctgttcgacgaggtgagccccaccccccccatcaccgtgacccacaagcccgaggaggacaccttcggcgtgagcatcgccgtgggcctggccgccttcgcctgcgtgctgctggtggtgctgttcgtgatgatcaacaagtacggcagaagaagcaagttcggcatgaagggccccgtggccgtgatcagcggcgaggaggacagcgccagccccctgcaccacatcaaccacggcatcaccacccccagcagcctggacgccggccccgacaccgtggtgatcggcatgaccagaatccccgtgatcgagaacccccagtacttcagacagggccacaactgccacaagcccgacacctgggtgttcagcaacatcgacaaccacggcatcctgaacctgaaggacaacagagaccacctggtgcccagcacccactacatctacgaggagcccgaggtgcagagcggcgaggtgagctaccccagaagccacggcttcagagagatcatgctgaaccccatcagcctgcccggccacagcaagcccctgaaccacggcatctacgtggaggacgtgaacgtgtacttcagcaagggcagacacggcttctag

SEQ ID NO: 90990 - DNA, 414 bp, Artificial Sequence
  Description of Artificial Sequence: Synthetic coding sequence
atgaccagaatccccgtgatcgagaacccccagtacttcagacagggccacaactgccacaagcccgacacctacgtgcagcacatcaagagaagagacatcgtgctgaagagagagctgggcgagggcgccttcggcaaggtgttcctggccgagtgctacaacctgagccccaccaaggacaagatgctggtggccgtgaaggccctgaaggaccccaccctggccgccagaaaggacttccagagagaggccgagctgctgaccaacctgcagcacgagcacatcgtgaagttctacggcgtgtgcggcgacggcgaccccctgatcatggtgttcgagtacatgaagcacggcgacctgaacaagttcctgagcagcatcagcagccccaagagccaccagcagggctag

SEQ ID NO: 90991 - DNA, 2478 bp, Artificial Sequence
  Description of Artificial Sequence: Synthetic coding sequence
atggacgtgagcctgtgccccgccaagtgcagcttctggagaatcttcctgctgggcagcgtgtggctggactacgtgggcagcgtgctggcctgccccgccaactgcgtgtgcagcaagaccgagatcaactgcagaagacccgacgacggcaacctgttccccctgctggagggccaggacagcggcaacagcaacggcaacgccagcatcaacatcaccgacatcagcagaaacatcaccagcatccacatcgagaactggagaagcctgcacaccctgaacgccgtggacatggagctgtacaccggcctgcagaagctgaccatcaagaacagcggcctgagaagcatccagcccagagccttcgccaagaacccccacctgagatacatcaacctgagcagcaacagactgaccaccctgagctggcagctgttccagaccctgagcctgagagagctgcagctggagcagaacttcttcaactgcagctgcgacatcagatggatgcagctgtggcaggagcagggcgaggccaagctgaacagccagaacctgtactgcatcaacgccgacggcagccagctgcccctgttcagaatgaacatcagccagtgcgacctgcccgagatcagcgtgagccacgtgaacctgaccgtgagagagggcgacaacgccgtgatcacctgcaacggcagcggcagccccctgcccgacgtggactggatcgtgaccggcctgcagagcatcaacacccaccagaccaacctgaactggaccaacgtgcacgccatcaacctgaccctggtgaacgtgaccagcgaggacaacggcttcaccctgacctgcatcgccgagaacgtggtgggcatgagcaacgccagcgtggccctgaccgtgtactacccccccagagtggtgagcctggaggagcccgagctgagactggagcactgcatcgagttcgtggtgagaggcaaccccccccccaccctgcactggctgcacaacggccagcccctgagagagagcaagatcatccacgtggagtactaccaggagggcgagatcagcgagggctgcctgctgttcaacaagcccacccactacaacaacggcaactacaccctgatcgccaagaaccccctgggcaccgccaaccagaccatcaacggccacttcctgaaggagcccttccccgagagcaccgacaacttcatcctgttcgacgaggtgagccccaccccccccatcaccgtgacccacaagcccgaggaggacaccttcggcgtgagcatcgccgtgggcctggccgccttcgcctgcgtgctgctggtggtgctgttcgtgatgatcaacaagtacggcagaagaagcaagttcggcatgaagggccccgtggccgtgatcagcggcgaggaggacagcgccagccccctgcaccacatcaaccacggcatcaccacccccagcagcctggacgccggccccgacaccgtggtgatcggcatgaccagaatccccgtgatcgagaacccccagtacttcagacagggccacaactgccacaagcccgacacctacgtgcagcacatcaagagaagagacatcgtgctgaagagagagctgggcgagggcgccttcggcaaggtgttcctggccgagtgctacaacctgagccccaccaaggacaagatgctggtggccgtgaaggccctgaaggaccccaccctggccgccagaaaggacttccagagagaggccgagctgctgaccaacctgcagcacgagcacatcgtgaagttctacggcgtgtgcggcgacggcgaccccctgatcatggtgttcgagtacatgaagcacggcgacctgaacaagttcctgagagcccacggccccgacgccatgatcctggtggacggccagcccagacaggccaagggcgagctgggcctgagccagatgctgcacatcgccagccagatcgccagcggcatggtgtacctggccagccagcacttcgtgcacagagacctggccaccagaaactgcctggtgggcgccaacctgctggtgaagatcggcgacttcggcatgagcagagacgtgtacagcaccgactactacagagtgggcggccacaccatgctgcccatcagatggatgccccccgagagcatcatgtacagaaagttcaccaccgagagcgacgtgtggagcttcggcgtgatcctgtgggagatcttcacctacggcaagcagccctggttccagctgagcaacaccgaggtgatcgagtgcatcacccagggcagagtgctggagagacccagagtgtgccccaaggaggtgtacgacgtgatgctgggctgctggcagagagagccccagcagagactgaacatcaaggagatctacaagatcctgcacgccctgggcaaggccacccccatctacctggacatcctgggctag

SEQ ID NO: 90992 - DNA, 2496 bp, Artificial Sequence
  Description of Artificial Sequence: Synthetic coding sequence
atggacgtgagcctgtgccccgccaagtgcagcttctggagaatcttcctgctgggcagcgtgtggctggactacgtgggcagcgtgctggcctgccccgccaactgcgtgtgcagcaagaccgagatcaactgcagaagacccgacgacggcaacctgttccccctgctggagggccaggacagcggcaacagcaacggcaacgccagcatcaacatcaccgacatcagcagaaacatcaccagcatccacatcgagaactggagaagcctgcacaccctgaacgccgtggacatggagctgtacaccggcctgcagaagctgaccatcaagaacagcggcctgagaagcatccagcccagagccttcgccaagaacccccacctgagatacatcaacctgagcagcaacagactgaccaccctgagctggcagctgttccagaccctgagcctgagagagctgcagctggagcagaacttcttcaactgcagctgcgacatcagatggatgcagctgtggcaggagcagggcgaggccaagctgaacagccagaacctgtactgcatcaacgccgacggcagccagctgcccctgttcagaatgaacatcagccagtgcgacctgcccgagatcagcgtgagccacgtgaacctgaccgtgagagagggcgacaacgccgtgatcacctgcaacggcagcggcagccccctgcccgacgtggactggatcgtgaccggcctgcagagcatcaacacccaccagaccaacctgaactggaccaacgtgcacgccatcaacctgaccctggtgaacgtgaccagcgaggacaacggcttcaccctgacctgcatcgccgagaacgtggtgggcatgagcaacgccagcgtggccctgaccgtgtactacccccccagagtggtgagcctggaggagcccgagctgagactggagcactgcatcgagttcgtggtgagaggcaaccccccccccaccctgcactggctgcacaacggccagcccctgagagagagcaagatcatccacgtggagtactaccaggagggcgagatcagcgagggctgcctgctgttcaacaagcccacccactacaacaacggcaactacaccctgatcgccaagaaccccctgggcaccgccaaccagaccatcaacggccacttcctgaaggagcccttccccgtggacgaggtgagccccaccccccccatcaccgtgacccacaagcccgaggaggacaccttcggcgtgagcatcgccgtgggcctggccgccttcgcctgcgtgctgctggtggtgctgttcgtgatgatcaacaagtacggcagaagaagcaagttcggcatgaagggccccgtggccgtgatcagcggcgaggaggacagcgccagccccctgcaccacatcaaccacggcatcaccacccccagcagcctggacgccggccccgacaccgtggtgatcggcatgaccagaatccccgtgatcgagaacccccagtacttcagacagggccacaactgccacaagcccgacacctacgtgcagcacatcaagagaagagacatcgtgctgaagagagagctgggcgagggcgccttcggcaaggtgttcctggccgagtgctacaacctgagccccaccaaggacaagatgctggtggccgtgaaggccctgaaggaccccaccctggccgccagaaaggacttccagagagaggccgagctgctgaccaacctgcagcacgagcacatcgtgaagttctacggcgtgtgcggcgacggcgaccccctgatcatggtgttcgagtacatgaagcacggcgacctgaacaagttcctgagagcccacggccccgacgccatgatcctggtggacggccagcccagacaggccaagggcgagctgggcctgagccagatgctgcacatcgccagccagatcgccagcggcatggtgtacctggccagccagcacttcgtgcacagagacctggccaccagaaactgcctggtgggcgccaacctgctggtgaagatcggcgacttcggcatgagcagagacgtgtacagcaccgactactacagactgttcaaccccagcggcaacgacttctgcatctggtgcgaggtgggcggccacaccatgctgcccatcagatggatgccccccgagagcatcatgtacagaaagttcaccaccgagagcgacgtgtggagcttcggcgtgatcctgtgggagatcttcacctacggcaagcagccctggttccagctgagcaacaccgaggtgatcgagtgcatcacccagggcagagtgctggagagacccagagtgtgccccaaggaggtgtacgacgtgatgctgggctgctggcagagagagccccagcagagactgaacatcaaggagatctacaagatcctgcacgccctgggcaaggccacccccatctacctggacatcctgggctag

SEQ ID NO: 90993 - DNA, 2520 bp, Artificial Sequence
  Description of Artificial Sequence: Synthetic coding sequence
atggacgtgagcctgtgccccgccaagtgcagcttctggagaatcttcctgctgggcagcgtgtggctggactacgtgggcagcgtgctggcctgccccgccaactgcgtgtgcagcaagaccgagatcaactgcagaagacccgacgacggcaacctgttccccctgctggagggccaggacagcggcaacagcaacggcaacgccagcatcaacatcaccgacatcagcagaaacatcaccagcatccacatcgagaactggagaagcctgcacaccctgaacgccgtggacatggagctgtacaccggcctgcagaagctgaccatcaagaacagcggcctgagaagcatccagcccagagccttcgccaagaacccccacctgagatacatcaacctgagcagcaacagactgaccaccctgagctggcagctgttccagaccctgagcctgagagagctgcagctggagcagaacttcttcaactgcagctgcgacatcagatggatgcagctgtggcaggagcagggcgaggccaagctgaacagccagaacctgtactgcatcaacgccgacggcagccagctgcccctgttcagaatgaacatcagccagtgcgacctgcccgagatcagcgtgagccacgtgaacctgaccgtgagagagggcgacaacgccgtgatcacctgcaacggcagcggcagccccctgcccgacgtggactggatcgtgaccggcctgcagagcatcaacacccaccagaccaacctgaactggaccaacgtgcacgccatcaacctgaccctggtgaacgtgaccagcgaggacaacggcttcaccctgacctgcatcgccgagaacgtggtgggcatgagcaacgccagcgtggccctgaccgtgtactacccccccagagtggtgagcctggaggagcccgagctgagactggagcactgcatcgagttcgtggtgagaggcaaccccccccccaccctgcactggctgcacaacggccagcccctgagagagagcaagatcatccacgtggagtactaccaggagggcgagatcagcgagggctgcctgctgttcaacaagcccacccactacaacaacggcaactacaccctgatcgccaagaaccccctgggcaccgccaaccagaccatcaacggccacttcctgaaggagcccttccccgagagcaccgacaacttcatcctgttcgacgaggtgagccccaccccccccatcaccgtgacccacaagcccgaggaggacaccttcggcgtgagcatcgccgtgggcctggccgccttcgcctgcgtgctgctggtggtgctgttcgtgatgatcaacaagtacggcagaagaagcaagttcggcatgaagggccccgtggccgtgatcagcggcgaggaggacagcgccagccccctgcaccacatcaaccacggcatcaccacccccagcagcctggacgccggccccgacaccgtggtgatcggcatgaccagaatccccgtgatcgagaacccccagtacttcagacagggccacaactgccacaagcccgacacctacgtgcagcacatcaagagaagagacatcgtgctgaagagagagctgggcgagggcgccttcggcaaggtgttcctggccgagtgctacaacctgagccccaccaaggacaagatgctggtggccgtgaaggccctgaaggaccccaccctggccgccagaaaggacttccagagagaggccgagctgctgaccaacctgcagcacgagcacatcgtgaagttctacggcgtgtgcggcgacggcgaccccctgatcatggtgttcgagtacatgaagcacggcgacctgaacaagttcctgagagcccacggccccgacgccatgatcctggtggacggccagcccagacaggccaagggcgagctgggcctgagccagatgctgcacatcgccagccagatcgccagcggcatggtgtacctggccagccagcacttcgtgcacagagacctggccaccagaaactgcctggtgggcgccaacctgctggtgaagatcggcgacttcggcatgagcagagacgtgtacagcaccgactactacagactgttcaaccccagcggcaacgacttctgcatctggtgcgaggtgggcggccacaccatgctgcccatcagatggatgccccccgagagcatcatgtacagaaagttcaccaccgagagcgacgtgtggagcttcggcgtgatcctgtgggagatcttcacctacggcaagcagccctggttccagctgagcaacaccgaggtgatcgagtgcatcacccagggcagagtgctggagagacccagagtgtgccccaaggaggtgtacgacgtgatgctgggctgctggcagagagagccccagcagagactgaacatcaaggagatctacaagatcctgcacgccctgggcaaggccacccccatctacctggacatcctgggctag

SEQ ID NO: 90994 - DNA, 2478 bp, Artificial Sequence; identical to SEQ ID NO: 90991
  Description of Artificial Sequence: Synthetic coding sequence

SEQ ID NO: 90995 - DNA, 1839 bp, Artificial Sequence; identical to SEQ ID NO: 90989
  Description of Artificial Sequence: Synthetic coding sequence

SEQ ID NO: 90996 - DNA, 1854 bp, Artificial Sequence
  Description of Artificial Sequence: Synthetic coding sequence
atggagctgtacaccggcctgcagaagctgaccatcaagaacagcggcctgagaagcatccagcccagagccttcgccaagaacccccacctgagatacatcaacctgagcagcaacagactgaccaccctgagctggcagctgttccagaccctgagcctgagagagctgcagctggagcagaacttcttcaactgcagctgcgacatcagatggatgcagctgtggcaggagcagggcgaggccaagctgaacagccagaacctgtactgcatcaacgccgacggcagccagctgcccctgttcagaatgaacatcagccagtgcgacctgcccgagatcagcgtgagccacgtgaacctgaccgtgagagagggcgacaacgccgtgatcacctgcaacggcagcggcagccccctgcccgacgtggactggatcgtgaccggcctgcagagcatcaacacccaccagaccaacctgaactggaccaacgtgcacgccatcaacctgaccctggtgaacgtgaccagcgaggacaacggcttcaccctgacctgcatcgccgagaacgtggtgggcatgagcaacgccagcgtggccctgaccgtgtactacccccccagagtggtgagcctggaggagcccgagctgagactggagcactgcatcgagttcgtggtgagaggcaaccccccccccaccctgcactggctgcacaacggccagcccctgagagagagcaagatcatccacgtggagtactaccaggagggcgagatcagcgagggctgcctgctgttcaacaagcccacccactacaacaacggcaactacaccctgatcgccaagaaccccctgggcaccgccaaccagaccatcaacggccacttcctgaaggagcccttccccgagagcaccgacaacttcatcctgttcgacgaggtgagccccaccccccccatcaccgtgacccacaagcccgaggaggacaccttcggcgtgagcatcgccgtgggcctggccgccttcgcctgcgtgctgctggtggtgctgttcgtgatgatcaacaagtacggcagaagaagcaagttcggcatgaagggccccgtggccgtgatcagcggcgaggaggacagcgccagccccctgcaccacatcaaccacggcatcaccacccccagcagcctggacgccggccccgacaccgtggtgatcggcatgaccagaatccccgtgatcgagaacccccagtacttcagacagggccacaactgccacaagcccgacacctacgtgcagcacatcaagagaagagacatcgtgctgaagagagagctgggcgagggcgccttcggcaaggtgttcctggccgagtgctacaacctgagccccaccaaggacaagatgctggtggccgtgaaggccctgaaggaccccaccctggccgccagaaaggacttccagagagaggccgagctgctgaccaacctgcagcacgagcacatcgtgaagttctacggcgtgtgcggcgacggcgaccccctgatcatggtgttcgagtacatgaagcacggcgacctgaacaagttcctgagagcccacggccccgacgccatgatcctggtggacggccagcccagacaggccaagggcgagctgggcctgagccagatgctgcacatcgccagccagatcgccagcggcatggtgtacctggccagccagcacttcgtgcacagagacctggccaccagaaactgcctggtgggcgccaacctgctggtgaagatcggcgacttcggcatgagcagagacgtgtacagcaccgactactacagagtggtgcaggcctag

SEQ ID NO: 90997 - DNA, 774 bp, Artificial Sequence
  Description of Artificial Sequence: Synthetic coding sequence
atgagcatcctgttctacgtgatcttcctggcctacctgagaggcatccagggcaacaacatggaccagagaagcctgcccgaggacagcctgaacagcctgatcatcaagctgatccaggccgacatcctgaagaacaagctgagcaagcagatggtggacgtgaaggagaactaccagagcaccctgcccaaggccgaggcccccagagagcccgagagaggcggccccgccaagagcgccttccagcccgtgatcgccatggacaccgagctgctgagacagcagagaagatacaacagccccagagtgctgctgagcgacagcacccccctggagcccccccccctgtacctgatggaggactacgtgggcagccccgtggtggccaacagaaccagcagaagaaagagatacgccgagcacaagagccacagaggcgagtacagcgtgtgcgacagcgagagcctgtgggtgaccgacaagagcagcgccatcgacatcagaggccaccaggtgaccgtgctgggcgagatcaagaccggcaacagccccgtgaagcagtacttctacgagaccagatgcaaggaggccagacccgtgaagaacggctgcagaggcatcgacgacaagcactggaacagccagtgcaagaccagccagacctacgtgagagccctgaccagcgagaacaacaagctggtgggctggagatggatcagaatcgacaccagctgcgtgtgcgccctgagcagaaagatcggcagaacctag

SEQ ID NO: 90998 - DNA, 813 bp, Artificial Sequence
  Description of Artificial Sequence: Synthetic coding sequence
atggtgaccttcgccaccatcctgcaggtgaacaaggtgatgagcatcctgttctacgtgatcttcctggcctacctgagaggcatccagggcaacaacatggaccagagaagcctgcccgaggacagcctgaacagcctgatcatcaagctgatccaggccgacatcctgaagaacaagctgagcaagcagatggtggacgtgaaggagaactaccagagcaccctgcccaaggccgaggcccccagagagcccgagagaggcggccccgccaagagcgccttccagcccgtgatcgccatggacaccgagctgctgagacagcagagaagatacaacagccccagagtgctgctgagcgacagcacccccctggagcccccccccctgtacctgatggaggactacgtgggcagccccgtggtggccaacagaaccagcagaagaaagagatacgccgagcacaagagccacagaggcgagtacagcgtgtgcgacagcgagagcctgtgggtgaccgacaagagcagcgccatcgacatcagaggccaccaggtgaccgtgctgggcgagatcaagaccggcaacagccccgtgaagcagtacttctacgagaccagatgcaaggaggccagacccgtgaagaacggctgcagaggcatcgacgacaagcactggaacagccagtgcaagaccagccagacctacgtgagagccctgaccagcgagaacaacaagctggtgggctggagatggatcagaatcgacaccagctgcgtgtgcgccctgagcagaaagatcggcagaacctag

SEQ ID NO: 90999 - DNA, 633 bp, Artificial Sequence
  Description of Artificial Sequence: Synthetic coding sequence
atgctgcccctgcccagctgcagcctgcccatcctgctgctgttcctgctgcccagcgtgcccatcgagagccagcccccccccagcaccctgccccccttcctggcccccgagtgggacctgctgagccccagagtggtgctgagcagaggcgcccccgccggcccccccctgctgttcctgctggaggccggcgccttcagagagagcgccggcgcccccgccaacagaagcagaagaggcgtgagcgagaccgcccccgccagcagaagaggcgagctggccgtgtgcgacgccgtgagcggctgggtgaccgacagaagaaccgccgtggacctgagaggcagagaggtggaggtgctgggcgaggtgcccgccgccggcggcagccccctgagacagtacttcttcgagaccagatgcaaggccgacaacgccgaggagggcggccccggcgccggcggcggcggctgcagaggcgtggacagaagacactgggtgagcgagtgcaaggccaagcagagctacgtgagagccctgaccgccgacgcccagggcagagtgggctggagatggatcagaatcgacaccgcctgcgtgtgcaccctgctgagcagaaccggcagagcctag

SEQ ID NO: 91000 - DNA, 594 bp, Artificial Sequence
  Description of Artificial Sequence: Synthetic coding sequence
atgcagagatggaaggccgccgccctggccagcgtgctgtgcagcagcgtgctgagcatctggatgtgcagagagggcctgctgctgagccacagactgggccccgccctggtgcccctgcacagactgcccagaaccctggacgccagaatcgccagactggcccagtacagagccctgctgcagggcgcccccgacgccatggagctgagagagctgaccccctgggccggcagaccccccggccccagaagaagagccggccccagaagaagaagagccagagccagactgggcgccagaccctgcggcctgagagagctggaggtgagagtgagcgagctgggcctgggctacgccagcgacgagaccgtgctgttcagatactgcgccggcgcctgcgaggccgccgccagagtgtacgacctgggcctgagaagactgagacagagaagaagactgagaagagagagagtgagagcccagccctgctgcagacccaccgcctacgaggacgaggtgagcttcctggacgcccacagcagataccacaccgtgcacgagctgagcgccagagagtgcgcctgcgtgtag

SEQ ID NO: 91001 - DNA, 1323 bp, Artificial Sequence
  Description of Artificial Sequence: Synthetic coding sequence
atgagcagctgcagaggccagaaggtggccggcggcctgagagtggtgagccccttccccctgtgccagcccgccggcgagcccagccagggcaagatgagaagcagctgcgtgctgctgaccgccctggtggccctggccgcctactacgtgtacatccccctgcccggcagcgtgagcgacccctggaagctgatgctgctggacgccaccttcagaggcgcccagcaggtgagcaacctgatccactacctgggcctgagccaccacctgctggccctgaacttcatcatcgtgagcttcggcaagaagagcgcctggagcagcgcccaggtgaaggtgaccgacaccgacttcgacggcgtggaggtgagagtgttcgagggcccccccaagcccgaggagcccctgaagagaagcgtggtgtacatccacggcggcggctgggccctggccagcgccaagatcagatactacgacgagctgtgcaccgccatggccgaggagctgaacgccgtgatcgtgagcatcgagtacagactggtgcccaaggtgtacttccccgagcagatccacgacgtggtgagagccaccaagtacttcctgaagcccgaggtgctgcagaagtacatggtggaccccggcagaatctgcatcagcggcgacagcgccggcggcaacctggccgccgccctgggccagcagttcacccaggacgccagcctgaagaacaagctgaagctgcaggccctgatctaccccgtgctgcaggccctggacttcaacacccccagctaccagcagaacgtgaacacccccatcctgcccagatacgtgatggtgaagtactgggtggactacttcaagggcaactacgacttcgtgcaggccatgatcgtgaacaaccacaccagcctggacgtggaggaggccgccgccgtgagagccagactgaactggaccagcctgctgcccgccagcttcaccaagaactacaagcccgtggtgcagaccaccggcaacgccagaatcgtgcaggagctgccccagctgctggacgccagaagcgcccccctgatcgccgaccaggccgtgctgcagctgctgcccaagacctacatcctgacctgcgagcacgacgtgctgagagacgacggcatcatgtacgccaagagactggagagcgccggcgtggaggtgaccctggaccacttcgaggacggcttccacggctgcatgatcttcaccagctggcccaccaacttcagcgtgggcatcagaaccagaaacagctacatcaagtggctggaccagaacctgtag

SEQ ID NO: 91002 - DNA, 1227 bp, Artificial Sequence
  Description of Artificial Sequence: Synthetic coding sequence
atgagaagcagctgcgtgctgctgaccgccctggtggccctggccgcctactacgtgtacatccccctgcccggcagcgtgagcgacccctggaagctgatgctgctggacgccaccttcagaggcgcccagcaggtgagcaacctgatccactacctgggcctgagccaccacctgctggccctgaacttcatcatcgtgagcttcggcaagaagagcgcctggagcagcgcccaggtgaaggtgaccgacaccgacttcgacggcgtggaggtgagagtgttcgagggcccccccaagcccgaggagcccctgaagagaagcgtggtgtacatccacggcggcggctgggccctggccagcgccaagatcagatactacgacgagctgtgcaccgccatggccgaggagctgaacgccgtgatcgtgagcatcgagtacagactggtgcccaaggtgtacttccccgagcagatccacgacgtggtgagagccaccaagtacttcctgaagcccgaggtgctgcagaagtacatggtggaccccggcagaatctgcatcagcggcgacagcgccggcggcaacctggccgccgccctgggccagcagttcacccaggacgccagcctgaagaacaagctgaagctgcaggccctgatctaccccgtgctgcaggccctggacttcaacacccccagctaccagcagaacgtgaacacccccatcctgcccagatacgtgatggtgaagtactgggtggactacttcaagggcaactacgacttcgtgcaggccatgatcgtgaacaaccacaccagcctggacgtggaggaggccgccgccgtgagagccagactgaactggaccagcctgctgcccgccagcttcaccaagaactacaagcccgtggtgcagaccaccggcaacgccagaatcgtgcaggagctgccccagctgctggacgccagaagcgcccccctgatcgccgaccaggccgtgctgcagctgctgcccaagacctacatcctgacctgcgagcacgacgtgctgagagacgacggcatcatgtacgccaagagactggagagcgccggcgtggaggtgaccctggaccacttcgaggacggcttccacggctgcatgatcttcaccagctggcccaccaacttcagcgtgggcatcagaaccagaaacagctacatcaagtggctggaccagaacctgtag

SEQ ID NO: 91003 - DNA, 1347 bp, Artificial Sequence
  Description of Artificial Sequence: Synthetic coding sequence
atgagcagctgcagaggccagaaggtggccggcggcctgagagtggtgagccccttccccctgtgccagcccgccggcgagcccagccagggcaagatgagaagcagctgcgtgctgctgaccgccctggtggccctggccgcctactacgtgtacatccccctgcccggcagcgtgagcgacccctggaagctgatgctgctggacgccaccttcagaggcgcccagcaggtgagcaacctgatccactacctgggcctgagccaccacctgctggccctgaacttcatcatcgtgagcttcggcaagaagagcgcctggagcagcgcccaggtgaaggtgaccgacaccgacttcgacggcgtggaggtgagagtgttcgagggcccccccaagcccgaggagcccctgaagagaagcgtggtgtacatccacggcggcggctgggccctggccagcgccagcgccagctggagccccagcgacgagatcagatactacgacgagctgtgcaccgccatggccgaggagctgaacgccgtgatcgtgagcatcgagtacagactggtgcccaaggtgtacttccccgagcagatccacgacgtggtgagagccaccaagtacttcctgaagcccgaggtgctgcagaagtacatggtggaccccggcagaatctgcatcagcggcgacagcgccggcggcaacctggccgccgccctgggccagcagttcacccaggacgccagcctgaagaacaagctgaagctgcaggccctgatctaccccgtgctgcaggccctggacttcaacacccccagctaccagcagaacgtgaacacccccatcctgcccagatacgtgatggtgaagtactgggtggactacttcaagggcaactacgacttcgtgcaggccatgatcgtgaacaaccacaccagcctggacgtggaggaggccgccgccgtgagagccagactgaactggaccagcctgctgcccgccagcttcaccaagaactacaagcccgtggtgcagaccaccggcaacgccagaatcgtgcaggagctgccccagctgctggacgccagaagcgcccccctgatcgccgaccaggccgtgctgcagctgctgcccaagacctacatcctgacctgcgagcacgacgtgctgagagacgacggcatcatgtacgccaagagactggagagcgccggcgtggaggtgaccctggaccacttcgaggacggcttccacggctgcatgatcttcaccagctggcccaccaacttcagcgtgggcatcagaaccagaaacagctacatcaagtggctggaccagaacctgtag

SEQ ID NO: 91004 - DNA, 828 bp, Artificial Sequence
  Description of Artificial Sequence: Synthetic coding sequence
atggccgaggagctgaacgccgtgatcgtgagcatcgagtacagactggtgcccaaggtgtacttccccgagcagatccacgacgtggtgagagccaccaagtacttcctgaagcccgaggtgctgcagaagtacatggtggaccccggcagaatctgcatcagcggcgacagcgccggcggcaacctggccgccgccctgggccagcagttcacccaggacgccagcctgaagaacaagctgaagctgcaggccctgatctaccccgtgctgcaggccctggacttcaacacccccagctaccagcagaacgtgaacacccccatcctgcccagatacgtgatggtgaagtactgggtggactacttcaagggcaactacgacttcgtgcaggccatgatcgtgaacaaccacaccagcctggacgtggaggaggccgccgccgtgagagccagactgaactggaccagcctgctgcccgccagcttcaccaagaactacaagcccgtggtgcagaccaccggcaacgccagaatcgtgcaggagctgccccagctgctggacgccagaagcgcccccctgatcgccgaccaggccgtgctgcagctgctgcccaagacctacatcctgacctgcgagcacgacgtgctgagagacgacggcatcatgtacgccaagagactggagagcgccggcgtggaggtgaccctggaccacttcgaggacggcttccacggctgcatgatcttcaccagctggcccaccaacttcagcgtgggcatcagaaccagaaacagctacatcaagtggctggaccagaacctgtag

SEQ ID NO: 91005 - DNA, 2754 bp, Artificial Sequence
  Description of Artificial Sequence: Synthetic coding sequence
atggccttcatcagaaagaagcagcaggagcagcagctgcagctgtacagcaaggagagattcagcctgctgctgctgaacctggaggagtactacttcgagcagcacagagccaaccacatcctgcacaagggcagccaccacgagagaaagatcagaggcagcctgaagatctgcagcaagagcgtgatcttcgagcccgacagcatcagccagcccatcatcaagatccccctgagagactgcatcaagatcggcaagcacggcgagaacggcgccaacagacacttcaccaaggccaagagcggcggcatcagcctgatcttcagccaggtgtacttcatcaaggagcacaacgtggtggccccctacaagatcgagagaggcaagatggagtacgtgttcgagctggacgtgcccggcaaggtggaggacgtggtggagaccctgctgcagctgcacagagccagctgcctggacaagctgggcgaccagaccgccatgatcaccgccatcctgcagagcagactggccagaaccagcttcgacaagaacagattccagaacatcagcgagaagctgcacatggagtgcaaggccgagatggtgacccccctggtgaccaaccccggccacgtgtgcatcaccgacaccaacctgtacttccagcccctgaacggctaccccaagcccgtggtgcagatcaccctgcaggacgtgagaagaatctacaagagaagacacggcctgatgcccctgggcctggaggtgttctgcaccgaggacgacctgtgcagcgacatctacctgaagttctacgagccccaggacagagacgacctgtacttctacatcgccacctacctggagcaccacgtggccgagcacaccgccgagagctacatgctgcagtggcagagaggccacctgagcaactaccagtacctgctgcacctgaacaacctggccgacagaagctgcaacgacctgagccagtaccccgtgttcccctggatcatccacgactacagcagcagcgagctggacctgagcaaccccggcaccttcagagacctgagcaagcccgtgggcgccctgaacaaggagagactggagagactgctgaccagataccaggagatgcccgagcccaagttcatgtacggcagccactacagcagccccggctacgtgctgttctacctggtgagaatcgcccccgagtacatgctgtgcctgcagaacggcagattcgacaacgccgacagaatgttcaacagcatcgccgagacctggaagaactgcctggacggcgccaccgacttcaaggagctgatccccgagttctacggcgacgacgtgagcttcctggtgaacagcctgaagctggacctgggcaagagacagggcggccagatggtggacgacgtggagctgcccccctgggccagcagccccgaggacttcctgcagaagagcaaggacgccctggagagcaactacgtgagcgagcacctgcacgagtggatcgacctgatcttcggctacaagcagaagggcagcgacgccgtgggcgcccacaacgtgttccaccccctgacctacgagggcggcgtggacctgaacagcatccaggaccccgacgagaaggtggccatgctgacccagatcctggagttcggccagacccccaagcagctgttcgtgaccccccaccccagaagaatcacccccaagttcaagagcctgagccagaccagcagctacaacgccagcatggccgacagccccggcgaggagagcttcgaggacctgaccgaggagagcaagaccctggcctggaacaacatcaccaagctgcagctgcacgagcactacaagatccacaaggaggccgtgaccggcatcaccgtgagcagaaacggcagcagcgtgttcaccaccagccaggacagcaccctgaagatgttcagcaaggagagcaagatgctgcagagaagcatcagcttcagcaacatggccctgagcagctgcctgctgctgcccggcgacgccaccgtgatcaccagcagctgggacaacaacgtgtacttctacagcatcgccttcggcagaagacaggacaccctgatgggccacgacgacgccgtgagcaagatctgctggcacgacaacagactgtacagcgccagctgggacagcaccgtgaaggtgtggagcggcgtgcccgccgagatgcccggcaccaagagacaccacttcgacctgctggccgagctggagcacgacgtgagcgtggacaccatcagcctgaacgccgccagcaccctgctggtgagcggcaccaaggagggcaccgtgaacatctgggacctgaccaccgccaccctgatgcaccagatcccctgccacagcggcatcgtgtgcgacaccgccttcagccccgacagcagacacgtgctgagcaccggcaccgacggctgcctgaacgtgatcgacgtgcagaccggcatgctgatcagcagcatgaccagcgacgagccccagagatgcttcgtgtgggacggcaacagcgtgctgagcggcagccagagcggcgagctgctggtgtgggacctgctgggcgccaagatcagcgagagaatccagggccacaccggcgccgtgacctgcatctggatgaacgagcagtgcagcagcatcatcaccggcggcgaggacagacagatcatcttctggaagctgcagtactag

SEQ ID NO: 91006 - DNA, 2847 bp, Artificial Sequence
  Description of Artificial Sequence: Synthetic coding sequence
atgaccggccaggccagattccacagaggcgccgaggcctgcagagccatcagacagtgcagaagcagaagacccagagccgcccaccccgagggcagagccggcagcggcagaggcagcagacacgccagccccggcgtgagaagaggcggcttcagcctgctgctgctgaacctggaggagtactacttcgagcagcacagagccaaccacatcctgcacaagggcagccaccacgagagaaagatcagaggcagcctgaagatctgcagcaagagcgtgatcttcgagcccgacagcatcagccagcccatcatcaagatccccctgagagactgcatcaagatcggcaagcacggcgagaacggcgccaacagacacttcaccaaggccaagagcggcggcatcagcctgatcttcagccaggtgtacttcatcaaggagcacaacgtggtggccccctacaagatcgagagaggcaagatggagtacgtgttcgagctggacgtgcccggcaaggtggaggacgtggtggagaccctgctgcagctgcacagagccagctgcctggacaagctgggcgaccagaccgccatgatcaccgccatcctgcagagcagactggccagaaccagcttcgacaagaacagattccagaacatcagcgagaagctgcacatggagtgcaaggccgagatggtgacccccctggtgaccaaccccggccacgtgtgcatcaccgacaccaacctgtacttccagcccctgaacggctaccccaagcccgtggtgcagatcaccctgcaggacgtgagaagaatctacaagagaagacacggcctgatgcccctgggcctggaggtgttctgcaccgaggacgacctgtgcagcgacatctacctgaagttctacgagccccaggacagagacgacctgtacttctacatcgccacctacctggagcaccacgtggccgagcacaccgccgagagctacatgctgcagtggcagagaggccacctgagcaactaccagtacctgctgcacctgaacaacctggccgacagaagctgcaacgacctgagccagtaccccgtgttcccctggatcatccacgactacagcagcagcgagctggacctgagcaaccccggcaccttcagagacctgagcaagcccgtgggcgccctgaacaaggagagactggagagactgctgaccagataccaggagatgcccgagcccaagttcatgtacggcagccactacagcagccccggctacgtgctgttctacctggtgagaatcgcccccgagtacatgctgtgcctgcagaacggcagattcgacaacgccgacagaatgttcaacagcatcgccgagacctggaagaactgcctggacggcgccaccgacttcaaggagctgatccccgagttctacggcgacgacgtgagcttcctggtgaacagcctgaagctggacctgggcaagagacagggcggccagatggtggacgacgtggagctgcccccctgggccagcagccccgaggacttcctgcagaagagcaaggacgccctggagagcaactacgtgagcgagcacctgcacgagtggatcgacctgatcttcggctacaagcagaagggcagcgacgccgtgggcgcccacaacgtgttccaccccctgacctacgagggcggcgtggacctgaacagcatccaggaccccgacgagaaggtggccatgctgacccagatcctggagttcggccagacccccaagcagctgttcgtgaccccccaccccagaagaatcacccccaagttcaagagcctgagccagaccagcagctacaacgccagcatggccgacagccccggcgaggagagcttcgaggacctgaccgaggagagcaagaccctggcctggaacaacatcaccaagctgcagctgcacgagcactacaagatccacaaggaggccgtgaccggcatcaccgtgagcagaaacggcagcagcgtgttcaccaccagccaggacagcaccctgaagatgttcagcaaggagagcaagatgctgcagagaagcatcagcttcagcaacatggccctgagcagctgcctgctgctgcccggcgacgccaccgtgatcaccagcagctgggacaacaacgtgtacttctacagcatcgccttcggcagaagacaggacaccctgatgggccacgacgacgccgtgagcaagatctgctggcacgacaacagactgtacagcgccagctgggacagcaccgtgaaggtgtggagcggcgtgcccgccgagatgcccggcaccaagagacaccacttcgacctgctggccgagctggagcacgacgtgagcgtggacaccatcagcctgaacgccgccagcaccctgctggtgagcggcaccaaggagggcaccgtgaacatctgggacctgaccaccgccaccctgatgcaccagatcccctgccacagcggcatcgtgtgcgacaccgccttcagccccgacagcagacacgtgctgagcaccggcaccgacggctgcctgaacgtgatcgacgtgcagaccggcatgctgatcagcagcatgaccagcgacgagccccagagatgcttcgtgtgggacggcaacagcgtgctgagcggcagccagagcggcgagctgctggtgtgggacctgctgggcgccaagatcagcgagagaatccagggccacaccggcgccgtgacctgcatctggatgaacgagcagtgcagcagcatcatcaccggcggcgaggacagacagatcatcttctggaagctgcagtactag

SEQ ID NO: 91007 - DNA, 1173 bp, Artificial Sequence
  Description of Artificial Sequence: Synthetic coding sequence
atgggcgacaccttcatcagacacatcgccctgctgggcttcgagaagagattcgtgcccagccagcactacgtgtacatgttcctggtgaagtggcaggacctgagcgagaaggtggtgtacagaagattcaccgagatctacgagttccacaagaccctgaaggagatgttccccatcgaggccggcgccatcaaccccgagaacagaatcatcccccacctgcccgcccccaagtggttcgacggccagagagccgccgagaacagacagggcaccctgaccgagtactgcggcaccctgatgagcctgcccaccaagatcagcagatgcccccacctgctggacttcttcaaggtgagacccgacgacctgaagctgcccaccgacaaccagaccaagaagcccgagacctacctgatgcccaaggacggcaagagcaccgccaccgacatcaccggccccatcatcctgcagacctacagagccatcgccaactacgagaagaccagcggcagcgagatggccctgagcaccggcgacgtggtggaggtggtggagaagagcgagagcggctggtggttctgccagatgaaggccaagagaggctggatccccgccagcttcctggagcccctggacagccccgacgagaccgaggaccccgagcccaactacgccggcgagccctacgtggccatcaaggcctacaccgccgtggagggcgacgaggtgagcctgctggagggcgaggccgtggaggtgatccacaagctgctggacggctggtgggtgatcagaaaggacgacgtgaccggctacttccccagcatgtacctgcagaagagcggccaggacgtgagccaggcccagagacagatcaagagaggcgccccccccagaagaagcagcatcagaaacgcccacagcatccaccagagaagcagaaagagactgagccaggacgcctacagaagaaacagcgtgagattcctgcagcagagaagaagacaggccagacccggcccccagagccccggcagccccctggaggaggagagacagacccagagaagcaagccccagcccgccgtgccccccagacccagcgccgacctgatcctgaacagatgcagcgagagcaccaagagaaagctggccagcgccgtgtag

SEQ ID NO: 91008 - DNA, 444 bp, Artificial Sequence
  Description of Artificial Sequence: Synthetic coding sequence
atgaccaagaagcccgagacctacctgatgcccaaggacggcaagagcaccgccaccgacatcaccggccccatcatcctgcagacctacagagccatcgccaactacgagaagaccagcggcagcgagatggccctgagcaccggcgacgtggtggaggtggtggagaagagcgagagcggccagaccagccacctgaccggcctgctgcccctggtgctgagaaacccccagccccaggccccctgccagggcagcggcagcctggcccccggcagaacccccgccctgctgggcgccctgaacgtgctgcccaccctgtgggtggccttctgcctgagcgtgcaccccgtggtggccgtgggcatctgcgcctggcaggccggcgccggccacgtgtgcgtgttctgcctggacggctacggcaccgtgtgcagcctgtag

SEQ ID NO: 91009 - DNA, 759 bp, Artificial Sequence
  Description of Artificial Sequence: Synthetic coding sequence
atgggcgacaccttcatcagacacatcgccctgctgggcttcgagaagagattcgtgcccagccagcactacgtgcacgtgcccggcgagatggccggccccgtgggcgagggcggcctgcccgccctgcacagagacctgagagtgcccagccccaagtggttcgacggccagagagccgccgagaacagacagggcaccctgaccgagtactgcggcaccctgatgagcctgcccaccaagatcagcagatgcccccacctgctggacttcttcaaggtgagacccgacgacctgaagctgcccaccgacaaccagaccaagaagcccgagacctacctgatgcccaaggacggcaagagcaccgccaccgacatcaccggccccatcatcctgcagacctacagagccatcgccaactacgagaagaccagcggcagcgagatggccctgagcaccggcgacgtggtggaggtggtggagaagagcgagagcggccagaccagccacctgaccggcctgctgcccctggtgctgagaaacccccagccccaggccccctgccagggcagcggcagcctggcccccggcagaacccccgccctgctgggcgccctgaacgtgctgcccaccctgtgggtggccttctgcctgagcgtgcaccccgtggtggccgtgggcatctgcgcctggcaggccggcgccggccacgtgtgcgtgttctgcctggacggctacggcaccgtgtgcagcctgtag

SEQ ID NO: 91010 - DNA, 1581 bp, Artificial Sequence
  Description of Artificial Sequence: Synthetic coding sequence
atgagcctggtggaggccatcagcctgtggaacgagggcgtgctggccgccgacaagaaggactggaagggcgccctggacgccttcagcgccgtgcaggacccccacagcagaatctgcttcaacatcggctgcatgtacaccatcctgaagaacatgaccgaggccgagaaggccttcaccagaagcatcaacagagacaagcacctggccgtggcctacttccagagaggcatgctgtactaccagaccgagaagtacgacctggccatcaaggacctgaaggaggccctgatccagctgagaggcaaccagctgatcgactacaagatcctgggcctgcagttcaagctgttcgcctgcgaggtgctgtacaacatcgccttcatgtacgccaagaaggaggagtggaagaaggccgaggagcagctggccctggccaccagcatgaagagcgagcccagacacagcaagatcgacaaggccatggagtgcgtgtggaagcagaagctgtacgagcccgtggtgatccccgtgggcaagctgttcagacccaacgagagacaggtggcccagctggccaagaaggactacctgggcaaggccaccgtggtggccagcgtggtggaccaggacagcttcagcggcttcgcccccctgcagccccaggccgccgagcccccccccagacccaagacccccgagatcttcagagccctggagggcgaggcccacagagtgctgttcggcttcgtgcccgagaccaaggaggagctgcaggtgatgcccggcaacatcgtgttcgtgctgaagaagggcaacgacaactgggccaccgtgatgttcaacggccagaagggcctggtgccctgcaactacctggagcccgtggagctgagaatccacccccagcagcagccccaggaggagagcagcccccagagcgacatccccgccccccccagcagcaaggcccccggcagaccccagctgagccccggccagaagcagaaggaggagcccaaggaggtgaagctgagcgtgcccatgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgcccctgagcgaggacagcatgaaggacgcctggggccaggtgaagaactactgcctgaccctgtggtgcgagaacaccgtgggcgaccagggcttccccgacgagcccaaggagagcgagaaggccgacgccaacaaccagaccaccgagccccagctgaagaagggcagccaggtggaggccctgttcagctacgaggccacccagcccgaggacctggagttccaggagggcgacatcatcctggtgctgagcaaggtgaacgaggagtggctggagggcgagtgcaagggcaaggtgggcatcttccccaaggtgttcgtggaggactgcgccaccaccgacctggagagcaccagaagagaggtgtag

SEQ ID NO: 91011 - DNA, 1581 bp, Artificial Sequence; identical to SEQ ID NO: 91010
  Description of Artificial Sequence: Synthetic coding sequence

SEQ ID NO: 91012 - DNA, 1797 bp, Artificial Sequence
  Description of Artificial Sequence: Synthetic coding sequence
ggcagccccgccagaggcgacgcccccacctgcctgctgagcgtgagctggcagctgagctggccccccagcttctacctgatcatgagcctggtggaggccatcagcctgtggaacgagggcgtgctggccgccgacaagaaggactggaagggcgccctggacgccttcagcgccgtgcaggacccccacagcagaatctgcttcaacatcggctgcatgtacaccatcctgaagaacatgaccgaggccgagaaggccttcaccagaagcatcaacagagacaagcacctggccgtggcctacttccagagaggcatgctgtactaccagaccgagaagtacgacctggccatcaaggacctgaaggaggccctgatccagctgagaggcaaccagctgatcgactacaagatcctgggcctgcagttcaagctgttcgcctgcgaggtgctgtacaacatcgccttcatgtacgccaagaaggaggagtggaagaaggccgaggagcagctggccctggccaccagcatgaagagcgagcccagacacagcaagatcgacaaggccatggagtgcgtgtggaagcagaagctgtacgagcccgtggtgatccccgtgggcaagctgttcagacccaacgagagacaggtggcccagctggccaagaaggactacctgggcaaggccaccgtggtggccagcgtggtggaccaggacagcttcagcggcttcgcccccctgcagccccaggtgagacagagcgacctgctgggcgcccaggccggcagcgtgagcagcagacagctgcagctggacgtggagctggagcccggctggagccaggtgcccggcagcaagttcagcgtgttcgccccctggcaccacgtgagaggctggggcctggacctggtgagcatcctgtgcagagccctggagggcgaggcccacagagtgctgttcggcttcgtgcccgagaccaaggaggagctgcaggtgatgcccggcaacatcgtgttcgtgctgaagaagggcaacgacaactgggccaccgtgatgttcaacggccagaagggcctggtgccctgcaactacctggagcccgtggagctgagaatccacccccagcagcagccccaggaggagagcagcccccagagcgacatccccgccccccccagcagcaaggcccccggcagaccccagctgagccccggccagaagcagaaggaggagcccaaggaggtgaagctgagcgtgcccatgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgcccctgagcgaggacagcatgaaggacgcctggggccaggtgaagaactactgcctgaccctgtggtgcgagaacaccgtgggcgaccagggcttccccgacgagcccaaggagagcgagaaggccgacgccaacaaccagaccaccgagccccagctgaagaagggcagccaggtggaggccctgttcagctacgaggccacccagcccgaggacctggagttccaggagggcgacatcatcctggtgctgagcaaggtgaacgaggagtggctggagggcgagtgcaagggcaaggtgggcatcttccccaaggtgttcgtggaggactgcgccaccaccgacctggagagcaccagaagagaggtgtag

SEQ ID NO: 91013 - DNA, 1446 bp, Artificial Sequence
  Description of Artificial Sequence: Synthetic coding sequence
atgagcctggtggaggccatcagcctgtggaacgagggcgtgctggccgccgacaagaaggactggaagggcgccctggacgccttcagcgccgtgcaggacccccacagcagaatctgcttcaacatcggctgcatgtacaccatcctgaagaacatgaccgaggccgagaaggccttcaccagaagcatcaacagagacaagcacctggccgtggcctacttccagagaggcatgctgtactaccagaccgagaagtacgacctggccatcaaggacctgaaggaggccctgatccagctgagaggcaaccagctgatcgactacaagatcctgggcctgcagttcaagctgttcgcctgcgagaagcagaagctgtacgagcccgtggtgatccccgtgggcaagctgttcagacccaacgagagacaggtggcccagctggccaagaaggactacctgggcaaggccaccgtggtggccagcgtggtggaccaggacagcttcagcggcttcgcccccctgcagccccaggccgccgagcccccccccagacccaagacccccgagatcttcagagccctggagggcgaggcccacagagtgctgttcggcttcgtgcccgagaccaaggaggagctgcaggtgatgcccggcaacatcgtgttcgtgctgaagaagggcaacgacaactgggccaccgtgatgttcaacggccagaagggcctggtgccctgcaactacctggagcccgtggagctgagaatccacccccagcagcagccccaggaggagagcagcccccagagcgacatccccgccccccccagcagcaaggcccccggcagaccccagctgagccccggccagaagcagaaggaggagcccaaggaggtgaagctgagcgtgcccatgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgcccctgagcgaggacagcatgaaggacgcctggggccaggtgaagaactactgcctgaccctgtggtgcgagaacaccgtgggcgaccagggcttccccgacgagcccaaggagagcgagaaggccgacgccaacaaccagaccaccgagccccagctgaagaagggcagccaggtggaggccctgttcagctacgaggccacccagcccgaggacctggagttccaggagggcgacatcatcctggtgctgagcaaggtgaacgaggagtggctggagggcgagtgcaagggcaaggtgggcatcttccccaaggtgttcgtggaggactgcgccaccaccgacctggagagcaccagaagagaggtgtag

SEQ ID NO: 91014 - DNA, 1338 bp, Artificial Sequence
  Description of Artificial Sequence: Synthetic coding sequence
atgagcctggtggaggccatcagcctgtggaacgagggcgtgctggccgccgacaagaaggactggaagggcgccctggacgccttcagcgccgtgcaggacccccacagcagaatctgcttcaacatcggctgcatgtacaccatcctgaagaacatgaccgaggccgagaaggccttcaccagaagcatcaacagagacaagcacctggccgtggcctacttccagagaggcatgctgtactaccagaccgagaagtacgacctggccatcaaggacctgaaggaggccctgatccagctgagaggcaaccagctgatcgactacaagatcctgggcctgcagttcaagctgttcgcctgcgaggtggtggccagcgtggtggaccaggacagcttcagcggcttcgcccccctgcagccccaggccgccgagcccccccccagacccaagacccccgagatcttcagagccctggagggcgaggcccacagagtgctgttcggcttcgtgcccgagaccaaggaggagctgcaggtgatgcccggcaacatcgtgttcgtgctgaagaagggcaacgacaactgggccaccgtgatgttcaacggccagaagggcctggtgccctgcaactacctggagcccgtggagctgagaatccacccccagcagcagccccaggaggagagcagcccccagagcgacatccccgccccccccagcagcaaggcccccggcagaccccagctgagccccggccagaagcagaaggaggagcccaaggaggtgaagctgagcgtgcccatgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgcccctgagcgaggacagcatgaaggacgcctggggccaggtgaagaactactgcctgaccctgtggtgcgagaacaccgtgggcgaccagggcttccccgacgagcccaaggagagcgagaaggccgacgccaacaaccagaccaccgagccccagctgaagaagggcagccaggtggaggccctgttcagctacgaggccacccagcccgaggacctggagttccaggagggcgacatcatcctggtgctgagcaaggtgaacgaggagtggctggagggcgagtgcaagggcaaggtgggcatcttccccaaggtgttcgtggaggactgcgccaccaccgacctggagagcaccagaagagaggtgtag

SEQ ID NO: 91015 - DNA, 432 bp, Artificial Sequence
  Description of Artificial Sequence: Synthetic coding sequence
atgcccggcaacatcgtgttcgtgctgaagaagggcaacgacaactgggccaccgtgatgttcaacggccagaagggcctggtgccctgcaactacctggagcccgtggagctgagaatccacccccagcagcagccccaggaggagagcagcccccagagcgacatccccgccccccccagcagcaaggcccccggcagaccccagctgagccccggccagaagcagaaggaggagcccaaggaggtgaagctgagcgtgcccatgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgccctag

SEQ ID NO: 91016 - DNA, 171 bp, Artificial Sequence
  Description of Artificial Sequence: Synthetic coding sequence
atgccctacaccctgaaggtgcactacaagtacaccgtggtgatgaagacccagcccggcctgccctacagccaggtgagagacatggtgagcaagaagctggagctgagactggagcacaccaagctgagctacagacccagagacagcaacgagctggtgcccctgtag

SEQ ID NO: 91017 - DNA, 1020 bp, Artificial Sequence
  Description of Artificial Sequence: Synthetic coding sequence
atggccgtggcccagcagctgagagccgagagcgacttcgagcagctgcccgacgacgtggccatcagcgccaacatcgccgacatcgaggagaagagaggcttcaccagccacttcgtgttcgtgatcgaggtgaagaccaagggcggcagcaagtacctgatctacagaagatacagacagttccacgccctgcagagcaagctggaggagagattcggccccgacagcaagagcagcgccctggcctgcaccctgcccaccctgcccgccaaggtgtacgtgggcgtgaagcaggagatcgccgagatgagaatccccgccctgaacgcctacatgaagagcctgctgagcctgcccgtgtgggtgctgatggacgaggacgtgagaatcttcttctaccagagcccctacgacagcgagcaggtgccccaggccctgagaagactgagacccagaaccagaaaggtgaagagcgtgagcccccagggcaacagcgtggacagaatggccgcccccagagccgaggccctgttcgacttcaccggcaacagcaagctggagctgaacttcaaggccggcgacgtgatcttcctgctgagcagaatcaacaaggactggctggagggcaccgtgagaggcgccaccggcatcttccccctgagcttcgtgaagatcctgaaggacttccccgaggaggacgaccccaccaactggctgagatgctactactacgaggacaccatcagcaccatcaaggacatcgccgtggaggaggacctgagcagcacccccctgctgaaggacctgctggagctgaccagaagagagttccagagagaggacatcgccctgaactacagagacgccgagggcgacctggtgagactgctgagcgacgaggacgtggccctgatggtgagacaggccagaggcctgcccagccagaagagactgttcccctggaagctgcacatcacccagaaggacaactacagagtgtacaacaccatgccctag

SEQ ID NO: 91018 - DNA, 1047 bp, Artificial Sequence
  Description of Artificial Sequence: Synthetic coding sequence
atggccgtggcccagcagctgagagccgagagcgacttcgagcagctgcccgacgacgtggccatcagcgccaacatcgccgacatcgaggagaagagaggcttcaccagccacttcgtgttcgtgatcgaggtgaagaccaagggcggcagcaagtacctgatctacagaagatacagacagttccacgccctgcagagcaagctggaggagagattcggccccgacagcaagagcagcgccctggcctgcaccctgcccaccctgcccgccaaggtgtacgtgggcgtgaagcaggagatcgccgagatgagaatccccgccctgaacgcctacatgaagagcctgctgagcctgcccgtgtgggtgctgatggacgaggacgtgagaatcttcttctaccagagcccctacgacagcgagcaggtgccccaggccctgagaagactgagacccagaaccagaaaggtgaagagcgtgagcccccagggcaacagcgtggacagaatggccgcccccagagccgaggccctgttcgacttcaccggcaacagcaagctggagctgaacttcaaggccggcgacgtgatcttcctgctgagcagaatcaacaaggactggctggagggcaccgtgagaggcgccaccggcatcttccccctgagcttcgtgaagatcctgaaggacttccccgaggaggacgaccccaccaactggctgagatgctactactacgaggacaccatcagcaccatcaagagcgtggcctgggagggcggcgcctgccccgccttcctgcccagcctgagacccctgcccctgaccagccccagccacggcagcctgagccacagcaaggcccccagcggcagccagatgagccacaacgccgtgaccagccaccagagacccggctggcccggccagccccacagccccttcccccaccccaccccccacttccagcccgacgccagcctgctgcagcccgtgacccccctgggcaccagcagatggagaaagatcagcgccgccctgccctactag

SEQ ID NO: 91019 - DNA, 501 bp, Artificial Sequence
  Description of Artificial Sequence: Synthetic coding sequence
atgagaatccccgccctgaacgcctacatgaagagcctgctgagcctgcccgtgtgggtgctgatggacgaggacgtgagaatcttcttctaccagagcccctacgacagcgagcaggtgccccaggccctgagaagactgagacccagaaccagaaaggtgaagagcgtgagcccccagggcaacagcgtggacagaatggccgcccccagagccgaggccctgttcgacttcaccggcaacagcaagctggagctgaacttcaaggccggcgacgtgatcttcctgctgagcagaatcaacaaggactggctggagggcaccgtgagaggcgccaccggcatcttccccctgagcttcgtgaagatcctgaaggacttccccgaggaggacgaccccaccaactggctgagatgctactactacgaggacaccatcagcaccatcaagagcgtggcctgggagggcggcgcctgccccgccttcctgcccagcctgtag

SEQ ID NO: 91020 - DNA, 480 bp, Artificial Sequence
  Description of Artificial Sequence: Synthetic coding sequence
atgaacgacatcagccagaaggccgagatcctgctgagcagcagcaagcccgtgcccaagacctacgtgcccaagctgggcaagggcgacgtgaaggacaagttcgaggccatgcagagagccagagaggagagaaaccagagaagaagcagagacgagaagcagagaagaaaggagcagtacatcagagagagagagtggaacagaagaaagcaggagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcagaagctggccagaagagacggcgcccacctgtag

SEQ ID NO: 91021 - DNA, 1836 bp, Artificial Sequence
  Description of Artificial Sequence: Synthetic coding sequence
atgaacgacatcagccagaaggccgagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcagatcgaggacatcaacaacaccggcaccgagagcgccagcgaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagatggaggaggagaagagaagaaccgaggaggagagaaagcacaagctggagatggagaagcaggagttcgagcagctgagacaggagatgggcgaggaggaggaggagaacgagaccttcggcctgagcagagagtacgaggagctgatcaagctgaagagaagcggcagcatccaggccaagaacctgaagagcaagttcgagaagatcggccagctgagcgagaaggagatccagaagaagatcgaggaggagagagccagaagaagagccatcgacctggagatcaaggagagagaggccgagaacttccacgaggaggacgacgtggacgtgagacccgccagaaagagcgaggcccccttcacccacaaggtgaacatgaaggccagattcgagcagatggccaaggccagagaggaggaggagcagagaagaatcgaggagcagaagctgctgagaatgcagttcgagcagagagagatcgacgccgccctgcagaagaagagagaggaggaggaggaggaggagggcagcatcatgaacggcagcaccgccgaggacgaggagcagaccagaagcggcgccccctggttcaagaagcccctgaagaacaccagcgtggtggacagcgagcccgtgagattcaccgtgaaggtgaccggcgagcccaagcccgagatcacctggtggttcgagggcgagatcctgcaggacggcgaggactaccagtacatcgagagaggcgagacctactgcctgtacctgcccgagaccttccccgaggacggcggcgagtacatgtgcaaggccgtgaacaacaagggcagcgccgccagcacctgcatcctgaccatcgagagcaagaactag

SEQ ID NO: 91022 - DNA, 2028 bp, Artificial Sequence
  Description of Artificial Sequence: Synthetic coding sequence
atgaacgacatcagccagaaggccgagatcctgctgagcagcagcaagcccgtgcccaagacctacgtgcccaagctgggcaagggcgacgtgaaggacaagttcgaggccatgcagagagccagagaggagagaaaccagagaagaagcagagacgagaagcagagaagaaaggagcagtacatcagagagagagagtggaacagaagaaagcaggagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcagatcgaggacatcaacaacaccggcaccgagagcgccagcgaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagatggaggaggagaagagaagaaccgaggaggagagaaagcacaagctggagatggagaagcaggagttcgagcagctgagacaggagatgggcgaggaggaggaggagaacgagaccttcggcctgagcagagagtacgaggagctgatcaagctgaagagaagcggcagcatccaggccaagaacctgaagagcaagttcgagaagatcggccagctgagcgagaaggagatccagaagaagatcgaggaggagagagccagaagaagagccatcgacctggagatcaaggagagagaggccgagaacttccacgaggaggacgacgtggacgtgagacccgccagaaagagcgaggcccccttcacccacaaggtgaacatgaaggccagattcgagcagatggccaaggccagagaggaggaggagcagagaagaatcgaggagcagaagctgctgagaatgcagttcgagcagagagagatcgacgccgccctgcagaagaagagagaggaggaggaggaggaggagggcagcatcatgaacggcagcaccgccgaggacgaggagcagaccagaagcggcgccccctggttcaagaagcccctgaagaacaccagcgtggtggacagcgagcccgtgagattcaccgtgaaggtgaccggcgagcccaagcccgagatcacctggtggttcgagggcgagatcctgcaggacggcgaggactaccagtacatcgagagaggcgagacctactgcctgtacctgcccgagaccttccccgaggacggcggcgagtacatgtgcaaggccgtgaacaacaagggcagcgccgccagcacctgcatcctgaccatcgagagcaagaactag

SEQ ID NO: 91023 - DNA, 1731 bp, Artificial Sequence
  Description of Artificial Sequence: Synthetic coding sequence
tgagtgaagggcagattcgccgagatggagaagcagagacaggaggagcagagaaagagaaccgaggaggagagaaagagaagaatcgagcaggacatgctggagaagagaaagatccagagagagctggccaagagagccgagcagatcgaggacatcaacaacaccggcaccgagagcgccagcgaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagatggaggaggagaagagaagaaccgaggaggagagaaagcacaagctggagatggagaagcaggagttcgagcagctgagacaggagatgggcgaggaggaggaggagaacgagaccttcggcctgagcagagagtacgaggagctgatcaagctgaagagaagcggcagcatccaggccaagaacctgaagagcaagttcgagaagatcggccagctgagcgagaaggagatccagaagaagatcgaggaggagagagccagaagaagagccatcgacctggagatcaaggagagagaggccgagaacttccacgaggaggacgacgtggacgtgagacccgccagaaagagcgaggcccccttcacccacaaggtgaacatgaaggccagattcgagcagatggccaaggccagagaggaggaggagcagagaagaatcgaggagcagaagctgctgagaatgcagttcgagcagagagagatcgacgccgccctgcagaagaagagagaggaggaggaggaggaggagggcagcatcatgaacggcagcaccgccgaggacgaggagcagaccagaagcggcgccccctggttcaagaagcccctgaagaacaccagcgtggtggacagcgagcccgtgagattcaccgtgaaggtgaccggcgagcccaagcccgagatcacctggtggttcgagggcgagatcctgcaggacggcgaggactaccagtacatcgagagaggcgagacctactgcctgtacctgcccgagaccttccccgaggacggcggcgagtacatgtgcaaggccgtgaacaacaagggcagcgccgccagcacctgcatcctgaccatcgagaccgacgactactag

SEQ ID NO: 91024 - DNA, 966 bp, Artificial Sequence
  Description of Artificial Sequence: Synthetic coding sequence
atgaacgacatcagccagaaggccgagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcagatcgaggacatcaacaacaccggcaccgagagcgccagcgaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagtag

SEQ ID NO: 91025 - DNA, 1308 bp, Artificial Sequence
  Description of Artificial Sequence: Synthetic coding sequence
atgaacgacatcagccagaaggccgagatcctgctgagcagcagcaagcccgtgcccaagacctacgtgcccaagctgggcaagggcgacgtgaaggacaagttcgaggccatgcagagagccagagaggagagaaaccagagaagaagcagagacgagaagcagagaagaaaggagcagtacatcagagagagagagtggaacagaagaaagcaggagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagatggaggaggagaagagaagaaccgaggaggagagaaagcacaagctggagatggagaagcaggagttcgagcagctgagacaggagatgggcgaggaggaggaggagaacgagaccttcggcctgagcagagagtacgaggagctgatcaagctgaagagaagcggcagcatccaggccaagaacctgaagtag

SEQ ID NO: 91026 - DNA, 1989 bp, Artificial Sequence
  Description of Artificial Sequence: Synthetic coding sequence
atgaacgacatcagccagaaggccgagatcctgctgagcagcagcaagcccgtgcccaagacctacgtgcccaagctgggcaagggcgacgtgaaggacaagttcgaggccatgcagagagccagagaggagagaaaccagagaagaagcagagacgagaagcagagaagaaaggagcagtacatcagagagagagagtggaacagaagaaagcaggagatcaaggagatgctggccagcgacgacgaggaggacgtgagcagcaaggtggagaaggcctacgtgcccaagctgaccggcaccgtgaagggcagattcgccgagatggagaagcagagacaggaggagcagagaaagagaaccgaggaggagagaaagagaagaatcgagcaggacatgctggagaagagaaagatccagagagagctggccaagagagccgagcaggagggcgacgacagcctgctgatcaccgtggtgcccgtgaagagctacaagaccagcggcaagatgaagaagaacttcgaggacctggagaaggagagagaggagaaggagagaatcaagtacgaggaggacaagagaatcagatacgaggagcagagacccagcctgaaggaggccaagtgcctgagcctggtgatggacgacgagatcgagagcgaggccaagaaggagagcctgagccccggcaagctgaagctgaccttcgaggagctggagagacagagacaggagaacagaaagaagcaggccgaggaggaggccagaaagagactggaggaggagaagagagccttcgaggaggccagaagacagatggtgaacgaggacgaggagaaccaggacaccgccaagatcttcaagggctacagacccggcaagctgaagctgagcttcgaggagatggagagacagagaagagaggacgagaagagaaaggccgaggaggaggccagaagaagaatcgaggaggagaagaaggccttcgccgaggccagaagaaacatggtggtggacgacgacagccccgagatgtacaagaccatcagccaggagttcctgacccccggcaagctggagatcaacttcgaggagctgctgaagcagaagatggaggaggagaagagaagaaccgaggaggagagaaagcacaagctggagatggagaagcaggagttcgagcagctgagacaggagatgggcgaggaggaggaggagaacgagaccttcggcctgagcagagagtacgaggagctgatcaagctgaagagaagcggcagcatccaggccaagaacctgaagagcaagttcgagaagatcggccagctgagcgagaaggagatccagaagaagatcgaggaggagagagccagaagaagagccatcgacctggagatcaaggagagagaggccgagaacttccacgaggaggacgacgtggacgtgagacccgccagaaagagcgaggcccccttcacccacaaggtgaacatgaaggccagattcgagcagatggccaaggccagagaggaggaggagcagagaagaatcgaggagcagaagctgctgagaatgcagttcgagcagagagagatcgacgccgccctgcagaagaagagagaggaggaggaggaggaggagggcagcatcatgaacggcagcaccgccgaggacgaggagcagaccagaagcggcgccccctggttcaagaagcccctgaagaacaccagcgtggtggacagcgagcccgtgagattcaccgtgaaggtgaccggcgagcccaagcccgagatcacctggtggttcgagggcgagatcctgcaggacggcgaggactaccagtacatcgagagaggcgagacctactgcctgtacctgcccgagaccttccccgaggacggcggcgagtacatgtgcaaggccgtgaacaacaagggcagcgccgccagcacctgcatcctgaccatcgagaccgacgactactag

SEQ ID NO: 91027 - DNA, 813 bp, Artificial Sequence
  Description of Artificial Sequence: Synthetic coding sequence
atggagaaccagcccgtgagatggagagccctgcccggcctgcccagaccccccggcctgcccgccgccccctggctgctgctgggcgtgctgctgctgcccggcaccctgagactggccggcggccagagcgtgacccacaccggcctgcccatcatggccagcctggccaacaccgccatcagcttcagctgcagaatcacctacccctacaccccccagttcaaggtgttcaccgtgagctacttccacgaggacctgcagggccagagaagccccaagaagcccaccaactgccaccccggcctgggcaccgagaaccagagccacaccctggactgccaggtgaccctggtgctgcccggcgccagcgccaccggcacctactactgcagcgtgcactggccccacagcaccgtgagaggcagcggcaccttcatcctggtgagagacgccggctacagagagcccccccagagcccccagaagctgctgctgttcggcttcaccggcctgctgagcgtgctgagcgtggtgggcaccgccctgctgctgtggaacaagaagagaatgagaggccccggcaaggaccccaccagaaagtgccccgaccccagaagcgccagcagccccaagcagcaccccagcgagagcgtgtacaccgccctgcagagaagagagaccgaggtgtacgcctgcatcgagaacgaggacggcagcagccccaccgccaagcagagccccctgagccaggagagaccccacagattcgaggacgacggcgagctgaacctggtgtacgagaacctgtag

SEQ ID NO: 91028 - DNA, 1248 bp, Artificial Sequence
  Description of Artificial Sequence: Synthetic coding sequence
atggcccccgtgagcggcagcagaagccccgacagagaggccagcggcagcggcggcagaagaagaagcagcagcaagagccccaagcccagcaagagcgccagaagccccagaggcagaagaagcagaagccacagctgcagcagaagcggcgacagaaacggcctgacccaccagctgggcggcctgagccagggcagcagaaaccagagctacagaagcagaagcagaagcagaagcagagagagacccagcgcccccagaggcatccccttcgccagcgccagcagcagcgtgtactacggcagctacagcagaccctacggcagcgacaagccctggcccagcctgctggacaaggagagagaggagagcctgagacagaagagactgagcgagagagagagaatcggcgagctgggcgcccccgaggtgtggggcctgagccccaagaaccccgagcccgacagcgacgagcacacccccgtggaggacgaggagcccaagaagagcaccaccagcgccagcaccagcgaggaggagaagaagaagaagagcagcagaagcaaggagagaagcaagaagagaagaaagaagaagagcagcaagagaaagcacaagaagtacagcgaggacagcgacagcgacagcgacagcgagaccgacagcagcgacgaggacaacaagagaagagccaagaaggccaagaagaaggagaagaagaagaagcacagaagcaagaagtacaagaagaagagaagcaagaagagcagaaaggagagcagcgacagcagcagcaaggagagccaggaggagttcctggagaacccctggaaggacagaaccaaggccgaggagcccagcgacctgatcggccccgaggcccccaagaccctgaccagccaggacgacaagcccctgaactacggccacgccctgctgcccggcgagggcgccgccatggccgagtacgtgaaggccggcaagagaatccccagaagaggcgagatcggcctgaccagcgaggagatcgccagcttcgagtgcagcggctacgtgatgagcggcagcagacacagaagaatggaggccgtgagactgagaaaggagaaccagatctacagcgccgacgagaagagagccctggccagcttcaaccaggaggagagaagaaagagagagaacaagatcctggccagcttcagagagatggtgtacagaaagaccaagggcaaggacgacaagtag

SEQ ID NO: 91029 - DNA, 2073 bp, Artificial Sequence
  Description of Artificial Sequence: Synthetic coding sequence
atggagaagatcctgcagatggccgagggcatcgacatcggcgagatgcccagctacgacctggtgctgagcaagcccagcaagggccagaagagacacctgagcacctgcgacggccagaacccccccaagaagcaggccggcagcaagttccacgccagacccagattcgagcccgtgcacttcgtggccagcagcagcaaggacgagagacaggaggacccctacggcccccagaccaaggaggtgaacgagcagacccacttcgccagcatgcccagagacatctaccaggactacacccaggacagcttcagcatccaggacggcaacagccagtactgcgacagcagcggcttcatcctgaccaaggaccagcccgtgaccgccaacatgtacttcgacagcggcaaccccgcccccagcaccaccagccagcaggccaacagccagagcacccccgagcccagccccagccagaccttccccgagagcgtggtggccgagaagcagtacttcatcgagaagctgaccgccaccatctggaagaacctgagcaaccccgagatgaccagcggcagcgacaagatcaactacacctacatgctgaccagatgcatccaggcctgcaagaccaaccccgagtacatctacgcccccctgaaggagatcccccccgccgacatccccaagaacaagaagctgctgaccgacggctacgcctgcgaggtgagatgccagaacatctacctgaccaccggctacgccggcagcaagaacggcagcagagacagagccaccgagctggccgtgaagctgctgcagaagagaatcgaggtgagagtggtgagaagaaagttcaagcacaccttcggcgaggacctggtggtgtgccagatcggcatgagcagctacgagttcccccccgccctgaagccccccgaggacctggtggtgctgggcaaggacgccagcggccagcccatcttcaacgccagcgccaagcactggaccaacttcgtgatcaccgagaacgccaacgacgccatcggcatcctgaacaacagcgccagcttcaacaagatgagcatcgagtacaagtacgagatgatgcccaacagaacctggagatgcagagtgttcctgcaggaccactgcctggccgagggctacggcaccaagaagaccagcaagcacgccgccgccgacgaggccctgaagatcctgcagaagacccagcccacctaccccagcgtgaagagcagccagtgccacaccggcagcagccccagaggcagcggcaagaagaaggacatcaaggacctggtggtgtacgagaacagcagcaaccccgtgtgcaccctgaacgacaccgcccagttcaacagaatgaccgtggagtacgtgtacgagagaatgaccggcctgagatggaagtgcaaggtgatcctggagagcgaggtgatcgccgaggccgtgggcgtgaagaagaccgtgaagtacgaggccgccggcgaggccgtgaagaccctgaagaagacccagcccaccgtgatcaacaacctgaagaagggcgccgtggaggacgtgatcagcagaaacgagatccagggcagaagcgccgaggaggcctacaagcagcagatcaaggaggacaacatcggcaaccagctgctgagaaagatgggctggaccggcggcggcctgggcaagagcggcgagggcatcagagagcccatcagcgtgaaggagcagcacaagagagagggcctgggcctggacgtggagagagtgaacaagatcgccaagagagacatcgagcagatcatcagaaactacgccagaagcgagagccacaccgacctgaccttcagcagagagctgaccaacgacgagagaaagcagatccaccagatcgcccagaagtacggcctgaagagcaagagccacggcgtgggccacgacagatacctggtggtgggcagaaagagaagaaaggaggacctgctggaccagctgaagcaggagggccaggtgggccactacgagctggtgatgccccaggccaactag

SEQ ID NO: 91030 - DNA, 2073 bp, Artificial Sequence; identical to SEQ ID NO: 91029
  Description of Artificial Sequence: Synthetic coding sequence

SEQ ID NO: 91031 - DNA, 2118 bp, Artificial Sequence
  Description of Artificial Sequence: Synthetic coding sequence
atgggcttcatgctgcccctgatcttcagatacagccccagactgatggagaagatcctgcagatggccgagggcatcgacatcggcgagatgcccagctacgacctggtgctgagcaagcccagcaagggccagaagagacacctgagcacctgcgacggccagaacccccccaagaagcaggccggcagcaagttccacgccagacccagattcgagcccgtgcacttcgtggccagcagcagcaaggacgagagacaggaggacccctacggcccccagaccaaggaggtgaacgagcagacccacttcgccagcatgcccagagacatctaccaggactacacccaggacagcttcagcatccaggacggcaacagccagtactgcgacagcagcggcttcatcctgaccaaggaccagcccgtgaccgccaacatgtacttcgacagcggcaaccccgcccccagcaccaccagccagcaggccaacagccagagcacccccgagcccagccccagccagaccttccccgagagcgtggtggccgagaagcagtacttcatcgagaagctgaccgccaccatctggaagaacctgagcaaccccgagatgaccagcggcagcgacaagatcaactacacctacatgctgaccagatgcatccaggcctgcaagaccaaccccgagtacatctacgcccccctgaaggagatcccccccgccgacatccccaagaacaagaagctgctgaccgacggctacgcctgcgaggtgagatgccagaacatctacctgaccaccggctacgccggcagcaagaacggcagcagagacagagccaccgagctggccgtgaagctgctgcagaagagaatcgaggtgagagtggtgagaagaaagttcaagcacaccttcggcgaggacctggtggtgtgccagatcggcatgagcagctacgagttcccccccgccctgaagccccccgaggacctggtggtgctgggcaaggacgccagcggccagcccatcttcaacgccagcgccaagcactggaccaacttcgtgatcaccgagaacgccaacgacgccatcggcatcctgaacaacagcgccagcttcaacaagatgagcatcgagtacaagtacgagatgatgcccaacagaacctggagatgcagagtgttcctgcaggaccactgcctggccgagggctacggcaccaagaagaccagcaagcacgccgccgccgacgaggccctgaagatcctgcagaagacccagcccacctaccccagcgtgaagagcagccagtgccacaccggcagcagccccagaggcagcggcaagaagaaggacatcaaggacctggtggtgtacgagaacagcagcaaccccgtgtgcaccctgaacgacaccgcccagttcaacagaatgaccgtggagtacgtgtacgagagaatgaccggcctgagatggaagtgcaaggtgatcctggagagcgaggtgatcgccgaggccgtgggcgtgaagaagaccgtgaagtacgaggccgccggcgaggccgtgaagaccctgaagaagacccagcccaccgtgatcaacaacctgaagaagggcgccgtggaggacgtgatcagcagaaacgagatccagggcagaagcgccgaggaggcctacaagcagcagatcaaggaggacaacatcggcaaccagctgctgagaaagatgggctggaccggcggcggcctgggcaagagcggcgagggcatcagagagcccatcagcgtgaaggagcagcacaagagagagggcctgggcctggacgtggagagagtgaacaagatcgccaagagagacatcgagcagatcatcagaaactacgccagaagcgagagccacaccgacctgaccttcagcagagagctgaccaacgacgagagaaagcagatccaccagatcgcccagaagtacggcctgaagagcaagagccacggcgtgggccacgacagatacctggtggtgggcagaaagagaagaaaggaggacctgctggaccagctgaagcaggagggccaggtgggccactacgagctggtgatgccccaggccaactag

SEQ ID NO: 91032 - DNA, 570 bp, Artificial Sequence
  Description of Artificial Sequence: Synthetic coding sequence
atgctgctgagagccgcctggagaagagccgccgtggccgtgaccgccgcccccggccccaagcccgccgcccccaccagaggcctgagactgagagtgggcgacagagccccccagagcgccgtgcccgccgacaccgccgccgcccccgaggtgggccccgtgctgagacccctgtacatggacgtgcaggccaccacccccctggaccccagagtgctggacgccatgctgccctacctgatcaactactacggcaacccccacagcagaacccacgcctacggctgggagagcgaggccgccatggagagagccagacagcaggtggccagcctgatcggcgccgaccccagagagatcatcttcaccagcggcgccaccgagagcaacaacatcgccatcaagaccgagagccacagcgtgatccaggccggcgtgcagtggcacgacctggacagcctgcaggcccccccccccggcttcacccccttcagctgcctgagcctgctgagcagctgggactacagaagaccccccccccaccccgccaacttcctgtacttctag

SEQ ID NO: 91033 - DNA, 1374 bp, Artificial Sequence
  Description of Artificial Sequence: Synthetic coding sequence
atgctgctgagagccgcctggagaagagccgccgtggccgtgaccgccgcccccggccccaagcccgccgcccccaccagaggcctgagactgagagtgggcgacagagccccccagagcgccgtgcccgccgacaccgccgccgcccccgaggtgggccccgtgctgagacccctgtacatggacgtgcaggccaccacccccctggaccccagagtgctggacgccatgctgccctacctgatcaactactacggcaacccccacagcagaacccacgcctacggctgggagagcgaggccgccatggagagagccagacagcaggtggccagcctgatcggcgccgaccccagagagatcatcttcaccagcggcgccaccgagagcaacaacatcgccatcaagggcgtggccagattctacagaagcagaaagaagcacctgatcaccacccagaccgagcacaagtgcgtgctggacagctgcagaagcctggaggccgagggcttccaggtgacctacctgcccgtgcagaagagcggcatcatcgacctgaaggagctggaggccgccatccagcccgacaccagcctggtgagcgtgatgaccgtgaacaacgagatcggcgtgaagcagcccatcgccgagatcggcagaatctgcagcagcagaaaggtgtacttccacaccgacgccgcccaggccgtgggcaagatccccctggacgtgaacgacatgaagatcgacctgatgagcatcagcggccacaagatctacggccccaagggcgtgggcgccatctacatcagaagaagacccagagtgagagtggaggccctgcagagcggcggcggccaggagagaggcatgagaagcggcaccgtgcccacccccctggtggtgggcctgggcgccgcctgcgaggtggcccagcaggagatggagtacgaccacaagagaatcagcaagctgagcgagagactgatccagaacatcatgaagagcctgcccgacgtggtgatgaacggcgaccccaagcaccactaccccggctgcatcaacctgagcttcgcctacgtggagggcgagagcctgctgatggccctgaaggacgtggccctgagcagcggcagcgcctgcaccagcgccagcctggagcccagctacgtgctgagagccatcggcaccgacgaggacctggcccacagcagcatcagattcggcatcggcagattcaccaccgaggaggaggtggactacaccgtggagaagtgcatccagcacgtgaagagactgagagagatgagccccctgtgggagatggtgcaggacggcatcgacctgaagagcatcaagtggacccagcactag

SEQ ID NO: 91034 - DNA, 486 bp, Artificial Sequence
  Description of Artificial Sequence: Synthetic coding sequence
atgctgctgagagccgcctggagaagagccgccgtggccgtgaccgccgcccccggccccaagcccgccgcccccaccagaggcctgagactgagagtgggcgacagagccccccagagcgccgtgcccgccgacaccgccgccgcccccgaggtgggccccgtgctgagacccctgtacatggacgtgcaggccaccacccccctggaccccagagtgctggacgccatgctgccctacctgatcaactactacggcaacccccacagcagaacccacgcctacggctgggagagcgaggccgccatggagagagccagacagcaggtggccagcctgatcggcgccgaccccagagagatcatcttcaccagcggcgccaccgagagcaacaacatcgccatcaagggcgtggccagattctacagaagcagaaagaagcacctgatcaccaccctgagcggcggcgccggcggctgcgtgtag

SEQ ID NO: 91035 - DNA, 768 bp, Artificial Sequence
  Description of Artificial Sequence: Synthetic coding sequence
atgaccgtgaacaacgagatcggcgtgaagcagcccatcgccgagatcggcagaatctgcagcagcagaaaggtgtacttccacaccgacgccgcccaggccgtgggcaagatccccctggacgtgaacgacatgaagatcgacctgatgagcatcagcggccacaagatctacggccccaagggcgtgggcgccatctacatcagaagaagacccagagtgagagtggaggccctgcagagcggcggcggccaggagagaggcatgagaagcggcaccgtgcccacccccctggtggtgggcctgggcgccgcctgcgaggtggcccagcaggagatggagtacgaccacaagagaatcagcaagctgagcgagagactgatccagaacatcatgaagagcctgcccgacgtggtgatgaacggcgaccccaagcaccactaccccggctgcatcaacctgagcttcgcctacgtggagggcgagagcctgctgatggccctgaaggacgtggccctgagcagcggcagcgcctgcaccagcgccagcctggagcccagctacgtgctgagagccatcggcaccgacgaggacctggcccacagcagcatcagattcggcatcggcagattcaccaccgaggaggaggtggactacaccgtggagaagtgcatccagcacgtgaagagactgagagagatgagccccctgtgggagatggtgcaggacggcatcgacctgaagagcatcaagtggacccagcactag

SEQ ID NO: 91036 - DNA, 1221 bp, Artificial Sequence
  Description of Artificial Sequence: Synthetic coding sequence
atgctgctgagagccgcctggagaagagccgccgtggccgtgaccgccgcccccggccccaagcccgccgcccccaccagaggcctgagactgagagtgggcgacagagccccccagagcgccgtgcccgccgacaccgccgccgcccccgaggtgggccccgtgctgagacccctgtacatggacgtgcaggccaccacccccctggaccccagagtgctggacgccatgctgccctacctgatcaactactacggcaacccccacagcagaacccacgcctacggctgggagagcgaggccgccatggagagagccagacagcaggtggccagcctgatcggcgccgaccccagagagatcatcttcaccagcggcgccaccgagagcaacaacatcgccatcaaggagctggaggccgccatccagcccgacaccagcctggtgagcgtgatgaccgtgaacaacgagatcggcgtgaagcagcccatcgccgagatcggcagaatctgcagcagcagaaaggtgtacttccacaccgacgccgcccaggccgtgggcaagatccccctggacgtgaacgacatgaagatcgacctgatgagcatcagcggccacaagatctacggccccaagggcgtgggcgccatctacatcagaagaagacccagagtgagagtggaggccctgcagagcggcggcggccaggagagaggcatgagaagcggcaccgtgcccacccccctggtggtgggcctgggcgccgcctgcgaggtggcccagcaggagatggagtacgaccacaagagaatcagcaagctgagcgagagactgatccagaacatcatgaagagcctgcccgacgtggtgatgaacggcgaccccaagcaccactaccccggctgcatcaacctgagcttcgcctacgtggagggcgagagcctgctgatggccctgaaggacgtggccctgagcagcggcagcgcctgcaccagcgccagcctggagcccagctacgtgctgagagccatcggcaccgacgaggacctggcccacagcagcatcagattcggcatcggcagattcaccaccgaggaggaggtggactacaccgtggagaagtgcatccagcacgtgaagagactgagagagatgagccccctgtgggagatggtgcaggacggcatcgacctgaagagcatcaagtggacccagcactag

SEQ ID NO: 91037 - DNA, 693 bp, Artificial Sequence
  Description of Artificial Sequence: Synthetic coding sequence
atgctgaagaacccctacaccatcaagaagcagcccctgcaccagttcgtgcagagacccctgttccccctgcccgccgccttctaccaccccgtgagatacatgttcatccagacccaggacacccccaaccccaacagcctgaagttcatccccggcaagcccgtgctggagaccagaaccatggacttccccacccccgccgccgccttcagaagccccctggccagacagctgttcagaatcgagggcgtgaagagcgtgttcttcggccccgacttcatcaccgtgaccaaggagaacgaggagctggactggaacctgctgaagcccgacatctacgccaccatcatggacttcttcgccagcggcctgcccctggtgaccgaggagacccccagcggcgaggccggcagcgaggaggacgacgaggtggtggccatgatcaaggagctgctggacaccagaatcagacccaccgtgcaggaggacggcggcgacgtgatctacaagggcttcgaggacggcatcgtgcagctgaagctgcagggcagctgcaccagctgccccagcagcatcatcaccctgaagaacggcatccagaacatgctgcagttctacatccccgaggtggagggcgtggagcaggtgatggacgacgagagcgacgagaaggaggccaacagcccctag

SEQ ID NO: 91038 - DNA, 342 bp, Artificial Sequence
  Description of Artificial Sequence: Synthetic coding sequence
atggacttcttcgccagcggcctgcccctggtgaccgaggagacccccagcggcgaggccggcagcgaggaggacgacgaggtggtggccatgatcaaggagctgctggacaccagaatcagacccaccgtgcaggaggacggcggcgacgtgatctacaagggcttcgaggacggcatcgtgcagctgaagctgcagggcagctgcaccagctgccccagcagcatcatcaccctgaagaacggcatccagaacatgctgcagttctacatccccgaggtggagggcgtggagcaggtgatggacgacgagagcgacgagaaggaggccaacagcccctag

SEQ ID NO: 91039 - DNA, 765 bp, Artificial Sequence
  Description of Artificial Sequence: Synthetic coding sequence
atggccgccaccgccagaagaggctggggcgccgccgccgtggccgccggcctgagaagaagattctgccacatgctgaagaacccctacaccatcaagaagcagcccctgcaccagttcgtgcagagacccctgttccccctgcccgccgccttctaccaccccgtgagatacatgttcatccagacccaggacacccccaaccccaacagcctgaagttcatccccggcaagcccgtgctggagaccagaaccatggacttccccacccccgccgccgccttcagaagccccctggccagacagctgttcagaatcgagggcgtgaagagcgtgttcttcggccccgacttcatcaccgtgaccaaggagaacgaggagctggactggaacctgctgaagcccgacatctacgccaccatcatggacttcttcgccagcggcctgcccctggtgaccgaggagacccccagcggcgaggccggcagcgaggaggacgacgaggtggtggccatgatcaaggagctgctggacaccagaatcagacccaccgtgcaggaggacggcggcgacgtgatctacaagggcttcgaggacggcatcgtgcagctgaagctgcagggcagctgcaccagctgccccagcagcatcatcaccctgaagaacggcatccagaacatgctgcagttctacatccccgaggtggagggcgtggagcaggtgatggacgacgagagcgacgagaaggaggccaacagcccctag

SEQ ID NO: 91040 - DNA, 300 bp, Artificial Sequence
  Description of Artificial Sequence: Synthetic coding sequence
atggacttcttcgccagcggcctgcccctggtgaccgaggagacccccagcggcgaggccggcagcgaggaggacgacgaggtggtggccatgatcaaggagctgctggacaccagaatcagacccaccgtgcaggaggacggcggcgacgtgatctacaagggcttcgaggacggcatcgtgcagctgaagctgcagggcagctgcaccagctgccccagcagcatcatcaccctgaagaacggcatccagaacatgctgcagttctacatccccgaggtggagggcgtggagcagtag

SEQ ID NO: 91041 - DNA, 342 bp, Artificial Sequence; identical to SEQ ID NO: 91038
  Description of Artificial Sequence: Synthetic coding sequence

SEQ ID NO: 91042 - DNA, 291 bp, Artificial Sequence
  Description of Artificial Sequence: Synthetic coding sequence
atggacttcttcgccagcggcctgcccctggtgaccgaggagacccccagcggcgaggccggcagcgaggaggacgacgaggtggtggccatgatcaaggagctgctggacaccagaatcagacccaccgtgcaggaggacggcggcgacgtgatctacaagggcttcgaggacggcatcgtgcagctgaagctgcagggcagctgcaccagctgccccagcagcatcatcaccctgaagaacggcatccagaacatgctgcagttctacatccccgaggtggagggctag

SEQ ID NO: 91043 - DNA, 1464 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgcccgagggcagccccacctggctgggcatcagctgcagcagctacgagagaagcagcaacgccagagagccccacctgaagatccccaagtgcgccgccaccacctgcgtgcagagcctgggccagggcaagagcgacgtggtgggcagcctggccctgcagagcgtgggcgagagcagactgtggcagggccaccacgccaccgagagcgagcacagcctgagccccgccgacctgggcagccccgccagccccaaggagagcagcgaggccctggacgccgccgccgccctgagcgtggccgagtgcgtggagagaatggcccccaccctgcccaagagcgacctgaacgaggtgaaggagctgctgaagaccaacaagaagctggccaagatgatcggccacatcttcgagatgaacgacgacgacccccacaaggaggaggagatcagaaagtacagcgccatctacggcagattcgacagcaagagaaaggacggcaagcacctgaccctgcacgagctgaccgtgaacgaggccgccgcccagctgtgcgtgaaggacaacgccctgctgaccagaagagacgagctgttcgccctggccagacagatcagcagagaggtgacctacaagtacacctacagaaccaccaagagcaagtgcggcgagagagacgagctgagccccaagagaatcaaggtggaggacggcttccccgacttccaggacagcgtgcagaccctgttccagcaggccagagccaagagcgaggagctggccgccctgagcagccagcagcccgagaaggtgatggccaagcagatggagttcctgtgcaaccaggccggctacgagagactgcagcacgccgagagaagactgagcgccggcctgtacagacagagcagcgaggagcacagccccaacggcctgaccagcgacaacagcgacggccagggcgagagacccctgaacctgagaatgcccaacctgcagaacagacagccccaccacttcgtggtggacggcgagctgagcagactgtaccccagcgaggccaagagccacagcagcgagagcctgggcatcctgaaggactacccccacagcgccttcaccctggagaagaaggtgatcaagaccgagcccgaggacagcagatag

SEQ ID NO: 91044 - DNA, 1377 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgcccgagggcagccccacctggctgggcatcagctgcagcagctacgagagaagcagcaacgccagagagccccacctgaagatccccaagtgcgccgccaccacctgcgtgcagagcctgggccagggcaagagcgacgtggtgggcagcctggccctgcagagcgtgggcgagagcagactgtggcagggccaccacgccaccgagagcgagcacagcctgagccccgccgacctgggcagccccgccagccccaaggagagcagcgaggccctggacgccgccgccgccctgagcgtggccgagtgcgtggagagaatggcccccaccctgcccaagagcgacctgaacgaggtgaaggagctgctgaagaccaacaagaagctggccaagatgatcggccacatcttcgagatgaacgacgacgacccccacaaggaggaggagatcagaaagtacagcgccatctacggcagattcgacagcaagagaaaggacggcaagcacctgaccctgcacgagctgaccgtgaacgaggccgccgcccagctgtgcgtgaaggacaacgccctgctgaccagaagagacgagctgttcgccctggccagacagatcagcagagaggtgacctacaagtacacctacagaaccaccaagagcaagtgcggcgagagagacgagctgagccccaagagaatcaaggtggaggaccagcccgagaaggtgatggccaagcagatggagttcctgtgcaaccaggccggctacgagagactgcagcacgccgagagaagactgagcgccggcctgtacagacagagcagcgaggagcacagccccaacggcctgaccagcgacaacagcgacggccagggcgagagacccctgaacctgagaatgcccaacctgcagaacagacagccccaccacttcgtggtggacggcgagctgagcagactgtaccccagcgaggccaagagccacagcagcgagagcctgggcatcctgaaggactacccccacagcgccttcaccctggagaagaaggtgatcaagaccgagcccgaggacagcagatag

SEQ ID NO: 91045 - DNA, 1464 bp, Artificial Sequence; identical to SEQ ID NO: 91043
  Description of Artificial Sequence: Synthetic coding sequence

SEQ ID NO: 91046 - DNA, 1461 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgcccgagggcagccccacctggctgggcatcagctgcagcagctacgagagaagcagcaacgccagagagccccacctgaagatccccaagtgcgccgccaccacctgcgtgcagagcctgggccagggcaagagcgacgtggtgggcagcctggccctgcagagcgtgggcgagagcagactgtggcagggccaccacgccaccgagagcgagcacagcctgagccccgccgacctgggcagccccgccagccccaaggagagcagcgaggccctggacgccgccgccgccctgagcgtggccgagtgcgtggagagaatggcccccaccctgcccaagagcgacctgaacgaggtgaaggagctgctgaagaccaacaagaagctggccaagatgatcggccacatcttcgagatgaacgacgacgacccccacaaggaggaggagatcagaaagtacagcgccatctacggcagattcgacagcaagagaaaggacggcaagcacctgaccctgcacgagctgaccgtgaacgaggccgccgcccagctgtgcgtgaaggacaacgccctgctgaccagaagagacgagctgttcgccctggccagacagatcagcagagaggtgacctacaagtacacctacagaaccaccaagagcaagtgcggcgagagagacgagctgagccccaagagaatcaaggtggaggacggcttccccgacttccaggacagcgtgcagaccctgttccagcaggccagagccaagagcgaggagctggccgccctgagcagccagcccgagaaggtgatggccaagcagatggagttcctgtgcaaccaggccggctacgagagactgcagcacgccgagagaagactgagcgccggcctgtacagacagagcagcgaggagcacagccccaacggcctgaccagcgacaacagcgacggccagggcgagagacccctgaacctgagaatgcccaacctgcagaacagacagccccaccacttcgtggtggacggcgagctgagcagactgtaccccagcgaggccaagagccacagcagcgagagcctgggcatcctgaaggactacccccacagcgccttcaccctggagaagaaggtgatcaagaccgagcccgaggacagcagatag

SEQ ID NO: 91047 - DNA, 474 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgcccgagggcagccccacctggctgggcatcagctgcagcagctacgagagaagcagcaacgccagagagccccacctgaagatccccaagtgcgccgccaccacctgcgtgcagagcctgggccagggcaagagcgacgtggtgggcagcctggccctgcagagcgtgggcgagtag

SEQ ID NO: 91048 - DNA, 189 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagccctag

SEQ ID NO: 91049 - DNA, 303 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgccctag

SEQ ID NO: 91050 - DNA, 723 bp, Artificial Sequence
  Description of Artificial Sequence: Synthetic coding sequence
tgaaaggagctgctgaagaccaacaagaagctggccaagatgatcggccacatcttcgagatgaacgacgacgacccccacaaggaggaggagatcagaaagtacagcgccatctacggcagattcgacagcaagagaaaggacggcaagcacctgaccctgcacgagctgaccgtgaacgaggccgccgcccagctgtgcgtgaaggacaacgccctgctgaccagaagagacgagctgttcgccctggccagacagatcagcagagaggtgacctacaagtacacctacagaaccaccaagagcaagtgcggcgagagagacgagctgagccccaagagaatcaaggtggagcagcccgagaaggtgatggccaagcagatggagttcctgtgcaaccaggccggctacgagagactgcagcacgccgagagaagactgagcgccggcctgtacagacagagcagcgaggagcacagccccaacggcctgaccagcgacaacagcgacggccagggcgagagacccctgaacctgagaatgcccaacctgcagaacagacagccccaccacttcgtggtggacggcgagctgagcagactgtaccccagcgaggccaagagccacagcagcgagagcctgggcatcctgaaggactacccccacagcgccttcaccctggagaagaaggtgatcaagaccgagcccgaggacagcagatag

SEQ ID NO: 91051 - DNA, 459 bp, Artificial Sequence
  Description of Artificial Sequence: Synthetic coding sequence
atggccgccgccctgcccagaaccctgggcgagctgcagctgtacagaatcctgcagaaggccaacctgctgagctacttcgacgccttcatccagcagggcggcgacgacgtgcagcagctgtgcgaggccggcgaggaggagttcctggagatcatggccctggtgggcatggccagcaagcccctgcacgtgagaagactgcagaaggccctgagagactgggtgaccaaccccggcctgttcaaccagcccctgaccagcctgcccgtgagcagcatccccatctacaagctgcccgagggcagccccacctggctgggcatcagctgcagcagctacgagagaagcagcaacgccagagagccccacctgaagatccccaagtgcgccgccaccacctgcgtgcagagcctgggccagggcaagagcgacgtggtgggcagcctggccctgtag

SEQ ID NO: 91052 - DNA, 684 bp, Artificial Sequence
  Description of Artificial Sequence: Synthetic coding sequence
atgatcggccacatcttcgagatgaacgacgacgacccccacaaggaggaggagatcagaaagtacagcgccatctacggcagattcgacagcaagagaaaggacggcaagcacctgaccctgcacgagctgaccgtgaacgaggccgccgcccagctgtgcgtgaaggacaacgccctgctgaccagaagagacgagctgttcgccctggccagacagatcagcagagaggtgacctacaagtacacctacagaaccaccaagagcaagtgcggcgagagagacgagctgagccccaagagaatcaaggtggagcagcccgagaaggtgatggccaagcagatggagttcctgtgcaaccaggccggctacgagagactgcagcacgccgagagaagactgagcgccggcctgtacagacagagcagcgaggagcacagccccaacggcctgaccagcgacaacagcgacggccagggcgagagacccctgaacctgagaatgcccaacctgcagaacagacagccccaccacttcgtggtggacggcgagctgagcagactgtaccccagcgaggccaagagccacagcagcgagagcctgggcatcctgaaggactacccccacagcgccttcaccctggagaagaaggtgatcaagaccgagcccgaggacagcagatag

SEQ ID NO: 91053 - DNA, 1578 bp, Artificial Sequence
  Description of Artificial Sequence: Synthetic coding sequence
atgcacagagcccccagccccaccgccgagcagccccccggcggcggcgacagcgccagaagaaccctgcagcccagactgaagcccagcgccagagccatggccctgcccagaaccctgggcgagctgcagctgtacagagtgctgcagagagccaacctgctgagctactacgagaccttcatccagcagggcggcgacgacgtgcagcagctgtgcgaggccggcgaggaggagttcctggagatcatggccctggtgggcatggccaccaagcccctgcacgtgagaagactgcagaaggccctgagagagtgggccaccaaccccggcctgttcagccagcccgtgcccgccgtgcccgtgagcagcatccccctgttcaagatcagcgagaccgccggcaccagaaagggcagcatgagcaacggccacggcagccccggcgagaaggccggcagcgccagaagcttcagccccaagagccccctggagctgggcgagaagctgagccccctgcccggcggccccggcgccggcgaccccagaatctggcccggcagaagcacccccgagagcgacgtgggcgccggcggcgaggaggaggccggcagcccccccttcagcccccccgccggcggcggcgtgcccgagggcaccggcgccggcggcctggccgccggcggcaccggcggcggccccgacagactggagcccgagatggtgagaatggtggtggagagcgtggagagaatcttcagaagcttccccagaggcgacgccggcgaggtgaccagcctgctgaagctgaacaagaagctggccagaagcgtgggccacatcttcgagatggacgacaacgacagccagaaggaggaggagatcagaaagtacagcatcatctacggcagattcgacagcaagagaagagagggcaagcagctgagcctgcacgagctgaccatcaacgaggccgccgcccagttctgcatgagagacaacaccctgctgctgagaagagtggagctgttcagcctgagcagacaggtggccagagagagcacctacctgagcagcctgaagggcagcagactgcaccccgaggagctgggcggcccccccctgaagaagctgaagcaggaggtgggcgagcagagccaccccgagatccagcagcccccccccggccccgagagctacgtgcccccctacagacccagcctggaggaggacagcgccagcctgagcggcgagagcctggacggccacctgcaggccgtgggcagctgccccagactgacccccccccccgccgacctgcccctggccctgcccgcccacggcctgtggagcagacacatcctgcagcagaccctgatggacgagggcctgagactggccagactggtgagccacgacagagtgggcagactgagcccctgcgtgcccgccaagccccccctggccgagttcgaggagggcctgctggacagatgccccgcccccggcccccaccccgccctggtggagggcagaagaagcagcgtgaaggtggaggccgaggccagcagacagtag

SEQ ID NO: 91054 - DNA, 1386 bp, Artificial Sequence
  Description of Artificial Sequence: Synthetic coding sequence
atgcacagagcccccagccccaccgccgagcagccccccggcggcggcgacagcgccagaagaaccctgcagcccagactgaagcccagcgccagagccatggccctgcccagaaccctgggcgagctgcagctgtacagagtgctgcagagagccaacctgctgagctactacgagaccttcatccagcagggcggcgacgacgtgcagcagctgtgcgaggccggcgaggaggagttcctggagatcatggccctggtgggcatggccaccaagcccctgcacgtgagaagactgcagaaggccctgagagagtgggccaccaaccccggcctgttcagccagcccgtgcccgccgtgcccgtgagcagcatccccctgttcaagatcagcgagaccgccggcaccagaaagggcagcatgagcaacggccacggcagccccggcgagaaggccggcagcgccagaagcttcagccccaagagccccctggagctgggcgagaagctgagccccctgcccggcggccccggcgccggcgaccccagaatctggcccggcagaagcacccccgagagcgacgtgggcgccggcggcgaggaggaggccggcagcccccccttcagcccccccgccggcggcggcgtgcccgagggcaccggcgccggcggcctggccgccggcggcaccggcggcggccccgacagactggagcccgagatggtgagaatggtggtggagagcgtggagagaatcttcagaagcttccccagaggcgacgccggcgaggtgaccagcctgctgaagctgaacaagaagctggccagaagcgtgggccacatcttcgagatggacgacaacgacagccagaaggaggaggagatcagaaagtacagcatcatctacggcagattcgacagcaagagaagagagggcaagcagctgagcctgcacgagctgaccatcaacgaggccgccgcccagttctgcatgagagacaacaccctgctgctgagaagagtggagctgttcagcctgagcagacaggtggccagagagagcacctacctgagcagcctgaagggcagcagactgcaccccgaggagctgggcggcccccccctgaagaagctgaagcaggaggtgggcgagcagagccaccccgagatccagcagcccccccccggccccgagagctacgtgcccccctacagacccagcctggaggaggacagcgccagcctgagcggcgagagcctggacggccacctgcaggagttcgaggagggcctgctggacagatgccccgcccccggcccccaccccgccctggtggagggcagaagaagcagcgtgaaggtggaggccgaggccagcagacagtag

SEQ ID NO: 91055 - DNA, 969 bp, Artificial Sequence
  Description of Artificial Sequence: Synthetic coding sequence
atgcacagagcccccagccccaccgccgagcagccccccggcggcggcgacagcgccagaagaaccctgcagcccagactgaagcccagcgccagagccatggccctgcccagaaccctgggcgagctgcagctgtacagagtgctgcagagagccaacctgctgagctactacgagaccttcatccagcagggcggcgacgacgtgcagcagctgtgcgaggccggcgaggaggagttcctggagatcatggccctggtgggcatggccaccaagcccctgcacgtgagaagactgcagaaggccctgagagagtgggccaccaaccccggcctgttcagccagcccgtgcccgccgtgcccgtgagcagcatccccctgttcaagatcagcgagaccgccggcaccagaaagggcagcatgagcaacggccacggcagccccggcgagaaggccggcagcgccagaagcttcagccccaagagccccctggagctgggcgagaagctgagccccctgcccggcggccccggcgccggcgaccccagaatctggcccggcagaagcacccccgagagcgacgtgggcgccggcggcgaggaggaggccggcagcccccccttcagcccccccgccggcggcggcgtgcccgagggcaccggcgccggcggcctggccgccggcggcaccggcggcggccccgacagactggagcccgagatggtgagaatggtggtggagagcgtggagagaatcttcagaagcttccccagaggcgacgccggcgaggtgaccagcctgctgaagctgaacaagaagctggccagaagcgtgggccacatcttcgagatggacgacaacgacagccagaaggaggaggagatcagaaagtacagcatcatctacggcagattcgacagcaagagaagagagggcaagcagctgagcctgcacgaggccagcccctag

SEQ ID NO: 91056 - DNA, 723 bp, Artificial Sequence
  Description of Artificial Sequence: Synthetic coding sequence
tgaagcggcagcgccagccccgccgtggccgagctgtgccagaacacccccgagaccttcctggaggccagcaagctgctgctgacctacgccgacaacatcctgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaaggacatcatcaccctgagaaacttctggaagcaggacgtggacggcgtggccagcggccccatcgtgctgcactgcgccgccgagctgtag

SEQ ID NO: 91057 - DNA, 1965 bp, Artificial Sequence
  Description of Artificial Sequence: Synthetic coding sequence
atggccgccgccgccctgggcagcagcagcggcagcgccagccccgccgtggccgagctgtgccagaacacccccgagaccttcctggaggccagcaagctgctgctgacctacgccgacaacatcctgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaagggcatcaacatcagcgacgaggacttcctgctgctggagctgctgcactggttcaaggaggagttcttccactgggtgaacaacgtgctgtgcagcaagtgcggcggccagaccagaagcagagacagaagcctgctgcccagcgacgacgagctgaagtggggcgccaaggaggtggaggaccactactgcgacgcctgccagttcagcaacagattccccagatacaacaaccccgagaagctgctggagaccagatgcggcagatgcggcgagtgggccaactgcttcaccctgtgctgcagagccgtgggcttcgaggccagatacgtgtgggactacaccgaccacgtgtggaccgaggtgtacagccccagccagcagagatggctgcactgcgacgcctgcgaggacgtgtgcgacaagcccctgctgtacgagatcggctggggcaagaagctgagctacgtgatcgccttcagcaaggacgaggtggtggacgtgacctggagatacagctgcaagcacgaggaggtgatcgccagaagaaccaaggtgaaggaggccctgctgagagacaccatcaacggcctgaacaagcagagacagctgttcctgagcgagaacagaagaaaggagctgctgcagagaatcatcgtggagctggtggagttcatcagccccaagacccccaagcccggcgagctgggcggcagaatcagcggcagcgtggcctggagagtggccagaggcgagatgggcctgcagagaaaggagaccctgttcatcccctgcgagaacgagaagatcagcaagcagctgcacctgtgctacaacatcgtgaaggacagatacgtgagagtgagcaacaacaaccagaccatcagcggctgggagaacggcgtgtggaagatggagagcatcttcagaaaggtggagaccgactggcacatggtgtacctggccagaaaggagggcagcagcttcgcctacatcagctggaagttcgagtgcggcagcgtgggcctgaaggtggacagcatcagcatcagaaccagcagccagaccttccagaccggcaccgtggagtggaagctgagaagcgacaccgcccaggtggagctgaccggcgacaacagcctgcacagctacgccgacttcagcggcgccaccgaggtgatcctggaggccgagctgagcagaggcgacggcgacgtggcctggcagcacacccagctgttcagacagagcctgaacgaccacgaggagaactgcctggagatcatcatcaagttcagcgacctgtag

SEQ ID NO: 91058 - DNA, 1902 bp, Artificial Sequence
  Description of Artificial Sequence: Synthetic coding sequence
gccgccctgggcagcagcagcggcagcgccagccccgccgtggccgagctgtgccagaacacccccgagaccttcctggaggccagcaagctgctgctgacctacgccgacaacatcctgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaagggcatcaacatcagcgacgaggacttcctgctgctggagctgctgcactggttcaaggaggagttcttccactgggtgaacaacgtgctgtgcagcaagtgcggcggccagaccagaagcagagacagaagcctgctgcccagcgacgacgagctgaagtggggcgccaaggaggtggaggaccactactgcgacgcctgccagttcagcaacagattccccagatacaacaaccccgagaagctgctggagaccagatgcggcagatgcggcgagtgggccaactgcttcaccctgtgctgcagagccgtgggcttcgaggccagatacgtgtgggactacaccgagctgcagagaaccctgagcctgaagctgaccaccctgaaggagatcggcaagaccttcctgagaatcagcaagagacagaagctgatccaggtggtggacgtgacctggagatacagctgcaagcacgaggaggtgatcgccagaagaaccaaggtgaaggaggccctgctgagagacaccatcaacggcctgaacaagcagagacagctgttcctgagcgagaacagaagaaaggagctgctgcagagaatcatcgtggagctggtggagttcatcagccccaagacccccaagcccggcgagctgggcggcagaatcagcggcagcgtggcctggagagtggccagaggcgagatgggcctgcagagaaaggagaccctgttcatcccctgcgagaacgagaagatcagcaagcagctgcacctgtgctacaacatcgtgaaggacagatacgtgagagtgagcaacaacaaccagaccatcagcggctgggagaacggcgtgtggaagatggagagcatcttcagaaaggtggagaccgactggcacatggtgtacctggccagaaaggagggcagcagcttcgcctacatcagctggaagttcgagtgcggcagcgtgggcctgaaggtggacagcatcagcatcagaaccagcagccagaccttccagaccggcaccgtggagtggaagctgagaagcgacaccgcccaggtggagctgaccggcgacaacagcctgcacagctacgccgacttcagcggcgccaccgaggtgatcctggaggccgagctgagcagaggcgacggcgacgtggcctggcagcacacccagctgttcagacagagcctgaacgaccacgaggagaactgcctggagatcatcatcaagttcagcgacctgtag

SEQ ID NO: 91059 - DNA, 1677 bp, Artificial Sequence
  Description of Artificial Sequence: Synthetic coding sequence
atggccgccgccgccctgggcagcagcagcggcagcgccagccccgccgtggccgagctgtgccagaacacccccgagaccttcctggaggccagcaagctgctgctgacctacgccgacaacatcctgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaagggcatcaacatcagcgacgaggacttcctgctgctggagctgctgcactggttcaaggaggagttcttccactgggtgaacaacgtgctgtgcagcaagtgcggcggccagaccagaagcagagacagaagcctgctgcccagcgacgacgagctgaagtggggcgccaaggaggtggaggaccactactgcgacgcctgccagttcagcaacagattccccagatacaacaaccccgagaagctgctggagaccagatgcggcagatgcggcgagtgggccaactgcttcaccctgtgctgcagagccgtgggcttcgaggccagatacgtgtgggactacaccgaccacgtgtggaccgaggtgtacagccccagccagcagagatggctgcactgcgacgcctgcgaggacgtgtgcgacaagcccctgctgtacgagatcggctggggcaagaagctgagctacgtgatcgccttcagcaaggacgaggtggtggacgtgacctggagatacagctgcaagcacgaggaggtgatcgccagaagaaccaaggtgaaggaggccctgctgagagacaccatcaacggcctgaacaagcagagacagctgttcctgagcgagaacagaagaaaggagctgctgcagagaatcatcgtggagctggtggagttcatcagccccaagacccccaagcccggcgagctgggcggcagaatcagcggcagcgtggcctggagagtggccagaggcgagatgggcctgcagagaaaggagaccctgttcatcccctgcgagaacgagaagatcagcaagcagctgcacctgtgctacaacatcgtgaaggacagatacgtgagagtgagcaacaacaaccagaccatcagcggctgggagaacggcgtgtggaagatggagagcatcttcagaaaggtggagaccgactggcacatgatcaccgtgttcacccccatgctgatcttcctggtgcccctgaagctgttctggaagcagaactag

SEQ ID NO: 91060 - DNA, 1839 bp, Artificial Sequence
  Description of Artificial Sequence: Synthetic coding sequence
atgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaagggcatcaacatcagcgacgaggacttcctgctgctggagctgctgcactggttcaaggaggagttcttccactgggtgaacaacgtgctgtgcagcaagtgcggcggccagaccagaagcagagacagaagcctgctgcccagcgacgacgagctgaagtggggcgccaaggaggtggaggaccactactgcgacgcctgccagttcagcaacagattccccagatacaacaaccccgagaagctgctggagaccagatgcggcagatgcggcgagtgggccaactgcttcaccctgtgctgcagagccgtgggcttcgaggccagatacgtgtgggactacaccgaccacgtgtggaccgaggtgtacagccccagccagcagagatggctgcactgcgacgcctgcgaggacgtgtgcgacaagcccctgctgtacgagatcggctggggcaagaagctgagctacgtgatcgccttcagcaaggacgaggtggtggacgtgacctggagatacagctgcaagcacgaggaggtgatcgccagaagaaccaaggtgaaggaggccctgctgagagacaccatcaacggcctgaacaagcagagacagctgttcctgagcgagaacagaagaaaggagctgctgcagagaatcatcgtggagctggtggagttcatcagccccaagacccccaagcccggcgagctgggcggcagaatcagcggcagcgtggcctggagagtggccagaggcgagatgggcctgcagagaaaggagaccctgttcatcccctgcgagaacgagaagatcagcaagcagctgcacctgtgctacaacatcgtgaaggacagatacgtgagagtgagcaacaacaaccagaccatcagcggctgggagaacggcgtgtggaagatggagagcatcttcagaaaggtggagaccgactggcacatggtgtacctggccagaaaggagggcagcagcttcgcctacatcagctggaagttcgagtgcggcagcgtgggcctgaaggtggacagcatcagcatcagaaccagcagccagaccttccagaccggcaccgtggagtggaagctgagaagcgacaccgcccaggtggagctgaccggcgacaacagcctgcacagctacgccgacttcagcggcgccaccgaggtgatcctggaggccgagctgagcagaggcgacggcgacgtggcctggcagcacacccagctgttcagacagagcctgaacgaccacgaggagaactgcctggagatcatcatcaagttcagcgacctgtag

SEQ ID NO: 91061 - DNA, 516 bp, Artificial Sequence
  Description of Artificial Sequence: Synthetic coding sequence
atgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaaggacatcatcaccctgagaaacttctggaagcaggacgtggacggcgtggccagcggccccatcgtgctgcactgcgccgccgagctgtag

SEQ ID NO: 91062 - DNA, 1911 bp, Artificial Sequence
  Description of Artificial Sequence: Synthetic coding sequence
atggccgccgccgccctgggcagcagcagcggcagcgccagccccgccgtggccgagctgtgccagaacacccccgagaccttcctggaggccagcaagctgctgctgacctacgccgacaacatcctgagaaaccccaacgacgagaagtacagaagcatcagaatcggcaacaccgccttcagcaccagactgctgcccgtgagaggcgccgtggagtgcctgttcgagatgggcttcgaggagggcgagacccacctgatcttccccaagaaggccagcgtggagcagctgcagaagatcagagacctgatcgccatcgagagaagcagcagactggacggcagcaacaagagccacaaggtgaagagcagccagcagcccgccgccagcacccagctgcccaccacccccagcagcaaccccagcggcctgaaccagcacaccagaaacagacagggccagagcagcgacccccccagcgccagcaccgtggccgccgacagcgccatcctggaggtgctgcagagcaacatccagcacgtgctggtgtacgagaaccccgccctgcaggagaaggccctggcctgcatccccgtgcaggagctgaagagaaagagccaggagaagctgagcagagccagaaagctggacaagggcatcaacatcagcgacgaggacttcctgctgctggagctgctgcactggttcaaggaggagttcttccactgggtgaacaacgtgctgtgcagcaagtgcggcggccagaccagaagcagagacagaagcctgctgcccagcgacgacgagctgaagtggggcgccaaggaggtggaggaccactactgcgacgcctgccagttcagcaacagattccccagatacaacaaccccgagaagctgctggagaccagatgcggcagatgcggcgagtgggccaactgcttcaccctgtgctgcagagccgtgggcttcgaggccagatacgtgtgggactacaccgagctgcagagaaccctgagcctgaagctgaccaccctgaaggagatcggcaagaccttcctgagaatcagcaagagacagaagctgatccaggtggtggacgtgacctggagatacagctgcaagcacgaggaggtgatcgccagaagaaccaaggtgaaggaggccctgctgagagacaccatcaacggcctgaacaagcagagacagctgttcctgagcgagaacagaagaaaggagctgctgcagagaatcatcgtggagctggtggagttcatcagccccaagacccccaagcccggcgagctgggcggcagaatcagcggcagcgtggcctggagagtggccagaggcgagatgggcctgcagagaaaggagaccctgttcatcccctgcgagaacgagaagatcagcaagcagctgcacctgtgctacaacatcgtgaaggacagatacgtgagagtgagcaacaacaaccagaccatcagcggctgggagaacggcgtgtggaagatggagagcatcttcagaaaggtggagaccgactggcacatggtgtacctggccagaaaggagggcagcagcttcgcctacatcagctggaagttcgagtgcggcagcgtgggcctgaaggtggacagcatcagcatcagaaccagcagccagaccttccagaccggcaccgtggagtggaagctgagaagcgacaccgcccaggtggagctgaccggcgacaacagcctgcacagctacgccgacttcagcggcgccaccgaggtgatcctggaggccgagctgagcagaggcgacggcgacgtggcctggcagcacacccagctgttcagacagagcctgaacgaccacgaggagaactgcctggagatcatcatcaagttcagcgacctgtag

SEQ ID NO: 91063 - DNA, 1188 bp, Artificial Sequence
  Description of Artificial Sequence: Synthetic coding sequence
atggccgccgaggccagcgagagcggccccgccctgcacgagctgatgagagaggccgagatcagcctgctggagtgcaaggtgtgcttcgagaagttcggccacagacagcagagaagacccagaaacctgagctgcggccacgtggtgtgcctggcctgcgtggccgccctggcccaccccagaaccctggccctggagtgccccttctgcagaagagcctgcagaggctgcgacaccagcgactgcctgcccgtgctgcacctgatcgagctgctgggcagcgccctgagacagagccccgccgcccacagagccgcccccagcgcccccggcgccctgacctgccaccacaccttcggcggctggggcaccctggtgaaccccaccggcctggccctgtgccccaagaccggcagagtggtggtggtgcacgacggcagaagaagagtgaagatcttcgacagcggcggcggctgcgcccaccagttcggcgagaagggcgacgccgcccaggacatcagataccccgtggacgtgaccatcaccaacgactgccacgtggtggtgaccgacgccggcgacagaagcatcaaggtgttcgacttcttcggccagatcaagctggtgatcggcggccagttcagcctgccctggggcgtggagaccaccccccagaacggcatcgtggtgaccgacgccgaggccggcagcctgcacctgctggacgtggacttcgccgagggcgtgctgagaagaaccgagagactgcaggcccacctgtgcaaccccagaggcgtggccgtgagctggctgaccggcgccatcgccgtgctggagcaccccctggccctgggcaccggcgtgtgcagcaccagagtgaaggtgttcagcagcagcatgcagctggtgggccaggtggacaccttcggcctgagcctgtacttccccagcaagatcaccgccagcgccgtgaccttcgaccaccagggcaacgtgatcgtggccgacaccagcggccccgccatcctgtgcctgggcaagcccgaggagttccccgtgcccaagcccatggtgacccacggcctgagccaccccgtggccctgaccttcaccaaggagaacagcctgctggtgctggacaccgccagccacagcatcaaggtgtacaaggtggactggggctag

SEQ ID NO: 91064 - DNA, 903 bp, Artificial Sequence
  Description of Artificial Sequence: Synthetic coding sequence
atggccgccgccgccggcgacgccgacgacgagcccagaagcggccacagcagcagcgagggcgagtgcgccgtggcccccgagcccctgaccgacgccgagggcctgttcagcttcgccgacttcggcagcgccctgggcggcggcggcgccggcctgagcggcagagccagcggcggcgcccagagccccctgagatacctgcacgtgctgtggcagcaggacgccgagcccagagacgagctgagatgcaagatccccgccggcagactgagaagagccgccagaccccacagaagactgggccccaccggcaaggaggtgcacgccctgaagagactgagagacagcgccaacgccaacgacgtggagaccgtgcagcagctgctggaggacggcgccgacccctgcgccgccgacgacaagggcagaaccgccctgcacttcgccagctgcaacggcaacgaccagatcgtgcagctgctgctggaccacggcgccgaccccaaccagagagacggcctgggcaacacccccctgcacctggccgcctgcaccaaccacgtgcccgtgatcaccaccctgctgagaggcggcgccagagtggacgccctggacagagccggcagaacccccctgcacctggccaagagcaagctgaacatcctgcaggagggccacgcccagtgcctggaggccgtgagactggaggtgaagcagatcatccacatgctgagagagtacctggagagactgggccagcacgagcagagagagagactggacgacctgtgcaccagactgcagatgaccagcaccaaggagcaggtggacgaggtgaccgacctgctggccagcttcaccagcctgagcctgcagatgcagagcatggagaagagatag

SEQ ID NO: 91065 - DNA, 387 bp, Artificial Sequence
  Description of Artificial Sequence: Synthetic coding sequence
atgaccgaggccgacgtgaaccccaaggcctaccccctggccgacgcccacctgaccaagaagctgctggacctggtgcagcagagctgcaactacaagcagctgagaaagggcgccaacgaggccaccaagaccctgaacagaggcatcagcgagttcatcgtgatggccgccgacgccgagcccctggagatcatcctgcacctgcccctgctgtgcgaggacaagaacgtgccctacgtgttcgtgagaagcaagcaggccctgggcagagcctgcggcgtgagcagacccgtgatcgcctgcagcgtgaccatcaaggagggcagccagctgaagcagcagatccagagcatccagcagagcatcgagagactgctggtgtag

SEQ ID NO: 91066 - DNA, 387 bp, Artificial Sequence; identical to SEQ ID NO: 91065
  Description of Artificial Sequence: Synthetic coding sequence

SEQ ID NO: 91067 - DNA, 399 bp, Artificial Sequence
  Description of Artificial Sequence: Synthetic coding sequence
atgctgctggtgcagaccgaggccgacgtgaaccccaaggcctaccccctggccgacgcccacctgaccaagaagctgctggacctggtgcagcagagctgcaactacaagcagctgagaaagggcgccaacgaggccaccaagaccctgaacagaggcatcagcgagttcatcgtgatggccgccgacgccgagcccctggagatcatcctgcacctgcccctgctgtgcgaggacaagaacgtgccctacgtgttcgtgagaagcaagcaggccctgggcagagcctgcggcgtgagcagacccgtgatcgcctgcagcgtgaccatcaaggagggcagccagctgaagcagcagatccagagcatccagcagagcatcgagagactgctggtgtag

SEQ ID NO: 91068 - DNA, 2130 bp, Artificial Sequence
  Description of Artificial Sequence: Synthetic coding sequence
atggccaccgccggcggcggcagcggcgccgaccccggcagcagaggcctgctgagactgctgagcttctgcgtgctgctggccggcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagagacctgatggagaagctgaagggcagaaccagcagaatcgccggcctggccgtgagcctgaccaagcccagccccgccagcggcttcagccccagcgtgcagtgccccaacgacggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcagtgctaccaggaccacaacctgagccagaacggcagcgcccccaccttccccctgtgcgccatgcagctgttcagccacatgcacgccgtgatcagcaccgccacctgcatgagaagaagcagcatccagagcaccttcagcatcaaccccgagatcgtgtgcgaccccctgagcgactacaacgtgtggagcatgctgaagcccatcaacaccaccggcaccctgaagcccgacgacagagtggtggtggccgccaccagactggacagcagaagcttcttctggaacgtggcccccggcgccgagagcgccgtggccagcttcgtgacccagctggccgccgccgaggccctgcagaaggcccccgacgtgaccaccctgcccagaaacgtgatgttcgtgttcttccagggcgagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggacctgtacgagtacagctgggtgcagggccccctgcacagcaacgagaccgacagactgcccagatgcgtgagaagcaccgccagactggccagagccctgagccccgccttcgagctgagccagtggagcagcaccgagtacagcacctggaccgagagcagatggaaggacatcagagccagaatcttcctgatcgccagcaaggagctggagctgatcaccctgaccgtgggcttcggcatcctgatcttcagcctgatcgtgacctactgcatcaacgccaaggccgacgtgctgttcatcgcccccagagagcccggcgccgtgagctactag

SEQ ID NO: 91069 - DNA, 2070 bp, Artificial Sequence
  Description of Artificial Sequence: Synthetic coding sequence
atggacttcaacctgatcctggagagcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagagacctgatggagaagctgaagggcagaaccagcagaatcgccggcctggccgtgagcctgaccaagcccagccccgccagcggcttcagccccagcgtgcagtgccccaacgacggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcagtgctaccaggaccacaacctgagccagaacggcagcgcccccaccttccccctgtgcgccatgcagctgttcagccacatgcacgccgtgatcagcaccgccacctgcatgagaagaagcagcatccagagcaccttcagcatcaaccccgagatcgtgtgcgaccccctgagcgactacaacgtgtggagcatgctgaagcccatcaacaccaccggcaccctgaagcccgacgacagagtggtggtggccgccaccagactggacagcagaagcttcttctggaacgtggcccccggcgccgagagcgccgtggccagcttcgtgacccagctggccgccgccgaggccctgcagaaggcccccgacgtgaccaccctgcccagaaacgtgatgttcgtgttcttccagggcgagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggacctgtacgagtacagctgggtgcagggccccctgcacagcaacgagaccgacagactgcccagatgcgtgagaagcaccgccagactggccagagccctgagccccgccttcgagctgagccagtggagcagcaccgagtacagcacctggaccgagagcagatggaaggacatcagagccagaatcttcctgatcgccagcaaggagctggagctgatcaccctgaccgtgggcttcggcatcctgatcttcagcctgatcgtgacctactgcatcaacgccaaggccgacgtgctgttcatcgcccccagagagcccggcgccgtgagctactag

SEQ ID NO: 91070 - DNA, 1356 bp, Artificial Sequence
  Description of Artificial Sequence: Synthetic coding sequence
atgctgaagcccatcaacaccaccggcaccctgaagcccgacgacagagtggtggtggccgccaccagactggacagcagaagcttcttctggaacgtggcccccggcgccgagagcgccgtggccagcttcgtgacccagctggccgccgccgaggccctgcagaaggcccccgacgtgaccaccctgcccagaaacgtgatgttcgtgttcttccagggcgagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggacctgtacgagtacagctgggtgcagggccccctgcacagcaacgagaccgacagactgcccagatgcgtgagaagcaccgccagactggccagagccctgagccccgccttcgagctgagccagtggagcagcaccgagtacagcacctggaccgagagcagatggaaggacatcagagccagaatcttcctgatcgccagcaaggagctggagctgatcaccctgaccgtgggcttcggcatcctgatcttcagcctgatcgtgacctactgcatcaacgccaaggccgacgtgctgttcatcgcccccagagagcccggcgccgtgagctactag

SEQ ID NO: 91071 - DNA, 918 bp, Artificial Sequence
  Description of Artificial Sequence: Synthetic coding sequence
atgctgaagcccatcaacaccaccggcaccctgaagcccgacgacagagtggtggtggccgccaccagactggacagcagaagcttcttctggaacgtggcccccggcgccgagagcgccgtggccagcttcgtgacccagctggccgccgccgaggccctgcagaaggcccccgacgtgaccaccctgcccagaaacgtgatgttcgtgttcttccagggcgtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggactag

SEQ ID NO: 91072 - DNA, 2070 bp, Artificial Sequence; identical to SEQ ID NO: 91069
  Description of Artificial Sequence: Synthetic coding sequence

SEQ ID NO: 91073 - DNA, 768 bp, Artificial Sequence
  Description of Artificial Sequence: Synthetic coding sequence
atggccaccgccggcggcggcagcggcgccgaccccggcagcagaggcctgctgagactgctgagcttctgcgtgctgctggccggcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagagacctgatggagaagctgaagggcagaaccagcagaatcgccggcctggccgtgagcctgaccaagcccagccccgccagcggcttcagccccagcgtgcagtgccccaacgacggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcaggagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccagtag

SEQ ID NO: 91074 - DNA, 963 bp, Artificial Sequence
  Description of Artificial Sequence: Synthetic coding sequence
tgaggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcagctgttcagccacatgcacgccgtgatcagcaccgccacctgcatgagaagaagcagcatccagagcaccttcagcatcaaccccgagatcgtgtgcgaccccctgagcgactacaacgtgtggagcatgctgaagcccatcaacaccaccggcaccctgaagcccgacgacagagtggtggtggccgccaccagactggacagcagaagcttcttctggaacgtggcccccggcgccgagagcgccgtggccagcttcgtgacccagctggccgccgccgaggccctgcagaaggcccccgacgtgaccaccctgcccagaaacgtgatgttcgtgttcttccagggcgagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgcctag

SEQ ID NO: 91075 - DNA, 660 bp, Artificial Sequence
  Description of Artificial Sequence: Synthetic coding sequence
agaagcagcatccagagcaccttcagcatcaaccccgagatcgtgtgcgaccccctgagcgactacaacgtgtggagcatgctgaagcccatcaacaccaccggcaccctgaagcccgacgacagagtggtggtggccgccaccagactggccgccgccgaggccctgcagaaggcccccgacgtgaccaccctgcccagaaacgtgatgttcgtgttcttccagggcgagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggagtag

SEQ ID NO: 91076 - DNA, 828 bp, Artificial Sequence
  Description of Artificial Sequence: Synthetic coding sequence
tgaaacgtggcccccggcgccgagagcgccgtggccagcttcgtgacccagctggccgccgccgaggccctgcagaaggcccccgacgtgaccaccctgcccagaaacgtgatgttcgtgttcttccagggcgtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggactag

SEQ ID NO: 91077 - DNA, 405 bp, Artificial Sequence
  Description of Artificial Sequence: Synthetic coding sequence
atggccaccgccggcggcggcagcggcgccgaccccggcagcagaggcctgctgagactgctgagcttctgcgtgctgctggccggcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagacagaacgtgagactgagcgacaccttcctgtgcagcttcatggagttcctgagctacagcagagacctgatggagaagctgaagggctag

SEQ ID NO: 91078 - DNA, 699 bp, Artificial Sequence
  Description of Artificial Sequence: Synthetic coding sequence
atggccaccgccggcggcggcagcggcgccgaccccggcagcagaggcctgctgagactgctgagcttctgcgtgctgctggccggcctgttcctggacttcgagcccgaccccctgcccctgtgccccgacgtgagcttcttcccccagccccagccccccaccccccagagcaagggcaccggcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagagacctgatggagaagctgaagggcagaaccagcagaatcgccggcctggccgtgagcctgaccaagcccagccccgccagcggcttcagccccagcgtgcagtgccccaacgacggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcagtgctaccaggaccactag

SEQ ID NO: 91079 - DNA, 1716 bp, Artificial Sequence
  Description of Artificial Sequence: Synthetic coding sequence
atggccaccgccggcggcggcagcggcgccgaccccggcagcagaggcctgctgagactgctgagcttctgcgtgctgctggccggcctgtgcagaggcaacagcgtggagagaaagatctacatccccctgaacaagaccgccccctgcgtgagactgctgaacgccacccaccagatcggctgccagagcagcatcagcggcgacaccggcgtgatccacgtggtggagaaggaggaggacctgcagtgggtgctgaccgacggccccaaccccccctacatggtgctgctggagagcaagcacttcaccagagacctgatggagaagctgaagggcagaaccagcagaatcgccggcctggccgtgagcctgaccaagcccagccccgccagcggcttcagccccagcgtgcagtgccccaacgacggcttcggcgtgtacagcaacagctacggccccgagttcgcccactgcagagagatccagtggaacagcctgggcaacggcctggcctacgaggacttcagcttccccatcttcctgctggaggacgagaacgagaccaaggtgatcaagcaggagaccttcgactacatcggcagcagcagaatggtgtacgacatggagaagggcaagttccccgtgcagctggagaacgtggacagcttcgtggagctgggccaggtggccctgagaaccagcctggagctgtggatgcacaccgaccccgtgagccagaagaacgagagcgtgagaaaccaggtggaggacctgctggccaccctggagaagagcggcgccggcgtgcccgccgtgatcctgagaagacccaaccagagccagcccctgccccccagcagcctgcagagattcctgagagccagaaacatcagcggcgtggtgctggccgaccacagcggcgccttccacaacaagtactaccagagcatctacgacaccgccgagaacatcaacgtgagctaccccgagtggctgagccccgaggaggacctgaacttcgtgaccgacaccgccaaggccctggccgacgtggccaccgtgctgggcagagccctgtacgagctggccggcggcaccaacttcagcgacaccgtgcaggccgacccccagaccgtgaccagactgctgtacggcttcctgatcaaggccaacaacagctggttccagagcatcctgagacaggacctgagaagctacctgggcgacggccccctgcagcactacatcgccgtgagcagccccaccaacaccacctacgtggtgcagtacgccctggccaacctgaccggcaccgtggtgaacctgaccagagagcagtgccaggaccccagcaaggtgcccagcgagaacaaggacctgtacgagtacagctgggtgcagggccccctgcacagcaacgagaccgacagactgcccagatgcgtgagaagcaccgccagactggccagagccctgagccccgccttcgagctgagccagtggagcagcaccgagtacagcacctggaccgagagcagatggaaggacatcagagccagaatcttcctgatcgccagcaaggagctggagctgatcaccctgaccgtgggcttcggcatcctgatcttcagcctgatcgtgacctactgcatcaacgccaaggccgacgtgctgttcatcgcccccagagagcccggcgccgtgagctactag

SEQ ID NO: 91080 - DNA, 642 bp, Artificial Sequence
  Description of Artificial Sequence: Synthetic coding sequence
atgagcagagtgctggtgccctgccacgtgaagggcagcgtggccctgcaggtgggcgacgtgagaaccagccagggcagacccggcgtgctggtgatcgacgtgaccttccccagcgtggcccccttcgagctgcaggagatcaccttcaagaactactacaccgccttcctgagcatcagagtgagacagtacaccagcgcccacacccccgccaagtgggtgacctgcctgagagactactgcctgatgcccgacccccacagcgaggagggcgcccaggagtacgtgagcctgttcaagcaccagatgctgtgcgacatggccagaatcagcgagctgagactgatcctgagacagcccagccccctgtggctgagcttcaccgtggaggagctgcagatctaccagcagggccccaagagccccagcgtgaccttccccaagtggctgagccaccccgtgccctgcgagcagcccgccctgctgagagagggcctgcccgaccccagcagagtgagcagcgaggtgcagcagatgtgggccctgaccgagatgatcagagccagccacaccagcgccagaatcggcagattcgacgtggacggctgctacgacctgaacctgctgagctacacctag

SEQ ID NO: 91081 - DNA, 642 bp, Artificial Sequence; identical to SEQ ID NO: 91080
  Description of Artificial Sequence: Synthetic coding sequence

SEQ ID NO: 91082 - DNA, 528 bp, Artificial Sequence
  Description of Artificial Sequence: Synthetic coding sequence
atgagcagagtgctggtgccctgccacgtgaagggcagcgtggccctgcaggtgggcgacgtgagaaccagccagggcagacccggcgtgctggtgatcgacgtgaccttccccagcgtggcccccttcgagctgcaggagatcaccttcaagaactactacaccgccttcctgagcatcagagtgagacagtacaccagcgcccacacccccgccaagtgggtgacctgcctgagagactactgcctgatgcccgacccccacagcgaggagggcgcccaggagtacgtgagcctgttcaagcaccagagccccagcgtgaccttccccaagtggctgagccaccccgtgccctgcgagcagcccgccctgctgagagagggcctgcccgaccccagcagagtgagcagcgaggtgcagcagatgtgggccctgaccgagatgatcagagccagccacaccagcgccagaatcggcagattcgacgtggacggctgctacgacctgaacctgctgagctacacctag

SEQ ID NO: 91083 - DNA, 795 bp, Artificial Sequence
  Description of Artificial Sequence: Synthetic coding sequence
atggagagcggcttcaccagcaaggacacctacctgagccacttcaaccccagagactacctggagaagtactacaagttcggcagcagacacagcgccgagagccagatcctgaagcacctgctgaagaacctgttcaagatcttctgcctggacggcgtgaagggcgacctgctgatcgacatcggcagcggccccaccatctaccagctgctgagcgcctgcgagagcttcaaggagatcgtggtgaccgactacagcgaccagaacctgcaggagctggagaagtggctgaagaaggagcccgaggccttcgactggagccccgtggtgacctacgtgtgcgacctggagggcaacagagtgaagggccccgagaaggaggagaagctgagacaggccgtgaagcaggtgctgaagtgcgacgtgacccagagccagcccctgggcgccgtgcccctgccccccgccgactgcgtgctgagcaccctgtgcctggacgccgcctgccccgacctgcccacctactgcagagccctgagaaacctgggcagcctgctgaagcccggcggcttcctggtgatcatggacgccctgaagagcagctactacatgatcggcgagcagaagttcagcagcctgcccctgggcagagaggccgtggaggccgccgtgaaggaggccggctacaccatcgagtggttcgaggtgatcagccagagctacagcagcaccatggccaacaacgagggcctgttcagcctggtggccagaaagctgagcagacccctgtag

SEQ ID NO: 91084 - DNA, 795 bp, Artificial Sequence; identical to SEQ ID NO: 91083
  Description of Artificial Sequence: Synthetic coding sequence

SEQ ID NO: 91085 - DNA, 759 bp, Artificial Sequence
  Description of Artificial Sequence: Synthetic coding sequence
atgaagagcagaatccccgtggtgctgctggcctgcggcagcttcaaccccatcaccaacatgcacctgagaatgttcgaggtggccagagaccacctgcaccagaccggcatgtaccaggtgatccagggcatcatcagccccgtgaacgacacctacggcaagaaggacctggccgccagccaccacagagtggccatggccagactggccctgcagaccagcgactggatcagagtggacccctgggagagcgagcaggcccagtggatggagaccgtgaaggtgctgagacaccaccacagcaagctgctgagaagccccccccagatggagggccccgaccacggcaaggccctgttcagcacccccgccgccgtgcccgagctgaagctgctgtgcggcgccgacgtgctgaagaccttccagacccccaacctgtggaaggacgcccacatccaggagatcgtggagaagttcggcctggtgtgcgtgggcagagtgggccacgaccccaagggctacatcgccgagagccccatcctgagaatgcaccagcacaacatccacctggccaaggagcccgtgcagaacgagatcagcgccacctacatcagaagagccctgggccagggccagagcgtgaagtacctgatccccgacgccgtgatcacctacatcaaggaccacggcctgtacaccaagggcagcacctggaagggcaagagcacccagagcaccgagggcaagaccagctag

SEQ ID NO: 91086 - DNA, 648 bp, Artificial Sequence
  Description of Artificial Sequence: Synthetic coding sequence
atgtaccaggtgatccagggcatcatcagccccgtgaacgacacctacggcaagaaggacctggccgccagccaccacagagtggccatggccagactggccctgcagaccagcgactggatcagagtggacccctgggagagcgagcaggcccagtggatggagaccgtgaaggtgctgagacaccaccacagcaagctgctgagaagccccccccagatggagggccccgaccacggcaaggccctgttcagcacccccgccgccgtgcccgagctgaagctgctgtgcggcgccgacgtgctgaagaccttccagacccccaacctgtggaaggacgcccacatccaggagatcgtggagaagttcggcctggtgtgcgtgggcagagtgggccacgaccccaagggctacatcgccgagagccccatcctgagaatgcaccagcacaacatccacctggccaaggagcccgtgcagaacgagatcagcgccacctacatcagaagagccctgggccagggccagagcgtgaagtacctgatccccgacgccgtgatcacctacatcaaggaccacggcctgtacaccaagggcagcacctggaagggcaagagcacccagagcaccgagggcaagaccagctag

SEQ ID NO: 91087 - DNA, 648 bp, Artificial Sequence; identical to SEQ ID NO: 91086
  Description of Artificial Sequence: Synthetic coding sequence

SEQ ID NO: 91088 - DNA, 429 bp, Artificial Sequence
  Description of Artificial Sequence: Synthetic coding sequence
atggagggccccgaccacggcaaggccctgttcagcacccccgccgccgtgcccgagctgaagctgctgtgcggcgccgacgtgctgaagaccttccagacccccaacctgtggaaggacgcccacatccaggagatcgtggagaagttcggcctggtgtgcgtgggcagagtgggccacgaccccaagggctacatcgccgagagccccatcctgagaatgcaccagcacaacatccacctggccaaggagcccgtgcagaacgagatcagcgccacctacatcagaagagccctgggccagggccagagcgtgaagtacctgatccccgacgccgtgatcacctacatcaaggaccacggcctgtacaccaagggcagcacctggaagggcaagagcacccagagcaccgagggcaagaccagctag

SEQ ID NO: 91089 - DNA, 345 bp, Artificial Sequence
  Description of Artificial Sequence: Synthetic coding sequence
atgaagagcagaatccccgtggtgctgctggcctgcggcagcttcaaccccatcaccaacatgcacctgagaatgttcgaggtggccagagaccacctgcaccagaccggcatgtaccaggtgatccagggcatcatcagccccgtgaacgacacctacggcaagaaggacctggccgccagccaccacagagtggccatggccagactggccctgcagaccagcgactggatcagagtggacccctgggagagcgagcaggcccagtggatggagaccgtgaaggtgctgagacaccaccacagcaagctgctgagaagccccccccagatggagggcccctag

SEQ ID NO: 91090 - DNA, 492 bp, Artificial Sequence
  Description of Artificial Sequence: Synthetic coding sequence
atgaagagcagaatccccgtggtgctgctggcctgcggcagcttcaaccccatcaccaacatgcacctgagaatgttcgaggtggccagagaccacctgcaccagaccgccgtgcccgagctgaagctgctgtgcggcgccgacgtgctgaagaccttccagacccccaacctgtggaaggacgcccacatccaggagatcgtggagaagttcggcctggtgtgcgtgggcagagtgggccacgaccccaagggctacatcgccgagagccccatcctgagaatgcaccagcacaacatccacctggccaaggagcccgtgcagaacgagatcagcgccacctacatcagaagagccctgggccagggccagagcgtgaagtacctgatccccgacgccgtgatcacctacatcaaggaccacggcctgtacaccaagggcagcacctggaagggcaagagcacccagagcaccgagggcaagaccagctag

SEQ ID NO: 91091 - DNA, 3261 bp, Artificial Sequence
  Description of Artificial Sequence: Synthetic coding sequence
atggccaacctgctgaagaccgtggtgaccggctgcagctgccccctgctgagcaacctgggcagctgcaagggcctgagagtgaagaaggacttcctgagaaccttctacacccaccaggagctgtggtgcaaggcccccgtgaagcccggcatcccctacaagcagctgaccgtgggcgtgcccaaggagatcttccagaacgagaagagagtggccctgagccccgccggcgtgcagaacctggtgaagcagggcttcaacgtggtggtggagagcggcgccggcgaggccagcaagttcagcgacgaccactacagagtggccggcgcccagatccagggcgccaaggaggtgctggccagcgacctggtggtgaaggtgagagcccccatggtgaaccccaccctgggcgtgcacgaggccgacctgctgaagaccagcggcaccctgatcagcttcatctaccccgcccagaaccccgagctgctgaacaagctgagccagagaaagaccaccgtgctggccatggaccaggtgcccagagtgaccatcgcccagggctacgacgccctgagcagcatggccaacatcgccggctacaaggccgtggtgctggccgccaaccacttcggcagattcttcaccggccagatcaccgccgccggcaaggtgccccccgccaagatcctgatcgtgggcggcggcgtggccggcctggccagcgccggcgccgccaagagcatgggcgccatcgtgagaggcttcgacaccagagccgccgccctggagcagttcaagagcctgggcgccgagcccctggaggtggacctgaaggagagcggcgagggccagggcggctacgccaaggagatgagcaaggagttcatcgaggccgagatgaagctgttcgcccagcagtgcaaggaggtggacatcctgatcagcaccgccctgatccccggcaagaaggcccccgtgctgttcaacaaggagatgatcgagagcatgaaggagggcagcgtggtggtggacctggccgccgaggccggcggcaacttcgagaccaccaagcccggcgagctgtacatccacaagggcatcacccacatcggctacaccgacctgcccagcagaatggccacccaggccagcaccctgtacagcaacaacatcaccaagctgctgaaggccatcagccccgacaaggacaacttctacttcgacgtgaaggacgacttcgacttcggcaccatgggccacgtgatcagaggcaccgtggtgatgaaggacggcaaggtgatcttccccgcccccacccccaagaacatcccccagggcgcccccgtgaagcagaagaccgtggccgagctggaggccgagaaggccgccaccatcacccccttcagaaagaccatgagcaccgccagcgcctacaccgccggcctgaccggcatcctgggcctgggcatcgccgcccccaacctggccttcagccagatggtgaccaccttcggcctggccggcatcgtgggctaccacaccgtgtggggcgtgacccccgccctgcacagccccctgatgagcgtgaccaacgccatcagcggcctgaccgccgtgggcggcctggccctgatgggcggccacctgtaccccagcaccaccagccagggcctggccgccctggccgccttcatcagcagcgtgaacatcgccggcggcttcctggtgacccagagaatgctggacatgttcaagagacccaccgacccccccgagtacaactacctgtacctgctgcccgccggcaccttcgtgggcggctacctggccgccctgtacagcggctacaacatcgagcagatcatgtacctgggcagcggcctgtgctgcgtgggcgccctggccggcctgagcacccagggcaccgccagactgggcaacgccctgggcatgatcggcgtggccggcggcctggccgccaccctgggcgtgctgaagcccggccccgagctgctggcccagatgagcggcgccatggccctgggcggcaccatcggcctgaccatcgccaagagaatccagatcagcgacctgccccagctggtggccgccttccacagcctggtgggcctggccgccgtgctgacctgcatcgccgagtacatcatcgagtacccccacttcgccaccgacgccgccgccaacctgaccaagatcgtggcctacctgggcacctacatcggcggcgtgaccttcagcggcagcctgatcgcctacggcaagctgcagggcctgctgaagagcgcccccctgctgctgcccggcagacacctgctgaacgccggcctgctggccgccagcgtgggcggcatcatccccttcatggtggaccccagcttcaccaccggcatcacctgcctgggcagcgtgagcgccctgagcgccgtgatgggcgtgaccctgaccgccgccatcggcggcgccgacatgcccgtggtgatcaccgtgctgaacagctacagcggctgggccctgtgcgccgagggcttcctgctgaacaacaacctgctgaccatcgtgggcgccctgatcggcagcagcggcgccatcctgagctacatcatgtgcgtggccatgaacagaagcctggccaacgtgatcctgggcggctacggcaccaccagcaccgccggcggcaagcccatggagatcagcggcacccacaccgagatcaacctggacaacgccatcgacatgatcagagaggccaacagcatcatcatcacccccggctacggcctgtgcgccgccaaggcccagtaccccatcgccgacctggtgaagatgctgaccgagcagggcaagaaggtgagattcggcatccaccccgtggccggcagaatgcccggccagctgaacgtgctgctggccgaggccggcgtgccctacgacatcgtgctggagatggacgagatcaaccacgacttccccgacaccgacctggtgctggtgatcggcgccaacgacaccgtgaacagcgccgcccaggaggaccccaacagcatcatcgccggcatgcccgtgctggaggtgtggaagagcaagcaggtgatcgtgatgaagagaagcctgggcgtgggctacgccgccgtggacaaccccatcttctacaagcccaacaccgccatgctgctgggcgacgccaagaagacctgcgacgccctgcaggccaaggtgagagagagctaccagaagtag

SEQ ID NO: 91092 - DNA, 3261 bp, Artificial Sequence; identical to SEQ ID NO: 91091
  Description of Artificial Sequence: Synthetic coding sequence

SEQ ID NO: 91093 - DNA, 600 bp, Artificial Sequence
  Description of Artificial Sequence: Synthetic coding sequence
atggccaacctgctgaagaccgtggtgaccggctgcagctgccccctgctgagcaacctgggcagctgcaagggcctgagagtgaagaaggacttcctgagaaccttctacacccaccaggagctgtggtgcaaggcccccgtgaagcccggcatcccctacaagcagctgaccgtgggcgtgcccaaggagatcttccagaacgagaagagagtggccctgagccccgccggcgtgcagaacctggtgaagcagggcttcaacgtggtggtggagagcggcgccggcgaggccagcaagttcagcgacgaccactacagagtggccggcgcccagatccagggcgccaaggaggtgctggccagcgacctggtggtgaaggtgagagcccccatggtgaaccccaccctgggcgtgcacgaggccgacctgctgaagaccagcggcaccctgatcagcttcatctaccccgcccagaaccccgagctgctgaacaagctgagccagagaaagaccaccgtgctggccatggaccaggtgcccagagtgaccatcgcccagggctacgacgccctgagcagcatggccaacatcgcctag

SEQ ID NO: 91094 - DNA, 654 bp, Artificial Sequence
  Description of Artificial Sequence: Synthetic coding sequence
atggccaacctgctgaagaccgtggtgaccggctgcagctgccccctgctgagcaacctgggcagctgcaagggcctgagagtgaagaaggacttcctgagaaccttctacacccaccaggagctgtggtgcaaggcccccgtgaagcccggcatcccctacaagcagctgaccgtgggcgtgcccaaggagatcttccagaacgagaagagagtggccctgagccccgccggcgtgcagaacctggtgaagcagggcttcaacgtggtggtggagagcggcgccggcgaggccagcaagttcagcgacgaccactacagagtggccggcgcccagatccagggcgccaaggaggtgctggccagcgacctggtggtgaaggtgagagcccccatggtgaaccccaccctgggcgtgcacgaggccgacctgctgaagaccagcggcaccctgatcagcttcatctaccccgcccagaaccccgagctgctgaacaagctgagccagagaaagaccaccgtgctggccatggaccaggtgcccagagtgaccatcgcccagggctacgacgccctgagcagcatggccaacatcgccggctacaaggccgtggtgctggccgccaaccacttcggcagattcttcaccggctag

SEQ ID NO: 91095 - DNA, 1806 bp, Artificial Sequence
  Description of Artificial Sequence: Synthetic coding sequence
atgctgagctggaacagagtgagagccaagctgcccagcagccagatggtgaccaccttcggcctggccggcatcgtgggctaccacaccgtgtggggcgtgacccccgccctgcacagccccctgatgagcgtgaccaacgccatcagcggcctgaccgccgtgggcggcctggccctgatgggcggccacctgtaccccagcaccaccagccagggcctggccgccctggccgccttcatcagcagcgtgaacatcgccggcggcttcctggtgacccagagaatgctggacatgttcaagagacccaccgacccccccgagtacaactacctgtacctgctgcccgccggcaccttcgtgggcggctacctggccgccctgtacagcggctacaacatcgagcagatcatgtacctgggcagcggcctgtgctgcgtgggcgccctggccggcctgagcacccagggcaccgccagactgggcaacgccctgggcatgatcggcgtggccggcggcctggccgccaccctgggcgtgctgaagcccggccccgagctgctggcccagatgagcggcgccatggccctgggcggcaccatcggcctgaccatcgccaagagaatccagatcagcgacctgccccagctggtggccgccttccacagcctggtgggcctggccgccgtgctgacctgcatcgccgagtacatcatcgagtacccccacttcgccaccgacgccgccgccaacctgaccaagatcgtggcctacctgggcacctacatcggcggcgtgaccttcagcggcagcctgatcgcctacggcaagctgcagggcctgctgaagagcgcccccctgctgctgcccggcagacacctgctgaacgccggcctgctggccgccagcgtgggcggcatcatccccttcatggtggaccccagcttcaccaccggcatcacctgcctgggcagcgtgagcgccctgagcgccgtgatgggcgtgaccctgaccgccgccatcggcggcgccgacatgcccgtggtgatcaccgtgctgaacagctacagcggctgggccctgtgcgccgagggcttcctgctgaacaacaacctgctgaccatcgtgggcgccctgatcggcagcagcggcgccatcctgagctacatcatgtgcgtggccatgaacagaagcctggccaacgtgatcctgggcggctacggcaccaccagcaccgccggcggcaagcccatggagatcagcggcacccacaccgagatcaacctggacaacgccatcgacatgatcagagaggccaacagcatcatcatcacccccggctacggcctgtgcgccgccaaggcccagtaccccatcgccgacctggtgaagatgctgaccgagcagggcaagaaggtgagattcggcatccaccccgtggccggcagaatgcccggccagctgaacgtgctgctggccgaggccggcgtgccctacgacatcgtgctggagatggacgagatcaaccacgacttccccgacaccgacctggtgctggtgatcggcgccaacgacaccgtgaacagcgccgcccaggaggaccccaacagcatcatcgccggcatgcccgtgctggaggtgtggaagagcaagcaggtgatcgtgatgaagagaagcctgggcgtgggctacgccgccgtggacaaccccatcttctacaagcccaacaccgccatgctgctgggcgacgccaagaagacctgcgacgccctgcaggccaaggtgagagagagctaccagaagtag

SEQ ID NO: 91096 - DNA, 357 bp, Artificial Sequence
  Description of Artificial Sequence: Synthetic coding sequence
atgagaagagccggcctgggcgagggcgtgccccccggcaactacggcaactacggctacgccaacagcggctacagcgcctgcgaggaggagaacgagagactgaccgagagcctgagaagcaaggtgaccgccatcaagagcctgagcatcgagatcggccacgaggtgaagacccagaacaagctgctggccgagatggacagccagttcgacagcaccaccggcttcctgggcaagaccatgggcaagctgaagatcctgagcagaggcagccagaccaagctgctgtgctacatgatgctgttcagcctgttcgtgttcttcatcatctactggatcatcaagctgagatag

SEQ ID NO: 91097 - DNA, 1107 bp, Artificial Sequence
  Description of Artificial Sequence: Synthetic coding sequence
atgaaccccgccgccgaggccgagttcaacatcctgctggccaccgacagctacaaggtgacccactacaagcagtacccccccaacaccagcaaggtgtacagctacttcgagtgcagagagaagaagaccgagaacagcaagctgagaaaggtgaagtacgaggagaccgtgttctacggcctgcagtacatcctgaacaagtacctgaagggcaaggtggtgaccaaggagaagatccaggaggccaaggacgtgtacaaggagcacttccaggacgacgtgttcaacgagaagggctggaactacatcctggagaagtacgacggccacctgcccatcgagatcaaggccgtgcccgagggcttcgtgatccccagaggcaacgtgctgttcaccgtggagaacaccgaccccgagtgctactggctgaccaactggatcgagaccatcctggtgcagagctggtaccccatcaccgtggccaccaacagcagagagcagaagaagatcctggccaagtacctgctggagaccagcggcaacctggacggcctggagtacaagctgcacgacttcggctacagaggcgtgagcagccaggagaccgccggcatcggcgccagcgcccacctggtgaacttcaagggcaccgacaccgtggccggcctggccctgatcaagaagtactacggcaccaaggaccccgtgcccggctacagcgtgcccgccgccgagcacagcaccatcaccgcctggggcaaggaccacgagaaggacgccttcgagcacatcgtgacccagttcagcagcgtgcccgtgagcgtggtgagcgacagctacgacatctacaacgcctgcgagaagatctggggcgaggacctgagacacctgatcgtgagcagaagcacccaggcccccctgatcatcagacccgacagcggcaaccccctggacaccgtgctgaaggtgctggagatcctgggcaagaagttccccgtgaccgagaacagcaagggctacaagctgctgcccccctacctgagagtgatccagggcgacggcgtggacatcaacaccctgcaggaggtgtgcgtgctgtactag

SEQ ID NO: 91098 - DNA, 183 bp, Artificial Sequence
  Description of Artificial Sequence: Synthetic coding sequence
atgaaccccgccgccgaggccgagttcaacatcctgctggccaccgacagctacaaggtgacccactacaagcagtacccccccaacaccagcaaggtgtacagctacttcgagtgcagagagaagaagaccgagaacagcaagctgagaaaggtgaagtacgaggagaccgtgttctactag

SEQ ID NO: 91099 - DNA, 267 bp, Artificial Sequence
  Description of Artificial Sequence: Synthetic coding sequence
atgaaccccgccgccgaggccgagttcaacatcctgctggccaccgacagctacaaggtgacccactacaagcagtacccccccaacaccagcaaggtgtacagctacttcgagtgcagagagaagaagaccgagaacagcaagctgagaaaggtgaagtacgaggagaccgtgttctacggcctgcagtacatcctgaacaagtacctgaagggcaaggtggtgaccaaggagaagatccaggaggccaaggacgtgtacaagtag

SEQ ID NO: 91100 - DNA, 1701 bp, Artificial Sequence
  Description of Artificial Sequence: Synthetic coding sequence
atggccgccgagcaggaccccgaggccagagccgccgccagacccctgctgaccgacctgtaccaggccaccatggccctgggctactggagagccggcagagccagagacgccgccgagttcgagctgttcttcagaagatgccccttcggcggcgccttcgccctggccgccggcctgagagactgcgtgagattcctgagagccttcagactgagagacgccgacgtgcagttcctggccagcgtgctgccccccgacaccgaccccgccttcttcgagcacctgagagccctggactgcagcgaggtgaccgtgagagccctgcccgagggcagcctggccttccccggcgtgcccctgctgcaggtgagcggccccctgctggtggtgcagctgctggagacccccctgctgtgcctggtgagctacgccagcctggtggccaccaacgccgccagactgagactgatcgccggccccgagaagagactgctggagatgggcctgagaagagcccagggccccgacggcggcctgaccgccagcacctacagctacctgggcggcttcgacagcagcagcaacgtgctggccggccagctgagaggcgtgcccgtggccggcaccctggcccacagcttcgtgaccagcttcagcggcagcgaggtgccccccgaccccatgctggcccccgccgccggcgagggccccggcgtggacctggccgccaaggcccaggtgtggctggagcaggtgtgcgcccacctgggcctgggcgtgcaggagccccaccccggcgagagagccgccttcgtggcctacgccctggccttccccagagccttccagggcctgctggacacctacagcgtgtggagaagcggcctgcccaacttcctggccgtggccctggccctgggcgagctgggctacagagccgtgggcgtgagactggacagcggcgacctgctgcagcaggcccaggagatcagaaaggtgttcagagccgccgccgcccagttccaggtgccctggctggagagcgtgctgatcgtggtgagcaacaacatcgacgaggaggccctggccagactggcccaggagggcagcgaggtgaacgtgatcggcatcggcaccagcgtggtgacctgcccccagcagcccagcctgggcggcgtgtacaagctggtggccgtgggcggccagcccagaatgaagctgaccgaggaccccgagaagcagaccctgcccggcagcaaggccgccttcagactgctgggcagcgacggcagccccctgatggacatgctgcagctggccgaggagcccgtgccccaggccggccaggagctgagagtgtggccccccggcgcccaggagccctgcaccgtgagacccgcccaggtggagcccctgctgagactgtgcctgcagcagggccagctgtgcgagcccctgcccagcctggccgagagcagagccctggcccagctgagcctgagcagactgagccccgagcacagaagactgagaagccccgcccagtaccaggtgggcggcggccccccctgccacagcgccctgtgcgcccccgccctgaccctgcccaccgcccccgtgctgtgcagcctgcaggtggtgctgagcgagagactgcaggccctggtgaacagcctgtgcgccggccagagcccctag

SEQ ID NO: 91101 - DNA, 1578 bp, Artificial Sequence
  Description of Artificial Sequence: Synthetic coding sequence
atggccgccgagcaggaccccgaggccagagccgccgccagacccctgctgaccgacctgtaccaggccaccatggccctgggctactggagagccggcagagccagagacgccgccgagttcgagctgttcttcagaagatgccccttcggcggcgccttcgccctggccgccggcctgagagactgcgtgagattcctgagagccttcagactgagagacgccgacgtgcagttcctggccagcgtgctgccccccgacaccgaccccgccttcttcgagcacctgagagccctggactgcagcgaggtgaccgtgagagccctgcccgagggcagcctggccttccccggcgtgcccctgctgcaggtgagcggccccctgctggtggtgcagctgctggagacccccctgctgtgcctggtgagctacgccagcctggtggccaccaacgccgccagactgagactgatcgccggccccgagaagagactgctggagatgggcctgagaagagcccagggccccgacggcggcctgaccgccagcacctacagctacctgggcggcttcgacagcagcagcaacgtgctggccggccagctgagaggcgtgcccgtggccggcaccctggcccacagcttcgtgaccagcttcagcggcagcgaggtgccccccgaccccatgctggcccccgccgccggcgagggccccggcgtggacctggccgccaaggcccaggtgtggctggagcaggtgtgcgcccacctgggcctgggcgtgcaggagccccaccccggcgagagagccgccttcgtggcctacgccctggccttccccagagccttccagggcctgctggacacctacagcgtgtggagaagcggcctgcccaacttcctggccgtggccctggccctgggcgagctgggctacagagccgtgggcgtgagactggacagcggcgacctgctgcagcaggcccaggagatcagaaaggtgttcagagccgccgccgcccagttccaggtgccctggctggagagcgtgctgatcgtggtgagcaacaacatcgacgaggaggccctggccagactggcccaggagggcagcgaggtgaacgtgatcggcatcggcaccagcgtggtgacctgcccccagcagcccagcctgggcggcgtgtacaagctggtggccgtgggcggccagcccagaatgaagctgaccgaggaccccgagaagcagaccctgcccggcagcaaggccgccttcagactgctgggcagcgacggcagccccctgatggacatgctgcagctggccgaggagcccgtgccccaggccggccaggagctgagagtgtggccccccggcgcccaggagccctgcaccgtgagacccgcccagctgtgcgagcccctgcccagcctggccgagagcagagccctggcccagctgagcctgagcagactgagccccgagcacagaagactgagaagccccgcccagtaccaggtggtgctgagcgagagactgcaggccctggtgaacagcctgtgcgccggccagagcccctag

SEQ ID NO: 91102 - DNA, 1473 bp, Artificial Sequence
  Description of Artificial Sequence: Synthetic coding sequence
atggccgccgagcaggaccccgaggccagagccgccgccagacccctgctgaccgacctgtaccaggccaccatggccctgggctactggagagccggcagagccagagacgccgccgagttcgagctgttcttcagaagatgccccttcggcggcgccttcgccctggccgccggcctgagagactgcgtgagattcctgagagccttcagactgagagacgccgacgtgcagttcctggccagcgtgctgccccccgacaccgaccccgccttcttcgagcacctgagagccctggactgcagcgaggtgaccgtgagagccctgcccgagggcagcctggccttccccggcgtgcccctgctgcaggtgagcggccccctgctggtggtgcagctgctggagacccccctgctgtgcctggtgagctacgccagcctggtggccaccaacgccgccagactgagactgatcgccggccccgagaagagactgctggagatgggcctgagaagagcccagggccccgacggcggcctgaccgccagcacctacagctacctgggcggcttcgacagcagcagcaacgtgctggccggccagctgagaggcgtgcccgtggccggcaccctggcccacagcttcgtgaccagcttcagcggcagcgaggtgccccccgaccccatgctggcccccgccgccggcgagggccccggcgtggacctggccgccaaggcccaggtgtggctggagcaggtgtgcgcccacctgggcctgggcgtgcaggagccccaccccggcgagagagccgccttcgtggcctacgccctggccttccccagagccttccagggcctgctggacacctacagcgtgtggagaagcggcctgcccaacttcctggccgtggccctggccctgggcgagctgggctacagagccgtgggcgtgagactggacagcggcgacctgctgcagcaggcccaggagatcagaaaggtgttcagagccgccgccgcccagttccaggtgccctggctggagagcgtgctgatcgtggtgagcaacaacatcgacgaggaggccctggccagactggcccaggagggcagcgaggtgaacgtgatcggcatcggcaccagcgtggtgacctgcccccagcagcccagcctgggcggcgtgtacaagctggtggccgtgggcggccagcccagaatgaagctgaccgaggaccccgagaagcagaccctgcccggcagcaaggccgccttcagactgctgggcagcgacggcagccccctgatggacatgctgcagctggccgaggagcccgtgccccaggccggccaggagctgagagtgtggccccccggcgcccaggagccctgcaccgtgagacccgcccaggtggagcccctgctgagactgtgcctgcagcagggccaggtggccgcccccccccccagcagctag

SEQ ID NO: 91103 - DNA, 1617 bp, Artificial Sequence
  Description of Artificial Sequence: Synthetic coding sequence
atggccgccgagcaggaccccgaggccagagccgccgccagacccctgctgaccgacctgtaccaggccaccatggccctgggctactggagagccggcagagccagagacgccgccgagttcgagctgttcttcagaagatgccccttcggcggcgccttcgccctggccgccggcctgagagactgcgtgagattcctgagagccttcagactgagagacgccgacgtgcagttcctggccagcgtgctgccccccgacaccgaccccgccttcttcgagcacctgagagccctggactgcagcgaggtgaccgtgagagccctgcccgagggcagcctggccttccccggcgtgcccctgctgcaggtgagcggccccctgctggtggtgcagctgctggagacccccctgctgtgcctggtgagctacgccagcctggtggccaccaacgccgccagactgagactgatcgccggccccgagaagagactgctggagatgggcctgagaagagcccagggccccgacggcggcctgaccgccagcacctacagctacctgggcggcttcgacagcagcagcaacgtgctggccggccagctgagaggcgtgcccgtggccggcaccctggcccacagcttcgtgaccagcttcagcggcagcgaggtgccccccgaccccatgctggcccccgccgccggcgagggccccggcgtggacctggccgccaaggcccaggtgtggctggagcaggtgtgcgcccacctgggcctgggcgtgcaggagccccaccccggcgagagagccgccttcgtggcctacgccctggccttccccagagccttccagggcctgctggacacctacagcgtgtggagaagcggcctgcccaacttcctggccgtggccctggccctgggcgagctgggctacagagccgtgggcgtgagactggacagcggcgacctgctgcagcaggcccaggagatcagaaaggtgttcagagccgccgccgcccagttccaggtgccctggctggagagcgtgctgatcgtggtgagcaacaacatcgacgaggaggccctggccagactggcccaggagggcagcgaggtgaacgtgatcggcatcggcaccagcgtggtgacctgcccccagcagcccagcctgggcggcgtgtacaagctggtggccgtgggcggccagcccagaatgaagctgaccgaggaccccgagaagcagaccctgcccggcagcaaggccgccttcagactgctgggcagcgacggcagccccctgatggacatgctgcagctggccgaggagcccgtgccccaggccggccaggagctgagagtgtggccccccggcgcccaggagccctgcaccgtgagacccgcccaggtggagcccctgctgagactgtgcctgcagcagggccagctgtgcgagcccctgcccagcctggccgagagcagagccctggcccagctgagcctgagcagactgagccccgagcacagaagactgagaagccccgcccagtaccaggtggtgctgagcgagagactgcaggccctggtgaacagcctgtgcgccggccagagcccctag

SEQ ID NO: 91104 - DNA, 2199 bp, Artificial Sequence
  Description of Artificial Sequence: Synthetic coding sequence
atgcccgaggagacccagacccaggaccagcccatggaggaggaggaggtggagaccttcgccttccaggccgagatcgcccagctgatgagcctgatcatcaacaccttctacagcaacaaggagatcttcctgagagagctgatcagcaacagcagcgacgccctggacaagatcagatacgagagcctgaccgaccccagcaagctggacagcggcaaggagctgcacatcaacctgatccccaacaagcaggacagaaccctgaccatcgtggacaccggcatcggcatgaccaaggccgacctgatcaacaacctgggcaccatcgccaagagcggcaccaaggccttcatggaggccctgcaggccggcgccgacatcagcatgatcggccagttcggcgtgggcttctacagcgcctacctggtggccgagaaggtgaccgtgatcaccaagcacaacgacgacgagcagtacgcctgggagagcagcgccggcggcagcttcaccgtgagaaccgacaccggcgagcccatgggcagaggcaccaaggtgatcctgcacctgaaggaggaccagaccgagtacctggaggagagaagaatcaaggagatcgtgaagaagcacagccagttcatcggctaccccatcaccctgttcgtggagaaggagagagacaaggaggtgagcgacgacgaggccgaggagaaggaggacaaggaggaggagaaggagaaggaggagaaggagagcgaggacaagcccgagatcgaggacgtgggcagcgacgaggaggaggagaagaaggacggcgacaagaagaagaagaagaagatcaaggagaagtacatcgaccaggaggagctgaacaagaccaagcccatctggaccagaaaccccgacgacatcaccaacgaggagtacggcgagttctacaagagcctgaccaacgactgggaggaccacctggccgtgaagcacttcagcgtggagggccagctggagttcagagccctgctgttcgtgcccagaagagcccccttcgacctgttcgagaacagaaagaagaagaacaacatcaagctgtacgtgagaagagtgttcatcatggacaactgcgaggagctgatccccgagtacctgaacttcatcagaggcgtggtggacagcgaggacctgcccctgaacatcagcagagagatgctgcagcagagcaagatcctgaaggtgatcagaaagaacctggtgaagaagtgcctggagctgttcaccgagctggccgaggacaaggagaactacaagaagttctacgagcagttcagcaagaacatcaagctgggcatccacgaggacagccagaacagaaagaagctgagcgagctgctgagatactacaccagcgccagcggcgacgagatggtgagcctgaaggactactgcaccagaatgaaggagaaccagaagcacatctactacatcaccggcgagaccaaggaccaggtggccaacagcgccttcgtggagagactgagaaagcacggcctggaggtgatctacatgatcgagcccatcgacgagtactgcgtgcagcagctgaaggagttcgagggcaagaccctggtgagcgtgaccaaggagggcctggagctgcccgaggacgaggaggagaagaagaagcaggaggagaagaagaccaagttcgagaacctgtgcaagatcatgaaggacatcctggagaagaaggtggagaaggtggtggtgagcaacagactggtgaccagcccctgctgcatcgtgaccagcacctacggctggaccgccaacatggagagaatcatgaaggcccaggccctgagagacaacagcaccatgggctacatggccgccaagaagcacctggagatcaaccccgaccacagcatcatcgagaccctgagacagaaggccgaggccgacaagaacgacaagagcgtgaaggacctggtgatcctgctgtacgagaccgccctgctgagcagcggcttcagcctggaggacccccagacccacgccaacagaatctacagaatgatcaagctgggcctgggcatcgacgaggacgaccccaccgccgacgacaccagcgccgccgtgaccgaggagatgccccccctggagggcgacgacgacaccagcagaatggaggaggtggactag

SEQ ID NO: 91105 - DNA, 2910 bp, Artificial Sequence
  Description of Artificial Sequence: Synthetic coding sequence
atggagggcgacagagtggccggcagacccgtgctgagcagcctgcccgtgctgctgctgctgcccctgctgatgctgagagccgccgccctgcaccccgacgagctgttcccccacggcgagagctggggcgaccagctgctgcaggagggcgacgacgagagcagcgccgtggtgaagctggccaaccccctgcacttctacgaggccagattcagcaacctgtacgtgggcaccaacggcatcatcagcacccaggacttccccagagagacccagtacgtggactacgacttccccaccgacttccccgccatcgcccccttcctggccgacatcgacaccagccacggcagaggcagagtgctgtacagagtgaacggcaaggtgagcggccacctgcacgtgggccacacccccgtgcacttcaccgacgtggacctgcacgcctacatcgtgggcaacgacggcagagcctacaccgccatcagccacatcccccagcccgccgcccaggccctgctgcccctgacccccatcggcggcctgttcggctggctgttcgccctggagaagcccggcagcgagaacggcttcagcctggccggcgccgccttcacccacgacatggaggtgaccttctaccccggcgaggagaccgtgagaatcacccagaccgccgagggcctggaccccgagaactacctgagcatcaagaccaacatccagggccaggtgccctacgtgagcgccaacttcaccgcccacatcagcccctacaaggagctgtaccactacagcgacagcaccgtgaccagcaccagcagcagagactacagcctgaccttcggcgccatcaaccagacctggagctacagaatccaccagaacatcacctaccaggtgtgcagacacgcccccagacaccccagcttccccaccacccagcagctgaacgtggacagagtgttcgccctgtacaacgacgaggagagagtgctgagattcgccgtgaccaaccagatcggccccgtgaaggaggacagcgaccccacccccggcaacccctgctacgacggcagccacatgtgcgacaccaccgccagatgccaccccggcaccggcgtggactacacctgcgagtgcgccagcggctaccagggcgacggcagaaactgcgtggacgagaacgagtgcgccaccggcttccacagatgcggccccaacagcgtgtgcatcaacctgcccggcagctacagatgcgagtgcagaagcggctacgagttcgccgacgacagacacacctgcatcctgatcaccccccccgccaacccctgcgaggacggcagccacacctgcgcccccgccggccaggccagatgcgtgcaccacggcggcagcaccttcagctgcgcctgcctgcccggctacgccggcgacggccaccagtgcaccgacgtggacgagtgcagcgagaacagatgccaccccgccgccacctgctacaacacccccggcagcttcagctgcagatgccagcccggctactacggcgacggcttccagtgcatccccgacagcaccagcagcctgaccccctgcgagcagcagcagagacacgcccaggcccagtacgcctaccccggcgccagattccacatcccccagtgcgacgagcagggcaacttcctgcccctgcagtgccacggcagcaccggcttctgctggtgcgtggaccccgacggccacgaggtgcccggcacccagaccccccccggcagcacccccccccactgcggccccagccccgagcccacccagagaccccccaccatctgcgagagatggagagagaacctgctggagcactacggcggcacccccagagacgaccagtacgtgccccagtgcgacgacctgggccacttcatccccctgcagtgccacggcaagagcgacttctgctggtgcgtggacaaggacggcagagaggtgcagggcaccagaagccagcccggcaccacccccgcctgcatccccaccgtggccccccccatggtgagacccacccccagacccgacgtgaccccccccagcgtgggcaccttcctgctgtacacccagggccagcagatcggctacctgcccctgaacggcaccagactgcagaaggacgccgccaagaccctgctgagcctgcacggcagcatcatcgtgggcatcgactacgactgcagagagagaatggtgtactggaccgacgtggccggcagaaccatcagcagagccggcctggagctgggcgccgagcccgagaccatcgtgaacagcggcctgatcagccccgagggcctggccatcgaccacatcagaagaaccatgtactggaccgacagcgtgctggacaagatcgagagcgccctgctggacggcagcgagagaaaggtgctgttctacaccgacctggtgaaccccagagccatcgccgtggaccccatcagaggcaacctgtactggaccgactggaacagagaggcccccaagatcgagaccagcagcctggacggcgagaacagaagaatcctgatcaacaccgacatcggcctgcccaacggcctgaccttcgaccccttcagcaagctgctgtgctgggccgacgccggcaccaagaagctggagtgcaccctgcccgacggcaccggcagaagagtgatccagaacaacctgaagtaccccttcagcatcgtgagctacgccgaccacttctaccacaccgactggagaagagacggcgtggtgagcgtgaacaagcacagcggccagttcaccgacgagtacctgcccgagcagagaagccacctgtacggcatcaccgccgtgtacccctactgccccaccggcagaaagtag

SEQ ID NO: 91106 - DNA, 3543 bp, Artificial Sequence
  Description of Artificial Sequence: Synthetic coding sequence
accccccagaccgagagaatcacccacagcagcatcagctggagcttcctgctgagattcagcagaggcaagctgctgatgctgagagccgccgccctgcaccccgacgagctgttcccccacggcgagagctggggcgaccagctgctgcaggagggcgacgacgagagcagcgccgtggtgaagctggccaaccccctgcacttctacgaggccagattcagcaacctgtacgtgggcaccaacggcatcatcagcacccaggacttccccagagagacccagtacgtggactacgacttccccaccgacttccccgccatcgcccccttcctggccgacatcgacaccagccacggcagaggcagagtgctgtacagagaggacaccagccccgccgtgctgggcctggccgccagatacgtgagagccggcttccccagaagcgccagattcacccccacccacgccttcctggccacctgggagcaggtgggcgcctacgaggaggtgaagagaggcgccctgcccagcggcgagctgaacaccttccaggccgtgctggccagcgacggcagcgacagctacgccctgttcctgtaccccgccaacggcctgcagttcctgggcaccagacccaaggagagctacaacgtgcagctgcagctgcccgccagagtgggcttctgcagaggcgaggccgacgacctgaagagcgagggcccctacttcagcctgaccagcaccgagcagagcgtgaagaacctgtaccagctgagcaacctgggcatccccggcgtgtgggccttccacatcggcagcaccagccccctggacaacgtgagacccgccgccgtgggcgacctgagcgccgcccacagcagcgtgcccctgggcagaagcttcagccacgccaccgccctggagagcgactacaacgaggacaacctggactactacgacgtgaacgaggaggaggccgagtacctgcccggcgagcccgaggaggccctgaacggccacagcagcatcgacgtgagcttccagagcaaggtggacaccaagcccctggaggagagcagcaccctggacccccacaccaaggagggcaccagcctgggcgaggtgggcggccccgacctgaagggccaggtggagccctgggacgagagagagaccagaagccccgccccccccgaggtggacagagacagcctggcccccagctgggagaccccccccccctaccccgagaacggcagcatccagccctaccccgacggcggccccgtgcccagcgagatggacgtgccccccgcccaccccgaggaggagatcgtgctgagaagctaccccgccagcggccacaccacccccctgagcagaggcacctacgaggtgggcctggaggacaacatcggcagcaacaccgaggtgttcacctacaacgccgccaacaaggagacctgcgagcacaaccacagacagtgcagcagacacgccttctgcaccgactacgccaccggcttctgctgccactgccagagcaagttctacggcaacggcaagcactgcctgcccgagggcgccccccacagagtgaacggcaaggtgagcggccacctgcacgtgggccacacccccgtgcacttcaccgacgtggacctgcacgcctacatcgtgggcaacgacggcagagcctacaccgccatcagccacatcccccagcccgccgcccaggccctgctgcccctgacccccatcggcggcctgttcggctggctgttcgccctggagaagcccggcagcgagaacggcttcagcctggccggcgccgccttcacccacgacatggaggtgaccttctaccccggcgaggagaccgtgagaatcacccagaccgccgagggcctggaccccgagaactacctgagcatcaagaccaacatccagggccaggtgccctacgtgagcgccaacttcaccgcccacatcagcccctacaaggagctgtaccactacagcgacagcaccgtgaccagcaccagcagcagagactacagcctgaccttcggcgccatcaaccagacctggagctacagaatccaccagaacatcacctaccaggtgtgcagacacgcccccagacaccccagcttccccaccacccagcagctgaacgtggacagagtgttcgccctgtacaacgacgaggagagagtgctgagattcgccgtgaccaaccagatcggccccgtgaaggaggacagcgaccccacccccggcaacccctgctacgacggcagccacatgtgcgacaccaccgccagatgccaccccggcaccggcgtggactacacctgcgagtgcgccagcggctaccagggcgacggcagaaactgcgtggacgagaacgagtgcgccaccggcttccacagatgcggccccaacagcgtgtgcatcaacctgcccggcagctacagatgcgagtgcagaagcggctacgagttcgccgacgacagacacacctgcatcctgatcaccccccccgccaacccctgcgaggacggcagccacacctgcgcccccgccggccaggccagatgcgtgcaccacggcggcagcaccttcagctgcgcctgcctgcccggctacgccggcgacggccaccagtgcaccgacgtggacgagtgcagcgagaacagatgccaccccgccgccacctgctacaacacccccggcagcttcagctgcagatgccagcccggctactacggcgacggcttccagtgcatccccgacagcaccagcagcctgaccccctgcgagcagcagcagagacacgcccaggcccagtacgcctaccccggcgccagattccacatcccccagtgcgacgagcagggcaacttcctgcccctgcagtgccacggcagcaccggcttctgctggtgcgtggaccccgacggccacgaggtgcccggcacccagaccccccccggcagcacccccccccactgcggccccagccccgagcccacccagagaccccccaccatctgcgagagatggagagagaacctgctggagcactacggcggcacccccagagacgaccagtacgtgccccagtgcgacgacctgggccacttcatccccctgcagtgccacggcaagagcgacttctgctggtgcgtggacaaggacggcagagaggtgcagggcaccagaagccagcccggcaccacccccgcctgcatccccaccgtggccccccccatggtgagacccacccccagacccgacgtgaccccccccagcgtgggcaccttcctgctgtacacccagggccagcagatcggctacctgcccctgaacggcaccagactgcagaaggacgccgccaagaccctgctgagcctgcacgtgaagtggatcagccccgtgggcggcagagccgcctggctgagccagtgggagcccccccacagaccctgctgcagcgaggtggactggtgcagagaggtgctggagggcttctag

SEQ ID NO: 91107 - DNA, 3825 bp, Artificial Sequence
  Description of Artificial Sequence: Synthetic coding sequence
atggagggcgacagagtgaagctggccaaccccctgcacttctacgaggccagattcagcaacctgtacgtgggcaccaacggcatcatcagcacccaggacttccccagagagacccagtacgtggactacgacttccccaccgacttccccgccatcgcccccttcctggccgacatcgacaccagccacggcagaggcagagtgctgtacagagaggacaccagccccgccgtgctgggcctggccgccagatacgtgagagccggcttccccagaagcgccagattcacccccacccacgccttcctggccacctgggagcaggtgggcgcctacgaggaggtgaagagaggcgccctgcccagcggcgagctgaacaccttccaggccgtgctggccagcgacggcagcgacagctacgccctgttcctgtaccccgccaacggcctgcagttcctgggcaccagacccaaggagagctacaacgtgcagctgcagctgcccgccagagtgggcttctgcagaggcgaggccgacgacctgaagagcgagggcccctacttcagcctgaccagcaccgagcagagcgtgaagaacctgtaccagctgagcaacctgggcatccccggcgtgtgggccttccacatcggcagcaccagccccctggacaacgtgagacccgccgccgtgggcgacctgagcgccgcccacagcagcgtgcccctgggcagaagcttcagccacgccaccgccctggagagcgactacaacgaggacaacctggactactacgacgtgaacgaggaggaggccgagtacctgcccggcgagcccgaggaggccctgaacggccacagcagcatcgacgtgagcttccagagcaaggtggacaccaagcccctggaggagagcagcaccctggacccccacaccaaggagggcaccagcctgggcgaggtgggcggccccgacctgaagggccaggtggagccctgggacgagagagagaccagaagccccgccccccccgaggtggacagagacagcctggcccccagctgggagaccccccccccctaccccgagaacggcagcatccagccctaccccgacggcggccccgtgcccagcgagatggacgtgccccccgcccaccccgaggaggagatcgtgctgagaagctaccccgccagcggccacaccacccccctgagcagaggcacctacgaggtgggcctggaggacaacatcggcagcaacaccgaggtgttcacctacaacgccgccaacaaggagacctgcgagcacaaccacagacagtgcagcagacacgccttctgcaccgactacgccaccggcttctgctgccactgccagagcaagttctacggcaacggcaagcactgcctgcccgagggcgccccccacagagtgaacggcaaggtgagcggccacctgcacgtgggccacacccccgtgcacttcaccgacgtggacctgcacgcctacatcgtgggcaacgacggcagagcctacaccgccatcagccacatcccccagcccgccgcccaggccctgctgcccctgacccccatcggcggcctgttcggctggctgttcgccctggagaagcccggcagcgagaacggcttcagcctggccggcgccgccttcacccacgacatggaggtgaccttctaccccggcgaggagaccgtgagaatcacccagaccgccgagggcctggaccccgagaactacctgagcatcaagaccaacatccagggccaggtgccctacgtgagcgccaacttcaccgcccacatcagcccctacaaggagctgtaccactacagcgacagcaccgtgaccagcaccagcagcagagactacagcctgaccttcggcgccatcaaccagacctggagctacagaatccaccagaacatcacctaccaggtgtgcagacacgcccccagacaccccagcttccccaccacccagcagctgaacgtggacagagtgttcgccctgtacaacgacgaggagagagtgctgagattcgccgtgaccaaccagatcggccccgtgaaggaggacagcgaccccacccccggcaacccctgctacgacggcagccacatgtgcgacaccaccgccagatgccaccccggcaccggcgtggactacacctgcgagtgcgccagcggctaccagggcgacggcagaaactgcgtggacgagaacgagtgcgccaccggcttccacagatgcggccccaacagcgtgtgcatcaacctgcccggcagctacagatgcgagtgcagaagcggctacgagttcgccgacgacagacacacctgcatctacgtggacgagtgcagcgagaacagatgccaccccgccgccacctgctacaacacccccggcagcttcagctgcagatgccagcccggctactacggcgacggcttccagtgcatccccgacagcaccagcagcctgaccccctgcgagcagcagcagagacacgcccaggcccagtacgcctaccccggcgccagattccacatcccccagtgcgacgagcagggcaacttcctgcccctgcagtgccacggcagcaccggcttctgctggtgcgtggaccccgacggccacgaggtgcccggcacccagaccccccccggcagcacccccccccactgcggccccagccccgagcccacccagagaccccccaccatctgcgagagatggagagagaacctgctggagcactacggcggcacccccagagacgaccagtacgtgccccagtgcgacgacctgggccacttcatccccctgcagtgccacggcaagagcgacttctgctggtgcgtggacaaggacggcagagaggtgcagggcaccagaagccagcccggcaccacccccgcctgcatccccaccgtggccccccccatggtgagacccacccccagacccgacgtgaccccccccagcgtgggcaccttcctgctgtacacccagggccagcagatcggctacctgcccctgaacggcaccagactgcagaaggacgccgccaagaccctgctgagcctgcacggcagcatcatcgtgggcatcgactacgactgcagagagagaatggtgtactggaccgacgtggccggcagaaccatcagcagagccggcctggagctgggcgccgagcccgagaccatcgtgaacagcggcctgatcagccccgagggcctggccatcgaccacatcagaagaaccatgtactggaccgacagcgtgctggacaagatcgagagcgccctgctggacggcagcgagagaaaggtgctgttctacaccgacctggtgaaccccagagccatcgccgtggaccccatcagaggcaacctgtactggaccgactggaacagagaggcccccaagatcgagaccagcagcctggacggcgagaacagaagaatcctgatcaacaccgacatcggcctgcccaacggcctgaccttcgaccccttcagcaagctgctgtgctgggccgacgccggcaccaagaagctggagtgcaccctgcccgacggcaccggcagaagagtgatccagaacaacctgaagtaccccttcagcatcgtgagctacgccgaccacttctaccacaccgactggagaagagacggcgtggtgagcgtgaacaagcacagcggccagttcaccgacgagtacctgcccgagcagagaagccacctgtacggcatcaccgccgtgtacccctactgccccaccggcagaaagtag

SEQ ID NO: 91108 - DNA, 3837 bp, Artificial Sequence
  Description of Artificial Sequence: Synthetic coding sequence
atgaccgccagaggcctggccctgggcctgctgctgctgctgctgtgccccgcccaggtgttcagccagagctgcgtgtggtacggcgagtgcggcatcgcctacggcgacaagagatacaactgcgagtacagcggcccccccaagcccctgcccaaggacggctacgacctggtgcaggagctgtgccccggcttcttcttcggcaacgtgagcctgtgctgcgacgtgagacagctgcagaccctgaaggacaacctgcagctgcccctgcagttcctgagcagatgccccagctgcttctacaacctgctgaacctgttctgcgagctgacctgcagccccagacagagccagttcctgaacgtgaccgccaccgaggactacgtggaccccgtgaccaaccagaccaagaccaacgtgaaggagctgcagtactacgtgggccagagcttcgccaacgccatgtacaacgcctgcagagacgtggaggcccccagcagcaacgacaaggccctgggcctgctgtgcggcaaggacgccgacgcctgcaacgccaccaactggatcgagtacatgttcaacaaggacaacggccaggcccccttcaccatcacccccgtgttcagcgacttccccgtgcacggcatggagcccatgaacaacgccaccaagggctgcgacgagagcgtggacgaggtgaccgccccctgcagctgccaggactgcagcatcgtgtgcggccccaagccccagcccccccccccccccgccccctggaccatcctgggcctggacgccatgtacgtgatcatgtggatcacctacatggccttcctgctggtgttcttcggcgccttcttcgccgtgtggtgctacagaaagagatacttcgtgagcgagtacacccccatcgacagcaacatcgccttcagcgtgaacgccagcgacaagggcgaggccagctgctgcgaccccgtgagcgccgccttcgagggctgcctgagaagactgttcaccagatggggcagcttctgcgtgagaaaccccggctgcgtgatcttcttcagcctggtgttcatcaccgcctgcagcagcggcctggtgttcgtgagagtgaccaccaaccccgtggacctgtggagcgcccccagcagccaggccagactggagaaggagtacttcgaccagcacttcggccccttcttcagaaccgagcagctgatcatcagagcccccctgaccgacaagcacatctaccagccctaccccagcggcgccgacgtgcccttcggcccccccctggacatccagatcctgcaccaggtgctggacctgcagatcgccatcgagaacatcaccgccagctacgacaacgagaccgtgaccctgcaggacatctgcctggcccccctgagcccctacaacaccaactgcaccatcctgagcgtgctgaactacttccagaacagccacagcgtgctggaccacaagaagggcgacgacttcttcgtgtacgccgactaccacacccacttcctgtactgcgtgagagcccccgccagcctgaacgacaccagcctgctgcacgacccctgcctgggcaccttcggcggccccgtgttcccctggctggtgctgggcggctacgacgaccagaactacaacaacgccaccgccctggtgatcaccttccccgtgaacaactactacaacgacaccgagaagctgcagagagcccaggcctgggagaaggagttcatcaacttcgtgaagaactacaagaaccccaacctgaccatcagcttcaccgccgagagaagcatcgaggacgagctgaacagagagagcgacagcgacgtgttcaccgtggtgatcagctacgccatcatgttcctgtacatcagcctggccctgggccacatgaagagctgcagaagactgctggtggacagcaaggtgagcctgggcatcgccggcatcctgatcgtgctgagcagcgtggcctgcagcctgggcgtgttcagctacatcggcctgcccctgaccctgatcgtgatcgaggtgatccccttcctggtgctggccgtgggcgtggacaacatcttcatcctggtgcaggcctaccagagagacgagagactgcagggcgagaccctggaccagcagctgggcagagtgctgggcgaggtggcccccagcatgttcctgagcagcttcagcgagaccgtggccttcttcctgggcgccctgagcgtgatgcccgccgtgcacaccttcagcctgttcgccggcctggccgtgttcatcgacttcctgctgcagatcacctgcttcgtgagcctgctgggcctggacatcaagagacaggagaagaacagactggacatcttctgctgcgtgagaggcgccgaggacggcaccagcgtgcaggccagcgagagctgcctgttcagattcttcaagaacagctacagccccctgctgctgaaggactggatgagacccatcgtgatcgccatcttcgtgggcgtgctgagcttcagcatcgccgtgctgaacaaggtggacatcggcctggaccagagcctgagcatgcccgacgacagctacatggtggactacttcaagagcatcagccagtacctgcacgccggcccccccgtgtacttcgtgctggaggagggccacgactacaccagcagcaagggccagaacatggtgtgcggcggcatgggctgcaacaacgacagcctggtgcagcagatcttcaacgccgcccagctggacaactacaccagaatcggcttcgcccccagcagctggatcgacgactacttcgactgggtgaagccccagagcagctgctgcagagtggacaacatcaccgaccagttctgcaacgccagcgtggtggaccccgcctgcgtgagatgcagacccctgacccccgagggcaagcagagaccccagggcggcgacttcatgagattcctgcccatgttcctgagcgacaaccccaaccccaagtgcggcaagggcggccacgccgcctacagcagcgccgtgaacatcctgctgggccacggcaccagagtgggcgccacctacttcatgacctaccacaccgtgctgcagaccagcgccgacttcatcgacgccctgaagaaggccagactgatcgccagcaacgtgaccgagaccatgggcatcaacggcagcgcctacagagtgttcccctacagcgtgttctacgtgttctacgagcagtacctgaccatcatcgacgacaccatcttcaacctgggcgtgagcctgggcgccatcttcctggtgaccatggtgctgctgggctgcgagctgtggagcgccgtgatcatgtgcgccaccatcgccatggtgctggtgaacatgttcggcgtgatgtggctgtggggcatcagcctgaacgccgtgagcctggtgaacctggtgatgagctgcggcatcagcgtggagttctgcagccacatcaccagagccttcaccgtgagcatgaagggcagcagagtggagagagccgaggaggccctggcccacatgggcagcagcgtgttcagcggcatcaccctgaccaagttcggcggcatcgtggtgctggccttcgccaagagccagatcttccagatcttctacttcagaatgtacctggccatggtgctgctgggcgccacccacggcctgatcttcctgcccgtgctgctgagctacatcggccccagcgtgaacaaggccaagagctgcgccaccgaggagagatacaagggcaccgagagagagagactgctgaacttctag

SEQ ID NO: 91109 - DNA, 2883 bp, Artificial Sequence
  Description of Artificial Sequence: Synthetic coding sequence
atgtacgtgatcatgtggatcacctacatggccttcctgctggtgttcttcggcgccttcttcgccgtgtggtgctacagaaagagatacttcgtgagcgagtacacccccatcgacagcaacatcgccttcagcgtgaacgccagcgacaagggcaccgcctggctgctgaccagcaccttccccagcagccccgtgctgcccggcgaggccagctgctgcgaccccgtgagcgccgccttcgagggctgcctgagaagactgttcaccagatggggcagcttctgcgtgagaaaccccggctgcgtgatcttcttcagcctggtgttcatcaccgcctgcagcagcggcctggtgttcgtgagagtgaccaccaaccccgtggacctgtggagcgcccccagcagccaggccagactggagaaggagtacttcgaccagcacttcggccccttcttcagaaccgagcagctgatcatcagagcccccctgaccgacaagcacatctaccagccctaccccagcggcgccgacgtgcccttcggcccccccctggacatccagatcctgcaccaggtgctggacctgcagatcgccatcgagaacatcaccgccagctacgacaacgagaccgtgaccctgcaggacatctgcctggcccccctgagcccctacaacaccaactgcaccatcctgagcgtgctgaactacttccagaacagccacagcgtgctggaccacaagaagggcgacgacttcttcgtgtacgccgactaccacacccacttcctgtactgcgtgagattcatcaacttcgtgaagaactacaagaaccccaacctgaccatcagcttcaccgccgagagaagcatcgaggacgagctgaacagagagagcgacagcgacgtgttcaccgtggtgatcagctacgccatcatgttcctgtacatcagcctggccctgggccacatgaagagctgcagaagactgctggtggacagcaaggtgagcctgggcatcgccggcatcctgatcgtgctgagcagcgtggcctgcagcctgggcgtgttcagctacatcggcctgcccctgaccctgatcgtgatcgaggtgatccccttcctggtgctggccgtgggcgtggacaacatcttcatcctggtgcaggcctaccagagagacgagagactgcagggcgagaccctggaccagcagctgggcagagtgctgggcgaggtggcccccagcatgttcctgagcagcttcagcgagaccgtggccttcttcctgggcgccctgagcgtgatgcccgccgtgcacaccttcagcctgttcgccggcctggccgtgttcatcgacttcctgctgcagatcacctgcttcgtgagcctgctgggcctggacatcaagagacaggagaagaacagactggacatcttctgctgcgtgagaggcgccgaggacggcaccagcgtgcaggccagcgagagctgcctgttcagattcttcaagaacagctacagccccctgctgctgaaggactggatgagacccatcgtgatcgccatcttcgtgggcgtgctgagcttcagcatcgccgtgctgaacaaggtggacatcggcctggaccagagcctgagcatgcccgacgacagctacatggtggactacttcaagagcatcagccagtacctgcacgccggcccccccgtgtacttcgtgctggaggagggccacgactacaccagcagcaagggccagaacatggtgtgcggcggcatgggctgcaacaacgacagcctggtgcagcagatcttcaacgccgcccagctggacaactacaccagaatcggcttcgcccccagcagctggatcgacgactacttcgactgggtgaagccccagagcagctgctgcagagtggacaacatcaccgaccagttctgcaacgccagcgtggtggaccccgcctgcgtgagatgcagacccctgacccccgagggcaagcagagaccccagggcggcgacttcatgagattcctgcccatgttcctgagcgacaaccccaaccccaagtgcggcaagggcggccacgccgcctacagcagcgccgtgaacatcctgctgggccacggcaccagagtgggcgccacctacttcatgacctaccacaccgtgctgcagaccagcgccgacttcatcgacgccctgaagaaggccagactgatcgccagcaacgtgaccgagaccatgggcatcaacggcagcgcctacagagtgttcccctacagcgtgttctacgtgttctacgagcagtacctgaccatcatcgacgacaccatcttcaacctgggcgtgagcctgggcgccatcttcctggtgaccatggtgctgctgggctgcgagctgtggagcgccgtgatcatgtgcgccaccatcgccatggtgctggtgaacatgttcggcgtgatgtggctgtggggcatcagcctgaacgccgtgagcctggtgaacctggtgatgagctgcggcatcagcgtggagttctgcagccacatcaccagagccttcaccgtgagcatgaagggcagcagagtggagagagccgaggaggccctggcccacatgggcagcagcgtgttcagcggcatcaccctgaccaagttcggcggcatcgtggtgctggccttcgccaagagccagatcttccagatcttctacttcagaatgtacctggccatggtgctgctgggcgccacccacggcctgatcttcctgcccgtgctgctgagctacatcggccccagcgtgaacaaggccaagagctgcgccaccgaggagagatacaagggcaccgagagagagagactgctgaacttctag

SEQ ID NO: 91110 - DNA, 2331 bp, Artificial Sequence
  Description of Artificial Sequence: Synthetic coding sequence
atgtacaacgcctgcagagacgtggaggcccccagcagcaacgacaaggccctgggcctgctgtgcggcaaggacgccgacgcctgcaacgccaccaactggatcgagtacatgttcaacaaggacaacggccaggcccccttcaccatcacccccgtgttcagcgacttccccgtgcacggcatggagcccatgaacaacgccaccaagggctgcgacgagagcgtggacgaggtgaccgccccctgcagctgccaggactgcagcatcgtgtgcggccccaagccccagcccccccccccccccgccccctggaccatcctgggcctggacgccatgtacgtgatcatgtggatcacctacatggccttcctgctggtgttcttcggcgccttcttcgccgtgtggtgctacagaaagagatacttcgtgagcgagtacacccccatcgacagcaacatcgccttcagcgtgaacgccagcgacaagggcgaggccagctgctgcgaccccgtgagcgccgccttcgagggctgcctgagaagactgttcaccagatggggcagcttctgcgtgagaaaccccggctgcgtgatcttcttcagcctggtgttcatcaccgcctgcagcagcggcctggtgttcgtgagagtgaccaccaaccccgtggacctgtggagcgcccccagcagccaggccagactggagaaggagtacttcgaccagcacttcggccccttcttcagaaccgagcagctgatcatcagagcccccctgaccgacaagcacatctaccagccctaccccagcggcgccgacgtgcccttcggcccccccctggacatccagatcctgcaccaggtgctggacctgcagatcgccatcgagaacatcaccgccagctacgacaacgagaccgtgaccctgcaggacatctgcctggcccccctgagcccctacaacaccaactgcaccatcctgagcgtgctgaactacttccagaacagccacagcgtgctggaccacaagaagggcgacgacttcttcgtgtacgccgactaccacacccacttcctgtactgcgtgagagcccccgccagcctgaacgacaccagcctgctgcacgacccctgcctgggcaccttcggcggccccgtgttcccctggctggtgctgggcggctacgacgaccagaactacaacaacgccaccgccctggtgatcaccttccccgtgaacaactactacaacgacaccgagaagctgcagagagcccaggcctgggagaaggagttcatcaacttcgtgaagaactacaagaaccccaacctgaccatcagcttcaccgccgagagaagcatcgaggacgagctgaacagagagagcgacagcgacgtgttcaccgtggtgatcagctacgccatcatgttcctgtacatcagcctggccctgggccacatgaagagctgcagaagactgctggtggacagcaaggtgagcctgggcatcgccggcatcctgatcgtgctgagcagcgtggcctgcagcctgggcgtgttcagctacatcggcctgcccctgaccctgatcgtgatcgaggtgatccccttcctggtgctggccgtgggcgtggacaacatcttcatcctggtgcaggcctaccagagagacgagagactgcagggcgagaccctggaccagcagctgggcagagtgctgggcgaggtggcccccagcatgttcctgagcagcttcagcgagaccgtggccttcttcctgggcgccctgagcgtgatgcccgccgtgcacaccttcagcctgttcgccggcctggccgtgttcatcgacttcctgctgcagatcacctgcttcgtgagcctgctgggcctggacatcaagagacaggagaagaacagactggacatcttctgctgcgtgagaggcgccgaggacggcaccagcgtgcaggccagcgagagctgcctgttcagattcttcaagaacagctacagccccctgctgctgaaggactggatgagacccatcgtgatcgccatcttcgtgggcgtgctgagcttcagcatcgccgtgctgaacaaggtggacatcggcctggaccagagcctgagcatgcccgacgacagctacatggtggactacttcaagagcatcagccagtacctgcacgccggcccccccgtgtacttcgtgctggaggagggccacgactacaccagcagcaagggccagaacatggtgtgcggcggcatgggctgcaacaacgacagcctggtgcagcagatcttcaacgccgcccagctggacaactag

SEQ ID NO: 91111 - DNA, 369 bp, Artificial Sequence
  Description of Artificial Sequence: Synthetic coding sequence
atgagattcctggccgccaccttcctgctgctggccctgagcaccgccgcccaggccgagcccgtgcagttcaaggactgcggcagcgtggacggcgtgatcaaggaggtgaacgtgagcccctgccccacccagccctgccagctgagcaagggccagagctacagcgtgaacgtgaccttcaccagcaacatccagagcaagagcagcaaggccgtggtgcacggcatcctgatgggcgtgcccgtgcccttccccatccccgagcccgacggctgcaagagcggcatcaactgccccatccagaaggacaagacctacagctacctgaacaagctgcccgtgaagagcgagtaccccagcgtgtag

SEQ ID NO: 91112 - DNA, 456 bp, Artificial Sequence
  Description of Artificial Sequence: Synthetic coding sequence
atgagattcctggccgccaccttcctgctgctggccctgagcaccgccgcccaggccgagcccgtgcagttcaaggactgcggcagcgtggacggcgtgatcaaggaggtgaacgtgagcccctgccccacccagccctgccagctgagcaagggccagagctacagcgtgaacgtgaccttcaccagcaacatccagagcaagagcagcaaggccgtggtgcacggcatcctgatgggcgtgcccgtgcccttccccatccccgagcccgacggctgcaagagcggcatcaactgccccatccagaaggacaagacctacagctacctgaacaagctgcccgtgaagagcgagtaccccagcatcaagctggtggtggagtggcagctgcaggacgacaagaaccagagcctgttctgctgggagatccccgtgcagatcgtgagccacctgtag

SEQ ID NO: 91113 - DNA, 1053 bp, Artificial Sequence
  Description of Artificial Sequence: Synthetic coding sequence
atggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatcgacggcgtgagcgtgaccagcttcagcgccagaaccggcaacgaggagcagaccagaatcaacctgaactgcacccagaaggccctgatgcaggtggtggacttcctgagcagaaacaagcagctgtaccagaagaccgagatcctgagcctggagaagcccctgctgctgcacaccggcatgggcagactgtgcaccctggacgagagcgtgagcctggccaccatgatcgacagaatcaagagacacctgaagctgagccacatcagactggccctgggcgtgggcagaaccctggagagccaggtgaaggtggtggccctgtgcgccggcagcggcagcagcgtgctgcagggcgtggaggccgacctgtacctgaccggcgagatgagccaccacgacaccctggacgccgccagccagggcatcaacgtgatcctgtgcgagcacagcaacaccgagagaggcttcctgagcgacctgagagacatgctggacagccacctggagaacaagatcaacatcatcctgagcgagaccgacagagaccccctgcaggtggtgtag

SEQ ID NO: 91114 - DNA, 759 bp, Artificial Sequence
  Description of Artificial Sequence: Synthetic coding sequence
atgctgagcagctgcgtgagacccgtgcccaccaccgtgagattcgtggacagcctgatctgcaacagcagcagaagcttcatggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatcgacggcgtgagcgtgaccagcttcagcgccagaaccggcaacgaggagcagaccagaatcaacctgaactgcacccagaaggccctgatgcaggtggtggacttcctgagcagaaacaagcagctgtaccagaagcaccaggacaacaccttctacaagagcgccggctgccagctgaagttcgtgacctag

SEQ ID NO: 91115 - DNA, 1134 bp, Artificial Sequence
  Description of Artificial Sequence: Synthetic coding sequence
atgctgagcagctgcgtgagacccgtgcccaccaccgtgagattcgtggacagcctgatctgcaacagcagcagaagcttcatggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatcgacggcgtgagcgtgaccagcttcagcgccagaaccggcaacgaggagcagaccagaatcaacctgaactgcacccagaaggccctgatgcaggtggtggacttcctgagcagaaacaagcagctgtaccagaagaccgagatcctgagcctggagaagcccctgctgctgcacaccggcatgggcagactgtgcaccctggacgagagcgtgagcctggccaccatgatcgacagaatcaagagacacctgaagctgagccacatcagactggccctgggcgtgggcagaaccctggagagccaggtgaaggtggtggccctgtgcgccggcagcggcagcagcgtgctgcagggcgtggaggccgacctgtacctgaccggcgagatgagccaccacgacaccctggacgccgccagccagggcatcaacgtgatcctgtgcgagcacagcaacaccgagagaggcttcctgagcgacctgagagacatgctggacagccacctggagaacaagatcaacatcatcctgagcgagaccgacagagaccccctgcaggtggtgtag

SEQ ID NO: 91116 - DNA, 489 bp, Artificial Sequence
  Description of Artificial Sequence: Synthetic coding sequence
atggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatctag

SEQ ID NO: 91117 - DNA, 1134 bp, Artificial Sequence; identical to SEQ ID NO: 91115
  Description of Artificial Sequence: Synthetic coding sequence

SEQ ID NO: 91118 - DNA, 858 bp, Artificial Sequence
  Description of Artificial Sequence: Synthetic coding sequence
atgctgagcagctgcgtgagacccgtgcccaccaccgtgagattcgtggacagcctgatctgcaacagcagcagaagcttcatggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatcgacggcgtgagcgtgaccagcttcagcgccagaaccggcaacgaggagcagaccagaatcaacctgaactgcacccagaaggccctgatgcaggtggtggacttcctgagcagaaacaagcagctgtaccagaagaccgagatcctgagcctggagaagagcctgaagagcaagagctggccctgcgtgctggtgctgggcgccgccttctgcagagtgctgagactgaccttcaccagccaggtgagatgccccatcatgatcctgtggatgctgctgcccaaggagtag

SEQ ID NO: 91119 - DNA, 1134 bp, Artificial Sequence; identical to SEQ ID NO: 91115
  Description of Artificial Sequence: Synthetic coding sequence

SEQ ID NO: 91120 - DNA, 630 bp, Artificial Sequence
  Description of Artificial Sequence: Synthetic coding sequence
atggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccaccgagggcaaccacagagtggagttcaacgtgaactacacccaggacctggacaaggtgatgagcgccgtgaagggcatcgacggcgtgagcgtgaccagcttcagcgccagaaccggcaacgaggagcagaccagaatcaacctgaactgcacccagaaggccctgatgcaggtggtggacttcctgagcagaaacaagcagctgtaccagaagaccgagtag

SEQ ID NO: 91121 - DNA, 492 bp, Artificial Sequence
  Description of Artificial Sequence: Synthetic coding sequence
atgctgagcagctgcgtgagacccgtgcccaccaccgtgagattcgtggacagcctgatctgcaacagcagcagaagcttcatggacctgaaggccctgctgagcagcctgaacgacttcgccagcctgagcttcgccgagagctgggacaacgtgggcctgctggtggagcccagccccccccacaccgtgaacaccctgttcctgaccaacgacctgaccgaggaggtgatggaggaggtgctgcagaagaaggccgacctgatcctgagctaccacccccccatcttcagacccatgaagagaatcacctggaacacctggaaggagagactggtgatcagagccctggagaacagagtgggcatctacagcccccacaccgcctacgacgccgccccccagggcgtgaacaactggctggccaagggcctgggcgcctgcaccagcagacccatccaccccagcaaggcccccaactaccccacctag

SEQ ID NO: 91122 - DNA, 4749 bp, Artificial Sequence
  Description of Artificial Sequence: Synthetic coding sequence
atggccggccccggcggctggagagacagagaggtgaccgacctgggccacctgcccgaccccaccggcatcttcagcctggacaagaccatcggcctgggcacctacggcagaatctacctgggcctgcacgagaagaccggcgccttcaccgccgtgaaggtgatgaacgccagaaagacccccctgcccgagatcggcagaagagtgagagtgaacaagtaccagaagagcgtgggctggagatacagcgacgaggaggaggacctgagaaccgagctgaacctgctgagaaagtacagcttccacaagaacatcgtgagcttctacggcgccttcttcaagctgagcccccccggccagagacaccagctgtggatggtgatggagctgtgcgccgccggcagcgtgaccgacgtggtgagaatgaccagcaaccagagcctgaaggaggactggatcgcctacatctgcagagagatcctgcagggcctggcccacctgcacgcccacagagtgatccacagagacatcaagggccagaacgtgctgctgacccacaacgccgaggtgaagctggtggacttcggcgtgagcgcccaggtgagcagaaccaacggcagaagaaacagcttcatcggcaccccctactggatggcccccgaggtgatcgactgcgacgaggaccccagaagaagctacgactacagaagcgacgtgtggagcgtgggcatcaccgccatcgagatggccgagggcgccccccccctgtgcaacctgcagcccctggaggccctgttcgtgatcctgagagagagcgcccccaccgtgaagagcagcggctggagcagaaagttccacaacttcatggagaagtgcaccatcaagaacttcctgttcagacccaccagcgccaacatgctgcagcaccccttcgtgagagacatcaagaacgagagacacgtggtggagagcctgaccagacacctgaccggcatcatcaagaagagacagaagaagggcatccccctgatcttcgagagagaggaggccatcaaggagcagtacaccgtgagaagattcagaggccccagctgcacccacgagctgctgagactgcccaccagcagcagatgcagacccctgagagtgctgcacggcgagcccagccagcccagatggctgcccgacagagaggagccccaggtgcaggccctgcagcagctgcagggcgccgccagagtgttcatgcccctgcaggccctggacagcgcccccaagcccctgaagggccaggcccaggccccccagagactgcagggcgccgccagagtgttcatgcccctgcaggcccaggtgaaggccaaggccagcaagcccctgcagatgcagatcaaggccccccccagactgagaagagccgccagagtgctgatgcccctgcaggcccaggtgagagcccccagactgctgcaggtgcagagccaggtgagcaagaagcagcaggcccagacccagaccagcgagccccaggacctggaccaggtgcccgaggagttccagggccaggaccaggtgcccgagcagcagagacagggccaggcccccgagcagcagcagagacacaaccaggtgcccgagcaggagctggagcagaaccaggcccccgagcagcccgaggtgcaggagcaggccgccgagcccgcccaggccgagaccgaggccgaggagcccgagagcctgagagtgaacgcccaggtgttcctgcccctgctgagccaggaccaccacgtgctgctgcccctgcacctggacacccaggtgctgatccccgtggagggccagaccgagggcagcccccaggcccaggcctggaccctggagcccccccaggccatcggcagcgtgcaggccctgatcgagggcctgagcagagacctgctgagagcccccaacagcaacaacagcaagcccctgggccccctgcagaccctgatggagaacctgagcagcaacagattctacagccagcccgagcaggccagagagaagaagagcaaggtgagcaccctgagacaggccctggccaagagactgagccccaagagattcagagccaagagcagctggagacccgagaagctggagctgagcgacctggaggccagaagacagagaagacagagaagatgggaggacatcttcaaccagcacgaggaggagctgagacaggtggacaaggacaaggaggacgagagcagcgacaacgacgaggtgttccacagcatccaggccgaggtgcagatcgagcccctgaagccctacatcagcaaccccaagaagatcgaggtgcaggagagaagccccagcgtgcccaacaaccaggaccacgcccaccacgtgaagttcagcagcagcgtgccccagagaagcctgctggagcaggcccagaagcccatcgacatcagacagagaagcagccagaacagacagaactggctggccgccagcgagagcagcagcgaggaggagagccccgtgaccggcagaagaagccagagcagccccccctacagcaccatcgaccagaagctgctggtggacatccacgtgcccgacggcttcaaggtgggcaagatcagcccccccgtgtacctgaccaacgagtgggtgggctacaacgccctgagcgagatcttcagaaacgactggctgacccccgcccccgtgatccagccccccgaggaggacggcgactacgtggagctgtacgacgccagcgccgacaccgacggcgacgacgacgacgagagcaacgacaccttcgaggacacctacgaccacgccaacggcaacgacgacctggacaaccaggtggaccaggccaacgacgtgtgcaaggaccacgacgacgacaacaacaagttcgtggacgacgtgaacaacaactactacgaggcccccagctgccccagagccagctacggcagagacggcagctgcaagcaggacggctacgacggcagcagaggcaaggaggaggcctacagaggctacggcagccacaccgccaacagaagccacggcggcagcgccgccagcgaggacaacgccgccatcggcgaccaggaggagcacgccgccaacatcggcagcgagagaagaggcagcgagggcgacggcggcaagggcgtggtgagaaccagcgaggagagcggcgccctgggcctgaacggcgaggagaactgcagcgagaccgacggccccggcctgaagagacccgccagccaggacttcgagtacctgcaggaggagcccggcggcggcaacgaggccagcaacgccatcgacagcggcgccgcccccagcgcccccgaccacgagagcgacaacaaggacatcagcgagagcagcacccagagcgacttcagcgccaaccacagcagccccagcaagggcagcggcatgagcgccgacgccaacttcgccagcgccatcctgtacgccggcttcgtggaggtgcccgaggagagccccaagcagcccagcgaggtgaacgtgaaccccctgtacgtgagccccgcctgcaagaagcccctgatccacatgtacgagaaggagttcaccagcgagatctgctgcggcagcctgtggggcgtgaacctgctgctgggcaccagaagcaacctgtacctgatggacagaagcggcaaggccgacatcaccaagctgatcagaagaagacccttcagacagatccaggtgctggagcccctgaacctgctgatcaccatcagcggccacaagaacagactgagagtgtaccacctgacctggctgagaaacaagatcctgaacaacgaccccgagagcaagagaagacaggaggagatgctgaagaccgaggaggcctgcaaggccatcgacaagctgaccggctgcgagcacttcagcgtgctgcagcacgaggagaccacctacatcgccatcgccctgaagagcagcatccacctgtacgcctgggcccccaagagcttcgacgagagcaccgccatcaaggtgtgcatcgaccagagcgccgacagcgagggcgactacatgagctaccaggcctacatcagaatcctggccaagatccaggccgccgaccccgtgaacagattcaagagacccgacgagctgctgcacctgctgaagctgaaggtgttccccaccctggaccacaagcccgtgaccgtggacctggccatcggcagcgagaagagactgaagatcttcttcagcagcgccgacggctaccacctgatcgacgccgagagcgaggtgatgagcgacgtgaccctgcccaagaaccccctggagatcatcatcccccagaacatcatcatcctgcccgactgcctgggcatcggcatgatgctgaccttcaacgccgaggccctgagcgtggaggccaacgagcagctgttcaagaagatcctggagatgtggaaggacatccccagcagcatcgccttcgagtgcacccagagaaccaccggctggggccagaaggccatcgaggtgagaagcctgcagagcagagtgctggagagcgagctgaagagaagaagcatcaagaagctgagattcctgtgcaccagaggcgacaagctgttcttcaccagcaccctgagaaaccaccacagcagagtgtacttcatgaccctgggcaagctggaggagctgcagagcaactacgacgtgtag

SEQ ID NO: 91123 - DNA, 4752 bp, Artificial Sequence
  Description of Artificial Sequence: Synthetic coding sequence
atggccggccccggcggctggagagacagagaggtgaccgacctgggccacctgcccgaccccaccggcatcttcagcctggacaagaccatcggcctgggcacctacggcagaatctacctgggcctgcacgagaagaccggcgccttcaccgccgtgaaggtgatgaacgccagaaagacccccctgcccgagatcggcagaagagtgagagtgaacaagtaccagaagagcgtgggctggagatacagcgacgaggaggaggacctgagaaccgagctgaacctgctgagaaagtacagcttccacaagaacatcgtgagcttctacggcgccttcttcaagctgagcccccccggccagagacaccagctgtggatggtgatggagctgtgcgccgccggcagcgtgaccgacgtggtgagaatgaccagcaaccagagcctgaaggaggactggatcgcctacatctgcagagagatcctgcagggcctggcccacctgcacgcccacagagtgatccacagagacatcaagggccagaacgtgctgctgacccacaacgccgaggtgaagctggtggacttcggcgtgagcgcccaggtgagcagaaccaacggcagaagaaacagcttcatcggcaccccctactggatggcccccgaggtgatcgactgcgacgaggaccccagaagaagctacgactacagaagcgacgtgtggagcgtgggcatcaccgccatcgagatggccgagggcgccccccccctgtgcaacctgcagcccctggaggccctgttcgtgatcctgagagagagcgcccccaccgtgaagagcagcggctggagcagaaagttccacaacttcatggagaagtgcaccatcaagaacttcctgttcagacccaccagcgccaacatgctgcagcaccccttcgtgagagacatcaagaacgagagacacgtggtggagagcctgaccagacacctgaccggcatcatcaagaagagacagaagaagaagggcatccccctgatcttcgagagagaggaggccatcaaggagcagtacaccgtgagaagattcagaggccccagctgcacccacgagctgctgagactgcccaccagcagcagatgcagacccctgagagtgctgcacggcgagcccagccagcccagatggctgcccgacagagaggagccccaggtgcaggccctgcagcagctgcagggcgccgccagagtgttcatgcccctgcaggccctggacagcgcccccaagcccctgaagggccaggcccaggccccccagagactgcagggcgccgccagagtgttcatgcccctgcaggcccaggtgaaggccaaggccagcaagcccctgcagatgcagatcaaggccccccccagactgagaagagccgccagagtgctgatgcccctgcaggcccaggtgagagcccccagactgctgcaggtgcagagccaggtgagcaagaagcagcaggcccagacccagaccagcgagccccaggacctggaccaggtgcccgaggagttccagggccaggaccaggtgcccgagcagcagagacagggccaggcccccgagcagcagcagagacacaaccaggtgcccgagcaggagctggagcagaaccaggcccccgagcagcccgaggtgcaggagcaggccgccgagcccgcccaggccgagaccgaggccgaggagcccgagagcctgagagtgaacgcccaggtgttcctgcccctgctgagccaggaccaccacgtgctgctgcccctgcacctggacacccaggtgctgatccccgtggagggccagaccgagggcagcccccaggcccaggcctggaccctggagcccccccaggccatcggcagcgtgcaggccctgatcgagggcctgagcagagacctgctgagagcccccaacagcaacaacagcaagcccctgggccccctgcagaccctgatggagaacctgagcagcaacagattctacagccagcccgagcaggccagagagaagaagagcaaggtgagcaccctgagacaggccctggccaagagactgagccccaagagattcagagccaagagcagctggagacccgagaagctggagctgagcgacctggaggccagaagacagagaagacagagaagatgggaggacatcttcaaccagcacgaggaggagctgagacaggtggacaaggacaaggaggacgagagcagcgacaacgacgaggtgttccacagcatccaggccgaggtgcagatcgagcccctgaagccctacatcagcaaccccaagaagatcgaggtgcaggagagaagccccagcgtgcccaacaaccaggaccacgcccaccacgtgaagttcagcagcagcgtgccccagagaagcctgctggagcaggcccagaagcccatcgacatcagacagagaagcagccagaacagacagaactggctggccgccagcgagagcagcagcgaggaggagagccccgtgaccggcagaagaagccagagcagccccccctacagcaccatcgaccagaagctgctggtggacatccacgtgcccgacggcttcaaggtgggcaagatcagcccccccgtgtacctgaccaacgagtgggtgggctacaacgccctgagcgagatcttcagaaacgactggctgacccccgcccccgtgatccagccccccgaggaggacggcgactacgtggagctgtacgacgccagcgccgacaccgacggcgacgacgacgacgagagcaacgacaccttcgaggacacctacgaccacgccaacggcaacgacgacctggacaaccaggtggaccaggccaacgacgtgtgcaaggaccacgacgacgacaacaacaagttcgtggacgacgtgaacaacaactactacgaggcccccagctgccccagagccagctacggcagagacggcagctgcaagcaggacggctacgacggcagcagaggcaaggaggaggcctacagaggctacggcagccacaccgccaacagaagccacggcggcagcgccgccagcgaggacaacgccgccatcggcgaccaggaggagcacgccgccaacatcggcagcgagagaagaggcagcgagggcgacggcggcaagggcgtggtgagaaccagcgaggagagcggcgccctgggcctgaacggcgaggagaactgcagcgagaccgacggccccggcctgaagagacccgccagccaggacttcgagtacctgcaggaggagcccggcggcggcaacgaggccagcaacgccatcgacagcggcgccgcccccagcgcccccgaccacgagagcgacaacaaggacatcagcgagagcagcacccagagcgacttcagcgccaaccacagcagccccagcaagggcagcggcatgagcgccgacgccaacttcgccagcgccatcctgtacgccggcttcgtggaggtgcccgaggagagccccaagcagcccagcgaggtgaacgtgaaccccctgtacgtgagccccgcctgcaagaagcccctgatccacatgtacgagaaggagttcaccagcgagatctgctgcggcagcctgtggggcgtgaacctgctgctgggcaccagaagcaacctgtacctgatggacagaagcggcaaggccgacatcaccaagctgatcagaagaagacccttcagacagatccaggtgctggagcccctgaacctgctgatcaccatcagcggccacaagaacagactgagagtgtaccacctgacctggctgagaaacaagatcctgaacaacgaccccgagagcaagagaagacaggaggagatgctgaagaccgaggaggcctgcaaggccatcgacaagctgaccggctgcgagcacttcagcgtgctgcagcacgaggagaccacctacatcgccatcgccctgaagagcagcatccacctgtacgcctgggcccccaagagcttcgacgagagcaccgccatcaaggtgtgcatcgaccagagcgccgacagcgagggcgactacatgagctaccaggcctacatcagaatcctggccaagatccaggccgccgaccccgtgaacagattcaagagacccgacgagctgctgcacctgctgaagctgaaggtgttccccaccctggaccacaagcccgtgaccgtggacctggccatcggcagcgagaagagactgaagatcttcttcagcagcgccgacggctaccacctgatcgacgccgagagcgaggtgatgagcgacgtgaccctgcccaagaaccccctggagatcatcatcccccagaacatcatcatcctgcccgactgcctgggcatcggcatgatgctgaccttcaacgccgaggccctgagcgtggaggccaacgagcagctgttcaagaagatcctggagatgtggaaggacatccccagcagcatcgccttcgagtgcacccagagaaccaccggctggggccagaaggccatcgaggtgagaagcctgcagagcagagtgctggagagcgagctgaagagaagaagcatcaagaagctgagattcctgtgcaccagaggcgacaagctgttcttcaccagcaccctgagaaaccaccacagcagagtgtacttcatgaccctgggcaagctggaggagctgcagagcaactacgacgtgtag

SEQ ID NO: 91124 - DNA, 567 bp, Artificial Sequence
  Description of Artificial Sequence: Synthetic coding sequence
atggccggccccggcggctggagagacagagaggtgaccgacctgggccacctgcccgaccccaccggcatcttcagcctggacaagaccatcggcctgggcacctacggcagaatctacctgggcctgcacgagaagaccggcgccttcaccgccgtgaaggtgatgaacgccagaaagacccccctgcccgagatcggcagaagagtgagagtgaacaagtaccagaagagcgtgggctggagatacagcgacgaggaggaggacctgagaaccgagctgaacctgctgagaaagtacagcttccacaagaacatcgtgagcttctacggcgccttcttcaagctgagcccccccggccagagacaccagctgtggatggtgatggagctgtgcgccgccggcagcgtgaccgacgtggtgagaatgaccagcaaccagagcctgaaggaggactggatcgcctacatctgcagagagatcctgcagcccaaggtgatcttcctgggcaccggctgcagcgacagcagcctgaagaaggagctgtgcctgaagcaccagaactag

SEQ ID NO: 91125 - DNA, 492 bp, Artificial Sequence
  Description of Artificial Sequence: Synthetic coding sequence
atgcaggtgcccagagagagaatcaagatcgccttcagactgtggatccccatcctggtgatcagaatcgtggtggccggcacctggccccaggcccccggcctgagcaccctgggcctgaacatcatcatcctgcccgactgcctgggcatcggcatgatgctgaccttcaacgccgaggccctgagcgtggaggccaacgagcagctgttcaagaagatcctggagatgtggaaggacatccccagcagcatcgccttcgagtgcacccagagaaccaccggctggggccagaaggccatcgaggtgagaagcctgcagagcagagtgctggagagcgagctgaagagaagaagcatcaagaagctgagattcctgtgcaccagaggcgacaagctgttcttcaccagcaccctgagaaaccaccacagcagagtgtacttcatgaccctgggcaagctggaggagctgcagagcaactacgacgtgtag

SEQ ID NO: 91126 - DNA, 1449 bp, Artificial Sequence
  Description of Artificial Sequence: Synthetic coding sequence
atgctgaagttccaggaggccgccaagtgcgtgagcggcagcaccgccatcagcacctaccccaagaccctgatcgccagaagatacgtgctgcagcagaagctgggcagcggcagcttcggcaccgtgtacctggtgagcgacaagaaggccaagagaggcgaggagctgaaggtgctgaaggagatcagcgtgggcgagctgaaccccaacgagaccgtgcaggccaacctggaggcccagctgctgagcaagctggaccaccccgccatcgtgaagttccacgccagcttcgtggagcaggacaacttctgcatcatcaccgagtactgcgagggcagagacctggacgacaagatccaggagtacaagcaggccggcaagatcttccccgagaaccagatcatcgagtggttcatccagctgctgctgggcgtggactacatgcacgagagaagaatcctgcacagagacctgaagagcaagaacgtgttcctgaagaacaacctgctgaagatcggcgacttcggcgtgagcagactgctgatgggcagctgcgacctggccaccaccctgaccggcaccccccactacatgagccccgaggccctgaagcaccagggctacgacaccaagagcgacatctggagcctggcctgcatcctgtacgagatgtgctgcatgaaccacgccttcgccggcagcaacttcctgagcatcgtgctgaagatcgtggagggcgacacccccagcctgcccgagagataccccaaggagctgaacgccatcatggagagcatgctgaacaagaaccccagcctgagacccagcgccatcgagatcctgaagatcccctacctggacgagcagctgcagaacctgatgtgcagatacagcgagatgaccctggaggacaagaacctggactgccagaaggaggccgcccacatcatcaacgccatgcagaagagaatccacctgcagaccctgagagccctgagcgaggtgcagaagatgacccccagagagagaatgagactgagaaagctgcaggccgccgacgagaaggccagaaagctgaagaagatcgtggaggagaagtacgaggagaacagcaagagaatgcaggagctgagaagcagaaacttccagcagctgagcgtggacgtgctgcacgagaagacccacctgaagggcatggaggagaaggaggagcagcccgagggcagactgagctgcagcccccaggacgaggacgaggagagatggcagggcagagaggaggagagcgacgagcccaccctggagaacctgcccgagagccagcccatccccagcatggacctgcacgagctggagagcatcgtggaggacgccaccagcgacctgggctaccacggcgactgcaacctgatcagcctggacgagtactggaagaacgagaagtag

SEQ ID NO: 91127 - DNA, 1938 bp, Artificial Sequence
  Description of Artificial Sequence: Synthetic coding sequence
atgctgaagttccaggaggccgccaagtgcgtgagcggcagcaccgccatcagcacctaccccaagaccctgatcgccagaagatacgtgctgcagcagaagctgggcagcggcagcttcggcaccgtgtacctggtgagcgacaagaaggccaagagaggcgaggagctgaaggtgctgaaggagatcagcgtgggcgagctgaaccccaacgagaccgtgcaggccaacctggaggcccagctgctgagcaagctggaccaccccgccatcgtgaagttccacgccagcttcgtggagcaggacaacttctgcatcatcaccgagtactgcgagggcagagacctggacgacaagatccaggagtacaagcaggccggcaagatcttccccgagaaccagatcatcgagtggttcatccagctgctgctgggcgtggactacatgcacgagagaagaatcctgcacagagacctgaagagcaagaacgtgttcctgaagaacaacctgctgaagatcggcgacttcggcgtgagcagactgctgatgggcagctgcgacctggccaccaccctgaccggcaccccccactacatgagccccgaggccctgaagcaccagggctacgacaccaagagcgacatctggagcctggcctgcatcctgtacgagatgtgctgcatgaaccacgccttcgccggcagcaacttcctgagcatcgtgctgaagatcgtggagggcgacacccccagcctgcccgagagataccccaaggagctgaacgccatcatggagagcatgctgaacaagaaccccagcctgagacccagcgccatcgagatcctgaagatcccctacctggacgagcagctgcagaacctgatgtgcagatacagcgagatgaccctggaggacaagaacctggactgccagaaggaggccgcccacatcatcaacgccatgcagaagagaatccacctgcagaccctgagagccctgagcgaggtgcagaagatgacccccagagagagaatgagactgagaaagctgcaggccgccgacgagaaggccagaaagctgaagaagatcgtggaggagaagtacgaggagaacagcaagagaatgcaggagctgagaagcagaaacttccagcagctgagcgtggacgtgctgcacgagaagacccacctgaagggcatggaggagaaggaggagcagcccgagggcagactgagctgcagcccccaggacgaggacgaggagagatggcagggcagagaggaggagagcgacgagcccaccctggagaacctgcccgagagccagcccatccccagcatggacctgcacgagctggagagcatcgtggaggacgccaccagcgacctgggctaccacgagatccccgaggaccccctggtggccgaggagtactacgccgacgccttcgacagctactgcgaggagagcgacgaggaggaggaggagatcgccctggagagacccgagaaggagatcagaaacgagggcagccagcccgcctacagaaccaaccagcaggacagcgacatcgaggccctggccagatgcctggagaacgtgctgggctgcaccagcctggacaccaagaccatcaccaccatggccgaggacatgagccccggcccccccatcttcaacagcgtgatggccagaaccaagatgaagagaatgagagagagcgccatgcagaagctgggcaccgaggtgttcgaggaggtgtacaactacctgaagagagccagacaccagaacgccagcgaggccgagatcagagagtgcctggagaaggtggtgccccaggccagcgactgcttcgaggtggaccagctgctgtacttcgaggagcagctgctgatcaccatgggcaaggagcccaccctgcagaaccacctgtag

SEQ ID NO: 91128 - DNA, 1386 bp, Artificial Sequence
  Description of Artificial Sequence: Synthetic coding sequence
atgcacgagagaagaatcctgcacagagacctgaagagcaagaacgtgttcctgaagaacaacctgctgaagatcggcgacttcggcgtgagcagactgctgatgggcagctgcgacctggccaccaccctgaccggcaccccccactacatgagccccgaggccctgaagcaccagggctacgacaccaagagcgacatctggagcctggcctgcatcctgtacgagatgtgctgcatgaaccacgccttcgccggcagcaacttcctgagcatcgtgctgaagatcgtggagggcgacacccccagcctgcccgagagataccccaaggagctgaacgccatcatggagagcatgctgaacaagaaccccagcctgagacccagcgccatcgagatcctgaagatcccctacctggacgagcagctgcagaacctgatgtgcagatacagcgagatgaccctggaggacaagaacctggactgccagaaggaggccgcccacatcatcaacgccatgcagaagagaatccacctgcagaccctgagagccctgagcgaggtgcagaagatgacccccagagagagaatgagactgagaaagctgcaggccgccgacgagaaggccagaaagctgaagaagatcgtggaggagaagtacgaggagaacagcaagagaatgcaggagctgagaagcagaaacttccagcagctgagcgtggacgtgctgcacgagagcgacgagcccaccctggagaacctgcccgagagccagcccatccccagcatggacctgcacgagctggagagcatcgtggaggacgccaccagcgacctgggctaccacgagatccccgaggaccccctggtggccgaggagtactacgccgacgccttcgacagctactgcgaggagagcgacgaggaggaggaggagatcgccctggagagacccgagaaggagatcagaaacgagggcagccagcccgcctacagaaccaaccagcaggacagcgacatcgaggccctggccagatgcctggagaacgtgctgggctgcaccagcctggacaccaagaccatcaccaccatggccgaggacatgagccccggcccccccatcttcaacagcgtgatggccagaaccaagatgaagagaatgagagagagcgccatgcagaagctgggcaccgaggtgttcgaggaggtgtacaactacctgaagagagccagacaccagaacgccagcgaggccgagatcagagagtgcctggagaaggtggtgccccaggccagcgactgcttcgaggtggaccagctgctgtacttcgaggagcagctgctgatcaccatgggcaaggagcccaccctgcagaaccacctgtag

SEQ ID NO: 91129 - DNA, 1938 bp, Artificial Sequence; identical to SEQ ID NO: 91127
  Description of Artificial Sequence: Synthetic coding sequence

SEQ ID NO: 91130 - DNA, 1449 bp, Artificial Sequence; identical to SEQ ID NO: 91126
  Description of Artificial Sequence: Synthetic coding sequence

SEQ ID NO: 91131 - DNA, 1938 bp, Artificial Sequence; identical to SEQ ID NO: 91127
  Description of Artificial Sequence: Synthetic coding sequence

SEQ ID NO: 91132 - DNA, 1413 bp, Artificial Sequence
  Description of Artificial Sequence: Synthetic coding sequence
atgctgaagttccaggaggccgccaagtgcgtgagcggcagcaccgccatcagcacctaccccaagaccctgatcgccagaagatacgtgctgcagcagaagctgggcagcggcagcttcggcaccgtgtacctggtgagcgacaagaaggccaagagaggcgaggagctgaaggtgctgaaggagatcagcgtgggcgagctgaaccccaacgagaccgtgcaggccaacctggaggcccagctgctgagcaagctggaccaccccgccatcgtgaagttccacgccagcttcgtggagcaggacaacttctgcatcatcaccgagtactgcgagggcagagacctggacgacaagatccaggagtacaagcaggccggcaagatcttccccgagaaccagatcatcgagtggttcatccagctgctgctgggcgtggactacatgcacgagagaagaatcctgcacagagacctgaagagcaagaacgtgttcctgaagaacaacctgctgaagatcggcgacttcggcgtgagcagactgctgatgggcagctgcgacctggccaccaccctgaccggcaccccccactacatgagccccgaggccctgaagcaccagggctacgacaccaagagcgacatctggagcctggcctgcatcctgtacgagatgtgctgcatgaaccacgccttcgccggcagcaacttcctgagcatcgtgctgaagatcgtggagggcgacacccccagcctgcccgagagataccccaaggagctgaacgccatcatggagagcatgctgaacaagaaccccagcctgagacccagcgccatcgagatcctgaagatcccctacctggacgagcagctgcagaacctgatgtgcagatacagcgagatgaccctggaggacaagaacctggactgccagaaggaggccgcccacatcatcaacgccatgcagaagagaatccacctgcagaccctgagagccctgagcgaggtgcagaagatgacccccagagagagaatgagactgagaaagctgcaggccgccgacgagaaggccagaaagctgaagaagatcgtggaggagaagtacgaggagaacagcaagagaatgcaggagctgagaagcagaaacttccagcagctgagcgtggacgtgctgcacgagaagacccacctgaagggcatggaggagaaggaggagcagcccgagggcagactgagctgcagcccccaggacgaggacgaggagagatggcagggcagagaggaggagagcgacgagcccaccctggagaacctgcccgagagccagcccatccccagcatggacctgcacgagctggagagcatcgtggaggacgccaccagcgacctgggctaccacgccacccacagctag

SEQ ID NO: 91133 - DNA, 2079 bp, Artificial Sequence
  Description of Artificial Sequence: Synthetic coding sequence
atggagaagtacgagagaatcagagtggtgggcagaggcgccttcggcatcgtgcacctgtgcctgagaaaggccgaccagaagctggtgatcatcaagcagatccccgtggagcagatgaccaaggaggagagacaggccgcccagaacgagtgccaggtgctgaagctgctgaaccaccccaacgtgatcgagtactacgagaacttcctggaggacaaggccctgatgatcgccatggagtacgcccccggcggcaccctggccgagttcatccagaagagatgcaacagcctgctggaggaggagaccatcctgcacttcttcgtgcagatcctgctggccctgcaccacgtgcacacccacctgatcctgcacagagacctgaagacccagaacatcctgctggacaagcacagaatggtggtgaagatcggcgacttcggcatcagcaagatcctgagcagcaagagcaaggcctacaccgtggtgggcaccccctgctacatcagccccgagctgtgcgagggcaagccctacaaccagaagagcgacatctgggccctgggctgcgtgctgtacgagctggccagcctgaagagagccttcgaggccgccaacctgcccgccctggtgctgaagatcatgagcggcaccttcgcccccatcagcgacagatacagccccgagctgagacagctggtgctgagcctgctgagcctggagcccgcccagagaccccccctgagccacatcatggcccagcccctgtgcatcagagccctgctgaacctgcacaccgacgtgggcagcgtgagaatgagaagagccgagaagagcgtggcccccagcaacaccggcagcagaaccaccagcgtgagatgcagaggcatccccagaggccccgtgagacccgccatccccccccccctgagcagcgtgtacgcctggggcggcggcctgggcacccccctgagactgcccatgctgaacaccgaggtggtgcaggtggccgccggcagaacccagaaggccggcgtgaccagaagcggcagactgatcctgtgggaggccccccccctgggcgccggcggcggcagcctgctgcccggcgccgtggagcagccccagccccagttcatcagcagattcctggagggccagagcggcgtgaccatcaagcacgtggcctgcggcgacttcttcaccgcctgcctgaccgacagaggcatcatcatgaccttcggcagcggcagcaacggctgcctgggccacggcagcctgaccgacatcagccagcccaccatcgtggaggccctgctgggctacgagatggtgcaggtggcctgcggcgccagccacgtgctggccctgagcaccgagagagagctgttcgcctggggcagaggcgacagcggcagactgggcctgggcaccagagagagccacagctgcccccagcaggtgcccatgccccccggccaggaggcccagagagtggtgtgcggcatcgacagcagcatgatcctgaccgtgcccggccaggccctggcctgcggcagcaacagattcaacaagctgggcctggaccacctgagcctgggcgaggagcccgtgccccaccagcaggtggaggaggccctgagcttcaccctgctgggcagcgcccccctggaccaggagcccctgctgagcatcgacctgggcaccgcccacagcgccgccgtgaccgccagcggcgactgctacaccttcggcagcaaccagcacggccagctgggcaccaacaccagaagaggcagcagagccccctgcaaggtgcagggcctggagggcatcaagatggccatggtggcctgcggcgacgccttcaccgtggccatcggcgccgagagcgaggtgtacagctggggcaagggcgccagaggcagactgggcagaagagacgaggacgccggcctgcccagacccgtgcagctggacgagacccacccctacaccgtgaccagcgtgagctgctgccacggcaacaccctgctggccgtgagaagcgtgaccgacgagcccgtgcccccctag

SEQ ID NO: 91134 - DNA, 1383 bp, Artificial Sequence
  Description of Artificial Sequence: Synthetic coding sequence
atggagaagtacgagagaatcagagtggtgggcagaggcgccttcggcatcgtgcacctgtgcctgagaaaggccgaccagaagctggtgatcatcaagcagatccccgtggagcagatgaccaaggaggagagacaggccgcccagaacgagtgccaggtgctgaagctgctgaaccaccccaacgtgatcgagtactacgagaacttcctggaggacaaggccctgatgatcgccatggagtacgcccccggcggcaccctggccgagttcatccagaagagatgcaacagcctgctggaggaggagaccatcctgcacttcttcgtgcagatcctgctggccctgcaccacgtgcacacccacctgatcctgcacagagacctgaagacccagaacatcctgctggacaagcacagaatggtggtgaagatcggcgacttcggcatcagcaagatcctgagcagcaagagcaaggcctacaccgtggtgggcaccccctgctacatcagccccgagctgtgcgagggcaagccctacaaccagaagagcgacatctgggccctgggctgcgtgctgtacgagctggccagcctgaagagagccttcgaggccgccaacctgcccgccctggtgctgaagatcatgagcggcaccttcgcccccatcagcgacagatacagccccgagctgagacagctggtgctgagcctgctgagcctggagcccgcccagagaccccccctgagccacatcatggcccagcccctgtgcatcagagccctgctgaacctgcacaccgacgtgggcagcgtgagaatgagaagacccgtgcagggccagagagccgtgctgggcggcagagtgtgggcccccagcggcagcaccggcggcctgagacagagagagacctggggcaagagcagcctgcccgcctgcagaaacgtgagaagagtgttcgtgctgagaccccccagcgtgctgcagggcagagaggtgagaggcccccagcagcacagagagcaggaccaccagtgccccctgcagagatacccccccggcacctgcgaggccagccaccccaccaccaccgtggtgagcgtgtgcctgggctggtgggccggccacccccccgccgccgccaacgcccagcacagaggcggccccggcggcagctgggcccacgccgagagcagaagacacgccctgtgggccagccaccccgtgggcggccccacccccagatgcagaagaagacagagccccagctggggcagcggcgccgccaccgcccccgtgcacctggccttccccggcggccccgtgggctgcgaccaccaggccagaggcctgtggggcctgctgcactgcctgcccgactag

SEQ ID NO: 91135 - DNA, 2940 bp, Artificial Sequence
  Description of Artificial Sequence: Synthetic coding sequence
atgagcgtgctgggcgagtacgagagacactgcgacagcatcaacagcgacttcggcagcgagagcggcggctgcggcgacagcagccccggccccagcgccagccagggccccagagccggcggcggcgccgccgagcaggaggagctgcactacatccccatcagagtgctgggcagaggcgccttcggcgaggccaccctgtacagaagaaccgaggacgacagcctggtggtgtggaaggaggtggacctgaccagactgagcgagaaggagagaagagacgccctgaacgagatcgtgatcctggccctgctgcagcacgacaacatcatcgcctactacaaccacttcatggacaacaccaccctgctgatcgagctggagtactgcaacggcggcaacctgtacgacaagatcctgagacagaaggacaagctgttcgaggaggagatggtggtgtggtacctgttccagatcgtgagcgccgtgagctgcatccacaaggccggcatcctgcacagagacatcaagaccctgaacatcttcctgaccaaggccaacctgatcaagctgggcgactacggcctggccaagaagctgaacagcgagtacagcatggccgagaccctggtgggcaccccctactacatgagccccgagctgtgccagggcgtgaagtacaacttcaagagcgacatctgggccgtgggctgcgtgatcttcgagctgctgaccctgaagagaaccttcgacgccaccaaccccctgaacctgtgcgtgaagatcgtgcagggcatcagagccatggaggtggacagcagccagtacagcctggagctgatccagatggtgcacagctgcctggaccaggaccccgagcagagacccaccgccgacgagctgctggacagacccctgctgagaaagagaagaagagagatggaggagaaggtgaccctgctgaacgcccccaccaagagacccagaagcagcaccgtgaccgaggcccccatcgccgtggtgaccagcagaaccagcgaggtgtacgtgtggggcggcggcaagagcaccccccagaagctggacgtgatcaagagcggctgcagcgccagacaggtgtgcgccggcaacacccacttcgccgtggtgaccgtggagaaggagctgtacacctgggtgaacatgcagggcggcaccaagctgcacggccagctgggccacggcgacaaggccagctacagacagcccaagcacgtggagaagctgcagggcaaggccatcagacaggtgagctgcggcgacgacttcaccgtgtgcgtgaccgacgagggccagctgtacgccttcggcagcgactactacggctgcatgggcgtggacaaggtggccggccccgaggtgctggagcccatgcagctgaacttcttcctgagcaaccccgtggagcaggtgagctgcggcgacaaccacgtggtggtgctgaccagaaacaaggaggtgtacagctggggctgcggcgagtacggcagactgggcctggacagcgaggaggactactacaccccccagaaggtggacgtgcccaaggccctgatcatcgtggccgtgcagtgcggctgcgacggcaccttcctgctgacccagagcggcaaggtgctggcctgcggcctgaacgagttcaacaagctgggcctgaaccagtgcatgagcggcatcatcaaccacgaggcctaccacgaggtgccctacaccaccagcttcaccctggccaagcagctgagcttctacaagatcagaaccatcgcccccggcaagacccacaccgccgccatcgacgagagaggcagactgctgaccttcggctgcaacaagtgcggccagctgggcgtgggcaactacaagaagagactgggcatcaacctgctgggcggccccctgggcggcaagcaggtgatcagagtgagctgcggcgacgagttcaccatcgccgccaccgacgacaaccacatcttcgcctggggcaacggcggcaacggcagactggccatgacccccaccgagagaccccacggcagcgacatctgcaccagctggcccagacccatcttcggcagcctgcaccacgtgcccgacctgagctgcagaggctggcacaccatcctgatcgtggagaaggtgctgaacagcaagaccatcagaagcaacagcagcggcctgagcatcggcaccgtgttccagagcagcagccccggcggcggcggcggcggcggcggcggcgaggaggaggacagccagcaggagagcgagacccccgaccccagcggcggcttcagaggcaccatggaggccgacagaggcatggagggcctgatcagccccaccgaggccatgggcaacagcaacggcgccagcagcagctgccccggctggctgagaaaggagctggagaacgccgagttcatccccatgcccgacagccccagccccctgagcgccgccttcagcgagagcgagaaggacaccctgccctacgaggagctgcagggcctgaaggtggccagcgaggcccccctggagcacaagccccaggtggaggccagcagccccagactgaaccccgccgtgacctgcgccggcaagggcacccccctgaccccccccgcctgcgcctgcagcagcctgcaggtggaggtggagagactgcagggcctggtgctgaagtgcctggccgagcagcagaagctgcagcaggagaacctgcagatcttcacccagctgcagaagctgaacaagaagctggagggcggccagcaggtgggcatgcacagcaagggcacccagaccgccaaggaggagatggagatggaccccaagcccgacctggacagcgacagctggtgcctgctgggcaccgacagctgcagacccagcctgtag

SEQ ID NO: 91136 - DNA, 1545 bp, Artificial Sequence
  Description of Artificial Sequence: Synthetic coding sequence
atgagcgtgctgggcgagtacgagagacactgcgacagcatcaacagcgacttcggcagcgagagcggcggctgcggcgacagcagccccggccccagcgccagccagggccccagagccggcggcggcgccttcggcgaggccaccctgtacagaagaaccgaggacgacagcctggtggtgtggaaggaggtggacctgaccagactgagcgagaaggagagaagagacgccctgaacgagatcgtgatcctggccctgctgcagcacgacaacatcatcgcctactacaaccacttcatggacaacaccaccctgctgatcgagctggagtactgcaacggcggcaacctgtacgacaagatcctgagacagaaggacaagctgttcgaggaggagatggtggtgtggtacctgttccagatcgtgagcgccgtgagctgcatccacaaggccggcatcctgcacagagacatcaagaccctgaacatcttcctgaccaaggccaacctgatcaagctgggcgactacggcctggccaagaagctgaacagcgagtacagcatggccgagaccctggtgggcaccccctactacatgagccccgagctgtgccagggcgtgaagtacaacttcaagagcgacatctgggccgtgggctgcgtgatcttcgagctgctgaccctgaagagaaccttcgacgccaccaaccccctgaacctgtgcgtgaagatcgtgcagggcatcagagccatggaggtggacagcagccagtacagcctggagctgatccagatggtgcacagctgcctggaccaggaccccgagcagagacccaccgccgacgagctgctggacagacccctgctgagaaagagaagaagagagatggaggagaaggtgaccctgctgaacgcccccaccaagagacccagaagcagcaccgtgaccgaggcccccatcgccgtggtgaccagcagaaccagcgaggtgtacgtgtggggcggcggcaagagcaccccccagaagctggacgtgatcaagagcggctgcagcgccagacaggtgtgcgccggcaacacccacttcgccgtggtgaccgtggagaaggagctgtacacctgggtgaacatgcagggcggcaccaagctgcacggccagctgggccacggcgacaaggccagctacagacagcccaagcacgtggagaagctgcagggcaaggccatcagacaggtgagctgcggcgacgacttcaccgtgtgcgtgaccgacgagggccagctgtacgccttcggcagcgactactacggctgcatgggcgtggacaaggtggccggccccgaggtgctggagcccatgcagctgaacttcttcctgagcaaccccgtggagcaggtgagctgcggcgacaaccacgtggtggtgctgaccagaaacaaggaggtgtacagctggggctgcggcgagtacggcagaggcagcctggtgagcgtgcacttcttcaccggcatccagcccgacttcaaggtggtgtgcatctag

SEQ ID NO: 91137 - DNA, 3777 bp, Artificial Sequence
  Description of Artificial Sequence: Synthetic coding sequence
atggagaagtacgtgagactgcagaagatcggcgagggcagcttcggcaaggccatcctggtgaagagcaccgaggacggcagacagtacgtgatcaaggagatcaacatcagcagaatgagcagcaaggagagagaggagagcagaagagaggtggccgtgctggccaacatgaagcaccccaacatcgtgcagtacagagagagcttcgaggagaacggcagcctgtacatcgtgatggactactgcgagggcggcgacctgttcaagagaatcaacgcccagaagggcgtgctgttccaggaggaccagatcctggactggttcgtgcagatctgcctggccctgaagcacgtgcacgacagaaagatcctgcacagagacatcaagagccagaacatcttcctgaccaaggacggcaccgtgcagctgggcgacttcggcatcgccagagtgctgaacagcaccgtggagctggccagaacctgcatcggcaccccctactacctgagccccgagatctgcgagaacaagccctacaacaacaagagcgacatctgggccctgggctgcgtgctgtacgagctgtgcaccctgaagcacgccttcgaggccggcagcatgaagaacctggtgctgaagatcatcagcggcagcttcccccccgtgagcctgcactacagctacgacctgagaagcctggtgagccagctgttcaagagaaaccccagagacagacccagcgtgaacagcatcctggagaagggcttcatcgccaagagaatcgagaagttcctgagcccccagctgatcgccgaggagttctgcctgaagaccttcagcaagttcggcagccagcccatccccgccaagagacccgccagcggccagaacagcatcagcgtgatgcccgcccagaagatcaccaagcccgccgccaagtacggcatccccctggcctacaagaagtacggcgacaagaagctgcacgagaagaagcccctgcagaagcacaagcaggcccaccagacccccgagaagagagtgaacaccggcgaggagagaagaaagatcagcgaggaggccgccagaaagagaagactggagttcatcgagaaggagaagaagcagaaggaccagatcatcagcctgatgaaggccgagcagatgaagagacaggagaaggagagactggagagaatcaacagagccagagagcagggctggagaaacgtgctgagcgccggcggcagcggcgaggtgaaggcccccttcctgggcagcggcggcaccatcgcccccagcagcttcagcagcagaggccagtacgagcactaccacgccatcttcgaccagatgcagcagcagagagccgaggacaacgaggccaagtggaagagagagatctacggcagaggcctgcccgagagaggcatcctgcccggcgtgagacccggcttcccctacggcgccgccggccaccaccacttccccgacgccgacgacatcagaaagaccctgaagagactgaaggccgtgagcaagcaggccaacgccaacagacagaagggccagctggccgtggagagagccaagcaggtggaggagttcctgcagagaaagagagaggccatgcagaacaaggccagagccgagggccacatggtgtacctggccagactgagacagatcagactgcagaacttcaacgagagacagcagatcaaggccaagctgagaggcgagaagaaggaggccaaccacagcgagggccaggagggcagcgaggaggccgacatgagaagaaagaagatcgagagcctgaaggcccacgccaacgccagagccgccgtgctgaaggagcagctggagagaaagagaaaggaggcctacgagagagagaagaaggtgtgggaggagcacctggtggccaagggcgtgaagagcagcgacgtgagcccccccctgggccagcacgagaccggcggcagccccagcaagcagcagatgagaagcgtgatcagcgtgaccagcgccctgaaggaggtgggcgtggacagcagcctgaccgacaccagagagaccagcgaggagatgcagaagaccaacaacgccatcagcagcaagagagagatcctgagaagactgaacgagaacctgaaggcccaggaggacgagaagggcaagcagaacctgagcgacaccttcgagatcaacgtgcacgaggacgccaaggagcacgagaaggagaagagcgtgagcagcgacagaaagaagtgggaggccggcggccagctggtgatccccctggacgagctgaccctggacaccagcttcagcaccaccgagagacacaccgtgggcgaggtgatcaagctgggccccaacggcagccccagaagagcctggggcaagagccccaccgacagcgtgctgaagatcctgggcgaggccgagctgcagctgcagaccgagctgctggagaacaccaccatcagaagcgagatcagccccgagggcgagaagtacaagcccctgatcaccggcgagaagaaggtgcagtgcatcagccacgagatcaaccccagcgccatcgtggacagccccgtggagaccaagagccccgagttcagcgaggccagcccccagatgagcctgaagctggagggcaacctggaggagcccgacgacctggagaccgagatcctgcaggagcccagcggcaccaacaaggacgagagcctgccctgcaccatcaccgacgtgtggatcagcgaggagaaggagaccaaggagacccagagcgccgacagaatcaccatccaggagaacgaggtgagcgaggacggcgtgagcagcaccgtggaccagctgagcgacatccacatcgagcccggcaccaacgacagccagcacagcaagtgcgacgtggacaagagcgtgcagcccgagcccttcttccacaaggtggtgcacagcgagcacctgaacctggtgccccaggtgcagagcgtgcagtgcagccccgaggagagcttcgccttcagaagccacagccacctgccccccaagaacaagaacaagaacagcctgctgatcggcctgagcaccggcctgttcgacgccaacaaccccaagatgctgagaacctgcagcctgcccgacctgagcaagctgttcagaaccctgatggacgtgcccaccgtgggcgacgtgagacaggacaacctggagatcgacgagatcgaggacgagaacatcaaggagggccccagcgacagcgaggacatcgtgttcgaggagaccgacaccgacctgcaggagctgcaggccagcatggagcagctgctgagagagcagcccggcgaggagtacagcgaggaggaggagagcgtgctgaagaacagcgacgtggagcccaccgccaacggcaccgacgtggccgacgaggacgacaaccccagcagcgagagcgccctgaacgaggagtggcacagcgacaacagcgacggcgagatcgccagcgagtgcgagtgcgacagcgtgttcaaccacctggaggagctgagactgcacctggagcaggagatgggcttcgagaagttcttcgaggtgtacgagaagatcaaggccatccacgaggacgaggacgagaacatcgagatctgcagcaagatcgtgcagaacatcctgggcaacgagcaccagcacctgtacgccaagatcctgcacctggtgatggccgacggcgcctaccaggaggacaacgacgagtag

SEQ ID NO: 91138 - DNA, 3861 bp, Artificial Sequence
  Description of Artificial Sequence: Synthetic coding sequence
atggagaagtacgtgagactgcagaagatcggcgagggcagcttcggcaaggccatcctggtgaagagcaccgaggacggcagacagtacgtgatcaaggagatcaacatcagcagaatgagcagcaaggagagagaggagagcagaagagaggtggccgtgctggccaacatgaagcaccccaacatcgtgcagtacagagagagcttcgaggagaacggcagcctgtacatcgtgatggactactgcgagggcggcgacctgttcaagagaatcaacgcccagaagggcgtgctgttccaggaggaccagatcctggactggttcgtgcagatctgcctggccctgaagcacgtgcacgacagaaagatcctgcacagagacatcaagagccagaacatcttcctgaccaaggacggcaccgtgcagctgggcgacttcggcatcgccagagtgctgaacagcaccgtggagctggccagaacctgcatcggcaccccctactacctgagccccgagatctgcgagaacaagccctacaacaacaagagcgacatctgggccctgggctgcgtgctgtacgagctgtgcaccctgaagcacgccttcgaggccggcagcatgaagaacctggtgctgaagatcatcagcggcagcttcccccccgtgagcctgcactacagctacgacctgagaagcctggtgagccagctgttcaagagaaaccccagagacagacccagcgtgaacagcatcctggagaagggcttcatcgccaagagaatcgagaagttcctgagcccccagctgatcgccgaggagttctgcctgaagaccttcagcaagttcggcagccagcccatccccgccaagagacccgccagcggccagaacagcatcagcgtgatgcccgcccagaagatcaccaagcccgccgccaagtacggcatccccctggcctacaagaagtacggcgacaagaagctgcacgagaagaagcccctgcagaagcacaagcaggcccaccagacccccgagaagagagtgaacaccggcgaggagagaagaaagatcagcgaggaggccgccagaaagagaagactggagttcatcgagaaggagaagaagcagaaggaccagatcatcagcctgatgaaggccgagcagatgaagagacaggagaaggagagactggagagaatcaacagagccagagagcagggctggagaaacgtgctgagcgccggcggcagcggcgaggtgaaggcccccttcctgggcagcggcggcaccatcgcccccagcagcttcagcagcagaggccagtacgagcactaccacgccatcttcgaccagatgcagcagcagagagccgaggacaacgaggccaagtggaagagagagatctacggcagaggcctgcccgagagaggcatcctgcccggcgtgagacccggcttcccctacggcgccgccggccaccaccacttccccgacgccgacgacatcagaaagaccctgaagagactgaaggccgtgagcaagcaggccaacgccaacagacagaagggccagctggccgtggagagagccaagcaggtggaggagttcctgcagagaaagagagaggccatgcagaacaaggccagagccgagggccacatgggcatcctgcagaacctggccgccatgtacggcggcagacccagcagcagcagaggcggcaagcccagaaacaaggaggaggaggtgtacctggccagactgagacagatcagactgcagaacttcaacgagagacagcagatcaaggccaagctgagaggcgagaagaaggaggccaaccacagcgagggccaggagggcagcgaggaggccgacatgagaagaaagaagatcgagagcctgaaggcccacgccaacgccagagccgccgtgctgaaggagcagctggagagaaagagaaaggaggcctacgagagagagaagaaggtgtgggaggagcacctggtggccaagggcgtgaagagcagcgacgtgagcccccccctgggccagcacgagaccggcggcagccccagcaagcagcagatgagaagcgtgatcagcgtgaccagcgccctgaaggaggtgggcgtggacagcagcctgaccgacaccagagagaccagcgaggagatgcagaagaccaacaacgccatcagcagcaagagagagatcctgagaagactgaacgagaacctgaaggcccaggaggacgagaagggcaagcagaacctgagcgacaccttcgagatcaacgtgcacgaggacgccaaggagcacgagaaggagaagagcgtgagcagcgacagaaagaagtgggaggccggcggccagctggtgatccccctggacgagctgaccctggacaccagcttcagcaccaccgagagacacaccgtgggcgaggtgatcaagctgggccccaacggcagccccagaagagcctggggcaagagccccaccgacagcgtgctgaagatcctgggcgaggccgagctgcagctgcagaccgagctgctggagaacaccaccatcagaagcgagatcagccccgagggcgagaagtacaagcccctgatcaccggcgagaagaaggtgcagtgcatcagccacgagatcaaccccagcgccatcgtggacagccccgtggagaccaagagccccgagttcagcgaggccagcccccagatgagcctgaagctggagggcaacctggaggagcccgacgacctggagaccgagatcctgcaggagcccagcggcaccaacaaggacgagagcctgccctgcaccatcaccgacgtgtggatcagcgaggagaaggagaccaaggagacccagagcgccgacagaatcaccatccaggagaacgaggtgagcgaggacggcgtgagcagcaccgtggaccagctgagcgacatccacatcgagcccggcaccaacgacagccagcacagcaagtgcgacgtggacaagagcgtgcagcccgagcccttcttccacaaggtggtgcacagcgagcacctgaacctggtgccccaggtgcagagcgtgcagtgcagccccgaggagagcttcgccttcagaagccacagccacctgccccccaagaacaagaacaagaacagcctgctgatcggcctgagcaccggcctgttcgacgccaacaaccccaagatgctgagaacctgcagcctgcccgacctgagcaagctgttcagaaccctgatggacgtgcccaccgtgggcgacgtgagacaggacaacctggagatcgacgagatcgaggacgagaacatcaaggagggccccagcgacagcgaggacatcgtgttcgaggagaccgacaccgacctgcaggagctgcaggccagcatggagcagctgctgagagagcagcccggcgaggagtacagcgaggaggaggagagcgtgctgaagaacagcgacgtggagcccaccgccaacggcaccgacgtggccgacgaggacgacaaccccagcagcgagagcgccctgaacgaggagtggcacagcgacaacagcgacggcgagatcgccagcgagtgcgagtgcgacagcgtgttcaaccacctggaggagctgagactgcacctggagcaggagatgggcttcgagaagttcttcgaggtgtacgagaagatcaaggccatccacgaggacgaggacgagaacatcgagatctgcagcaagatcgtgcagaacatcctgggcaacgagcaccagcacctgtacgccaagatcctgcacctggtgatggccgacggcgcctaccaggaggacaacgacgagtag

SEQ ID NO: 91139 - DNA, 3645 bp, Artificial Sequence
  Description of Artificial Sequence: Synthetic coding sequence
atggagaagtacgtgagactgcagaagatcggcgagggcagcttcggcaaggccatcctggtgaagagcaccgaggacggcagacagtacgtgatcaaggagatcaacatcagcagaatgagcagcaaggagagagaggagagcagaagagaggtggccgtgctggccaacatgaagcaccccaacatcgtgcagtacagagagagcttcgaggagaacggcagcctgtacatcgtgatggactactgcgagggcggcgacctgttcaagagaatcaacgcccagaagggcgtgctgttccaggaggaccagatcctggactggttcgtgcagatctgcctggccctgaagcacgtgcacgacagaaagatcctgcacagagacatcaagagccagaacatcttcctgaccaaggacggcaccgtgcagctgggcgacttcggcatcgccagagtgctgaacagcaccgtggagctggccagaacctgcatcggcaccccctactacctgagccccgagatctgcgagaacaagccctacaacaacaagagcgacatctgggccctgggctgcgtgctgtacgagctgtgcaccctgaagcacgccttcgaggccggcagcatgaagaacctggtgctgaagatcatcagcggcagcttcccccccgtgagcctgcactacagctacgacctgagaagcctggtgagccagctgttcaagagaaaccccagagacagacccagcgtgaacagcatcctggagaagggcttcatcgccaagagaatcgagaagttcctgagcccccagctgatcgccgaggagttctgcctgaagaccttcagcaagttcggcagccagcccatccccgccaagagacccgccagcggccagaacagcatcagcgtgatgcccgcccagaagatcaccaagcccgccgccaagtacggcatccccctggcctacaagaagtacggcgacaagaagctgcacgagaagaagcccctgcagaagcacaagcaggcccaccagacccccgagaagagagtgaacaccggcgaggagagaagaaagatcagcgaggaggccgccagaaagagaagactggagttcatcgagaaggagaagaagcagaaggaccagatcatcagcctgatgaaggccgagcagatgaagagacaggagaaggagagactggagagaatcaacagagccagagagcagggctggagaaacgtgctgagcgccggcggcagcggcgaggtgaaggcccccttcctgggcagcggcggcaccatcgcccccagcagcttcagcagcagaggccagtacgagcactaccacgccatcttcgaccagatgcagcagcagagagccgaggacaacgaggccaagtggaagagagagatctacggcagaggcctgcccgagagacagaagggccagctggccgtggagagagccaagcaggtggaggagttcctgcagagaaagagagaggccatgcagaacaaggccagagccgagggccacatggtgtacctggccagactgagacagatcagactgcagaacttcaacgagagacagcagatcaaggccaagctgagaggcgagaagaaggaggccaaccacagcgagggccaggagggcagcgaggaggccgacatgagaagaaagaagatcgagagcctgaaggcccacgccaacgccagagccgccgtgctgaaggagcagctggagagaaagagaaaggaggcctacgagagagagaagaaggtgtgggaggagcacctggtggccaagggcgtgaagagcagcgacgtgagcccccccctgggccagcacgagaccggcggcagccccagcaagcagcagatgagaagcgtgatcagcgtgaccagcgccctgaaggaggtgggcgtggacagcagcctgaccgacaccagagagaccagcgaggagatgcagaagaccaacaacgccatcagcagcaagagagagatcctgagaagactgaacgagaacctgaaggcccaggaggacgagaagggcaagcagaacctgagcgacaccttcgagatcaacgtgcacgaggacgccaaggagcacgagaaggagaagagcgtgagcagcgacagaaagaagtgggaggccggcggccagctggtgatccccctggacgagctgaccctggacaccagcttcagcaccaccgagagacacaccgtgggcgaggtgatcaagctgggccccaacggcagccccagaagagcctggggcaagagccccaccgacagcgtgctgaagatcctgggcgaggccgagctgcagctgcagaccgagctgctggagaacaccaccatcagaagcgagatcagccccgagggcgagaagtacaagcccctgatcaccggcgagaagaaggtgcagtgcatcagccacgagatcaaccccagcgccatcgtggacagccccgtggagaccaagagccccgagttcagcgaggccagcccccagatgagcctgaagctggagggcaacctggaggagcccgacgacctggagaccgagatcctgcaggagcccagcggcaccaacaaggacgagagcctgccctgcaccatcaccgacgtgtggatcagcgaggagaaggagaccaaggagacccagagcgccgacagaatcaccatccaggagaacgaggtgagcgaggacggcgtgagcagcaccgtggaccagctgagcgacatccacatcgagcccggcaccaacgacagccagcacagcaagtgcgacgtggacaagagcgtgcagcccgagcccttcttccacaaggtggtgcacagcgagcacctgaacctggtgccccaggtgcagagcgtgcagtgcagccccgaggagagcttcgccttcagaagccacagccacctgccccccaagaacaagaacaagaacagcctgctgatcggcctgagcaccggcctgttcgacgccaacaaccccaagatgctgagaacctgcagcctgcccgacctgagcaagctgttcagaaccctgatggacgtgcccaccgtgggcgacgtgagacaggacaacctggagatcgacgagatcgaggacgagaacatcaaggagggccccagcgacagcgaggacatcgtgttcgaggagaccgacaccgacctgcaggagctgcaggccagcatggagcagctgctgagagagcagcccggcgaggagtacagcgaggaggaggagagcgtgctgaagaacagcgacgtggagcccaccgccaacggcaccgacgtggccgacgaggacgacaaccccagcagcgagagcgccctgaacgaggagtggcacagcgacaacagcgacggcgagatcgccagcgagtgcgagtgcgacagcgtgttcaaccacctggaggagctgagactgcacctggagcaggagatgggcttcgagaagttcttcgaggtgtacgagaagatcaaggccatccacgaggacgaggacgagaacatcgagatctgcagcaagatcgtgcagaacatcctgggcaacgagcaccagcacctgtacgccaagatcctgcacctggtgatggccgacggcgcctaccaggaggacaacgacgagtag

SEQ ID NO: 91140 - DNA, 3570 bp, Artificial Sequence
  Description of Artificial Sequence: Synthetic coding sequence
atggagaagtacgtgagactgcagaagatcggcgagggcagcttcggcaaggccatcctggtgaagagcaccgaggacggcagacagtacgtgatcaaggagatcaacatcagcagaatgagcagcaaggagagagaggagagcagaagagaggtggccgtgctggccaacatgaagcaccccaacatcgtgcagtacagagagagcttcgaggagaacggcagcctgtacatcgtgatggactactgcgagggcggcgacctgttcaagagaatcaacgcccagaagggcgtgctgttccaggaggaccagatcctggactggttcgtgcagatctgcctggccctgaagcacgtgcacgacagaaagatcctgcacagagacatcaagagccagaacatcttcctgaccaaggacggcaccgtgcagctgggcgacttcggcatcgccagagtgctgaacagcaccgtggagctggccagaacctgcatcggcaccccctactacctgagccccgagatctgcgagaacaagccctacaacaacaagagcgacatctgggccctgggctgcgtgctgtacgagctgtgcaccctgaagcacgccttcgaggccggcagcatgaagaacctggtgctgaagatcatcagcggcagcttcccccccgtgagcctgcactacagctacgacctgagaagcctggtgagccagctgttcaagagaaaccccagagacagacccagcgtgaacagcatcctggagaagggcttcatcgccaagagaatcgagaagttcctgagcccccagctgatcgccgaggagttctgcctgaagaccttcagcaagttcggcagccagcccatccccgccaagagacccgccagcggccagaacagcatcagcgtgatgcccgcccagaagatcaccaagcccgccgccaagtacggcatccccctggcctacaagaagtacggcgacaagaagctgcacgagaagaagcccctgcagaagcacaagcaggcccaccagacccccgagaagagagtgaacaccggcgaggagagaagaaagatcagcgaggaggccgccagaaagagaagactggagttcatcgagaaggagaagaagcagaaggaccagatcatcagcctgatgaaggccgagcagatgaagagacaggagaaggagagagcccccttcctgggcagcggcggcaccatcgcccccagcagcttcagcagcagaggccagtacgagcactaccacgccatcttcgaccagatgcagcagcagagagccgaggacaacgaggccaagtggaagagagagatctacggcagaggcctgcccgagagacagaagggccagctggccgtggagagagccaagcaggtggaggagttcctgcagagaaagagagaggccatgcagaacaaggccagagccgagggccacatggtgtacctggccagactgagacagatcagactgcagaacttcaacgagagacagcagatcaaggccaagctgagaggcgagaagaaggaggccaaccacagcgagggccaggagggcagcgaggaggccgacatgagaagaaagaagatcgagagcctgaaggcccacgccaacgccagagccgccgtgctgaaggagcagctggagagaaagagaaaggaggcctacgagagagagaagaaggtgtgggaggagcacctggtggccaagggcgtgaagagcagcgacgtgagcccccccctgggccagcacgagaccggcggcagccccagcaagcagcagatgagaagcgtgatcagcgtgaccagcgccctgaaggaggtgggcgtggacagcagcctgaccgacaccagagagaccagcgaggagatgcagaagaccaacaacgccatcagcagcaagagagagatcctgagaagactgaacgagaacctgaaggcccaggaggacgagaagggcaagcagaacctgagcgacaccttcgagatcaacgtgcacgaggacgccaaggagcacgagaaggagaagagcgtgagcagcgacagaaagaagtgggaggccggcggccagctggtgatccccctggacgagctgaccctggacaccagcttcagcaccaccgagagacacaccgtgggcgaggtgatcaagctgggccccaacggcagccccagaagagcctggggcaagagccccaccgacagcgtgctgaagatcctgggcgaggccgagctgcagctgcagaccgagctgctggagaacaccaccatcagaagcgagatcagccccgagggcgagaagtacaagcccctgatcaccggcgagaagaaggtgcagtgcatcagccacgagatcaaccccagcgccatcgtggacagccccgtggagaccaagagccccgagttcagcgaggccagcccccagatgagcctgaagctggagggcaacctggaggagcccgacgacctggagaccgagatcctgcaggagcccagcggcaccaacaaggacgagagcctgccctgcaccatcaccgacgtgtggatcagcgaggagaaggagaccaaggagacccagagcgccgacagaatcaccatccaggagaacgaggtgagcgaggacggcgtgagcagcaccgtggaccagctgagcgacatccacatcgagcccggcaccaacgacagccagcacagcaagtgcgacgtggacaagagcgtgcagcccgagcccttcttccacaaggtggtgcacagcgagcacctgaacctggtgccccaggtgcagagcgtgcagtgcagccccgaggagagcttcgccttcagaagccacagccacctgccccccaagaacaagaacaagaacagcctgctgatcggcctgagcaccggcctgttcgacgccaacaaccccaagatgctgagaacctgcagcctgcccgacctgagcaagctgttcagaaccctgatggacgtgcccaccgtgggcgacgtgagacaggacaacctggagatcgacgagatcgaggacgagaacatcaaggagggccccagcgacagcgaggacatcgtgttcgaggagaccgacaccgacctgcaggagctgcaggccagcatggagcagctgctgagagagcagcccggcgaggagtacagcgaggaggaggagagcgtgctgaagaacagcgacgtggagcccaccgccaacggcaccgacgtggccgacgaggacgacaaccccagcagcgagagcgccctgaacgaggagtggcacagcgacaacagcgacggcgagatcgccagcgagtgcgagtgcgacagcgtgttcaaccacctggaggagctgagactgcacctggagcaggagatgggcttcgagaagttcttcgaggtgtacgagaagatcaaggccatccacgaggacgaggacgagaacatcgagatctgcagcaagatcgtgcagaacatcctgggcaacgagcaccagcacctgtacgccaagatcctgcacctggtgatggccgacggcgcctaccaggaggacaacgacgagtag

SEQ ID NO: 91141 - DNA, 1155 bp, Artificial Sequence
  Description of Artificial Sequence: Synthetic coding sequence
atgcccagcagagccgaggactacgaggtgctgtacaccatcggcaccggcagctacggcagatgccagaagatcagaagaaagagcgacggcaagatcctggtgtggaaggagctggactacggcagcatgaccgaggccgagaagcagatgctggtgagcgaggtgaacctgctgagagagctgaagcaccccaacatcgtgagatactacgacagaatcatcgacagaaccaacaccaccctgtacatcgtgatggagtactgcgagggcggcgacctggccagcgtgatcaccaagggcaccaaggagagacagtacctggacgaggagttcgtgctgagagtgatgacccagctgaccctggccctgaaggagtgccacagaagaagcgacggcggccacaccgtgctgcacagagacctgaagcccgccaacgtgttcctggacggcaagcagaacgtgaagctgggcgacttcggcctggccagaatcctgaaccacgacaccagcttcgccaagaccttcgtgggcaccccctactacatgagccccgagcagatgaacagaatgagctacaacgagaagagcgacatctggagcctgggctgcctgctgtacgagctgtgcgccctgatgccccccttcaccgccttcagccagaaggagctggccggcaagatcagagagggcaagttcagaagaatcccctacagatacagcgacgagctgaacgagatcatcaccagaatgctgaacctgaaggactaccacagacccagcgtggaggagatcctggagaaccccctgatcgccgacctggtggccgacgagcagagaagaaacctggagagaagaggcagacagctgggcgagcccgagaagagccaggacagcagccccgtgctgagcgagctgaagctgaaggagatccagctgcaggagagagagagagccctgaaggccagagaggagagactggagcagaaggagcaggagctgtgcgtgagagagagactggccgaggacaagctggccagagccgagaacctgctgaagaactacagcctgctgaaggagagaaagttcctgagcctggccagcaaccccggcatgagaatcaacctggtgaacagaagctggtgctacaagtag

SEQ ID NO: 91142 - DNA, 1338 bp, Artificial Sequence
  Description of Artificial Sequence: Synthetic coding sequence
atgcccagcagagccgaggactacgaggtgctgtacaccatcggcaccggcagctacggcagatgccagaagatcagaagaaagagcgacggcaagatcctggtgtggaaggagctggactacggcagcatgaccgaggccgagaagcagatgctggtgagcgaggtgaacctgctgagagagctgaagcaccccaacatcgtgagatactacgacagaatcatcgacagaaccaacaccaccctgtacatcgtgatggagtactgcgagggcggcgacctggccagcgtgatcaccaagggcaccaaggagagacagtacctggacgaggagttcgtgctgagagtgatgacccagctgaccctggccctgaaggagtgccacagaagaagcgacggcggccacaccgtgctgcacagagacctgaagcccgccaacgtgttcctggacggcaagcagaacgtgaagctgggcgacttcggcctggccagaatcctgaaccacgacaccagcttcgccaagaccttcgtgggcaccccctactacatgagccccgagcagatgaacagaatgagctacaacgagaagagcgacatctggagcctgggctgcctgctgtacgagctgtgcgccctgatgccccccttcaccgccttcagccagaaggagctggccggcaagatcagagagggcaagttcagaagaatcccctacagatacagcgacgagctgaacgagatcatcaccagaatgctgaacctgaaggactaccacagacccagcgtggaggagatcctggagaaccccctgatcgccgacctggtggccgacgagcagagaagaaacctggagagaagaggcagacagctgggcgagcccgagaagagccaggacagcagccccgtgctgagcgagctgaagctgaaggagatccagctgcaggagagagagagagccctgaaggccagagaggagagactggagcagaaggagcaggagctgtgcgtgagagagagactggccgaggacaagctggccagagccgagaacctgctgaagaactacagcctgctgaaggagagaaagttcctgagcctggccagcaaccccgagctgctgaacctgcccagcagcgtgatcaagaagaaggtgcacttcagcggcgagagcaaggagaacatcatgagaagcgagaacagcgagagccagctgaccagcaagagcaagtgcaaggacctgaagaagagactgcacgccgcccagctgagagcccaggccctgagcgacatcgagaagaactaccagctgaagagcagacagatcctgggcatgagatag

SEQ ID NO: 91143 - DNA, 1209 bp, Artificial Sequence
  Description of Artificial Sequence: Synthetic coding sequence
atgaccgaggccgagaagcagatgctggtgagcgaggtgaacctgctgagagagctgaagcaccccaacatcgtgagatactacgacagaatcatcgacagaaccaacaccaccctgtacatcgtgatggagtactgcgagggcggcgacctggccagcgtgatcaccaagggcaccaaggagagacagtacctggacgaggagttcgtgctgagagtgatgacccagctgaccctggccctgaaggagtgccacagaagaagcgacggcggccacaccgtgctgcacagagacctgaagcccgccaacgtgttcctggacggcaagcagaacgtgaagctgggcgacttcggcctggccagaatcctgaaccacgacaccagcttcgccaagaccttcgtgggcaccccctactacatgagccccgagcagatgaacagaatgagctacaacgagaagagcgacatctggagcctgggctgcctgctgtacgagctgtgcgccctgatgccccccttcaccgccttcagccagaaggagctggccggcaagatcagagagggcaagttcagaagaatcccctacagatacagcgacgagctgaacgagatcatcaccagaatgctgaacctgaaggactaccacagacccagcgtggaggagatcctggagaaccccctgatcgccgacctggtggccgacgagcagagaagaaacctggagagaagaggcagacagctgggcgagcccgagaagagccaggacagcagccccgtgctgagcgagctgaagctgaaggagatccagctgcaggagagagagagagccctgaaggccagagaggagagactggagcagaaggagcaggagctgtgcgtgagagagagactggccgaggacaagctggccagagccgagaacctgctgaagaactacagcctgctgaaggagagaaagttcctgagcctggccagcaaccccgagctgctgaacctgcccagcagcgtgatcaagaagaaggtgcacttcagcggcgagagcaaggagaacatcatgagaagcgagaacagcgagagccagctgaccagcaagagcaagtgcaaggacctgaagaagagactgcacgccgcccagctgagagcccaggccctgagcgacatcgagaagaactaccagctgaagagcagacagatcctgggcatgagatag

SEQ ID NO: 91144 - DNA, 1521 bp, Artificial Sequence
  Description of Artificial Sequence: Synthetic coding sequence
atggacgactacatggtgctgagaatgatcggcgagggcagcttcggcagagccctgctggtgcagcacgagagcagcaaccagatgttcgccatgaaggagatcagactgcccaagagcttcagcaacacccagaacagcagaaaggaggccgtgctgctggccaagatgaagcaccccaacatcgtggccttcaaggagagcttcgaggccgagggccacctgtacatcgtgatggagtactgcgacggcggcgacctgatgcagaagatcaagcagcagaagggcaagctgttccccgaggacatgatcctgaactggttcacccagatgtgcctgggcgtgaaccacatccacaagaagagagtgctgcacagagacatcaagagcaagaacatcttcctgacccagaacggcaaggtgaagctgggcgacttcggcagcgccagactgctgagcaaccccatggccttcgcctgcacctacgtgggcaccccctactacgtgccccccgagatctgggagaacctgccctacaacaacaagagcgacatctggagcctgggctgcatcctgtacgagctgtgcaccctgaagcaccccttccaggccaacagctggaagaacctgatcctgaaggtgtgccagggctgcatcagccccctgcccagccactacagctacgagctgcagttcctggtgaagcagatgttcaagagaaaccccagccacagacccagcgccaccaccctgctgagcagaggcatcgtggccagactggtgcagaagtgcctgccccccgagatcatcatggagtacggcgaggaggtgctggaggagatcaagaacagcaagcacaacacccccagaaagaaggccaaccccagcagaatcagaatcgccctgggcaacgaggccagcaccgtgcaggaggaggagcaggacagaaagggcagccacaccgacctggagagcatcaacgagaacctggtggagagcgccctgagaagagtgaacagagaggagaagggcaacaagagcgtgcacctgagaaaggccagcagccccaacctgcacagaagacagtgggagaagaacgtgcccaacaccgccctgaccgccctggagaacgccagcatcctgaccagcagcctgaccgccgaggacgacagaggcggcagcgtgatcaagtacagcaagaacaccaccagaaagcagtggctgaaggagacccccgacaccctgctgaacatcctgaagaacgccgacctgagcctggccttccagacctacaccatctacagacccggcagcgagggcttcctgaagggccccctgagcgaggagaccgaggccagcgacagcgtggacggcggccacgacagcgtgatcctggaccccgagagactggagcccggcctggacgaggaggacaccgacttcgaggaggaggacgacaaccccgactgggtgagcgagctgaagaagagagccggctggcagggcctgtgcgacagatag

SEQ ID NO: 91145 - DNA, 1521 bp, Artificial Sequence; identical to SEQ ID NO: 91144
  Description of Artificial Sequence: Synthetic coding sequence

SEQ ID NO: 91146 - DNA, 1470 bp, Artificial Sequence
  Description of Artificial Sequence: Synthetic coding sequence
atggacgactacatggtgctgagaatgatcggcgagggcagcttcggcagagccctgctggtgcagcacgagagcagcaaccagatgttcgccatgaaggagatcagactgcccaagagcttcagcaacacccagaacagcagaaaggaggccgtgctgctggccaagatgaagcaccccaacatcgtggccttcaaggagagcttcgaggccgagggccacctgtacatcgtgatggagtactgcgacggcggcgacctgatgcagaagatcaagcagcagaagggcaagctgttccccgaggacatgatcctgaactggttcacccagatgtgcctgggcgtgaaccacatccacaagaagagagtgctgcacagagacatcaagagcaagaacatcttcctgacccagaacggcaaggtgaagctgggcgacttcggcagcgccagactgctgagcaaccccatggccttcgcctgcacctacgtgggcaccccctactacgtgccccccgagatctgggagaacctgccctacaacaacaagagcgacatctggagcctgggctgcatcctgtacgagctgtgcaccctgaagcaccccttccaggccaacagctggaagaacctgatcctgaaggtgtgccagggctgcatcagccccctgcccagccactacagctacgagctgcagttcctggtgaagcagatgttcaagagaaaccccagccacagacccagcgccaccaccctgctgagcagaggcatcgtggccagactggtgcagaagtgcctgccccccgagatcatcatggagtacggcgaggaggtgctggaggagatcaagaacagcaagcacaacacccccagaaagaagcaggaggaggagcaggacagaaagggcagccacaccgacctggagagcatcaacgagaacctggtggagagcgccctgagaagagtgaacagagaggagaagggcaacaagagcgtgcacctgagaaaggccagcagccccaacctgcacagaagacagtgggagaagaacgtgcccaacaccgccctgaccgccctggagaacgccagcatcctgaccagcagcctgaccgccgaggacgacagaggcggcagcgtgatcaagtacagcaagaacaccaccagaaagcagtggctgaaggagacccccgacaccctgctgaacatcctgaagaacgccgacctgagcctggccttccagacctacaccatctacagacccggcagcgagggcttcctgaagggccccctgagcgaggagaccgaggccagcgacagcgtggacggcggccacgacagcgtgatcctggaccccgagagactggagcccggcctggacgaggaggacaccgacttcgaggaggaggacgacaaccccgactgggtgagcgagctgaagaagagagccggctggcagggcctgtgcgacagatag

SEQ ID NO: 91147 - DNA, 1533 bp, Artificial Sequence
  Description of Artificial Sequence: Synthetic coding sequence
atgcagttcggcagagcccacggcgactgcgtgagcggcgcccagctgtgcggctgccccagcatggacgactacatggtgctgagaatgatcggcgagggcagcttcggcagagccctgctggtgcagcacgagagcagcaaccagatgttcgccatgaaggagatcagactgcccaagagcttcagcaacacccagaacagcagaaaggaggccgtgctgctggccaagatgaagcaccccaacatcgtggccttcaaggagagcttcgaggccgagggccacctgtacatcgtgatggagtactgcgacggcggcgacctgatgcagaagatcaagcagcagaagggcaagctgttccccgaggacatgatcctgaactggttcacccagatgtgcctgggcgtgaaccacatccacaagaagagagtgctgcacagagacatcaagagcaagaacatcttcctgacccagaacggcaaggtgaagctgggcgacttcggcagcgccagactgctgagcaaccccatggccttcgcctgcacctacgtgggcaccccctactacgtgccccccgagatctgggagaacctgccctacaacaacaagagcgacatctggagcctgggctgcatcctgtacgagctgtgcaccctgaagcaccccttccaggccaacagctggaagaacctgatcctgaaggtgtgccagggctgcatcagccccctgcccagccactacagctacgagctgcagttcctggtgaagcagatgttcaagagaaaccccagccacagacccagcgccaccaccctgctgagcagaggcatcgtggccagactggtgcagaagtgcctgccccccgagatcatcatggagtacggcgaggaggtgctggaggagatcaagaacagcaagcacaacacccccagaaagaagcaggaggaggagcaggacagaaagggcagccacaccgacctggagagcatcaacgagaacctggtggagagcgccctgagaagagtgaacagagaggagaagggcaacaagagcgtgcacctgagaaaggccagcagccccaacctgcacagaagacagtgggagaagaacgtgcccaacaccgccctgaccgccctggagaacgccagcatcctgaccagcagcctgaccgccgaggacgacagaggcggcagcgtgatcaagtacagcaagaacaccaccagaaagcagtggctgaaggagacccccgacaccctgctgaacatcctgaagaacgccgacctgagcctggccttccagacctacaccatctacagacccggcagcgagggcttcctgaagggccccctgagcgaggagaccgaggccagcgacagcgtggacggcggccacgacagcgtgatcctggaccccgagagactggagcccggcctggacgaggaggacaccgacttcgaggaggaggacgacaaccccgactgggtgagcgagctgaagaagagagccggctggcagggcctgtgcgacagatag

SEQ ID NO: 91148 - DNA, 177 bp, Artificial Sequence
  Description of Artificial Sequence: Synthetic coding sequence
atggacgactacatggtgctgagaatgatcggcgagggcagcttcggcagagccctgctggtgcagcacgagagcagcaaccagatgttcgccatgaaggagatcagactgcccaagagcttcagcaacacccagaacagcagaaaggaggccgtgctgctggccaagatgaagtag

SEQ ID NO: 91149 - DNA, 510 bp, Artificial Sequence
  Description of Artificial Sequence: Synthetic coding sequence
atggccagaggcggcgacaccggctgcaccggccccagcgagaccagcgccagcggcgccgccgccatcgccctgcccggcctggagggccccgccaccgacgcccagtgccagaccctgcccctgaccgtgctgaagagcagaagccccagccccagaagcctgccccccgccctgagctgcccccccccccagcccgccatgctggagcacctgagcagcctgcccacccagatggactacaagggccagaagctggccgagcagatgttccagggcatcatcctgttcagcgccatcgtgggcttcatctacggctacgtggccgagcagttcggctggaccgtgtacatcgtgatggccggcttcgccttcagctgcctgctgaccctgcccccctggcccatctacagaagacaccccctgaagtggctgcccgtgcaggagagcagcaccgacgacaagaagcccggcgagagaaagatcaagagacacgccaagaacaactag

SEQ ID NO: 91150 - DNA, 2259 bp, Artificial Sequence
  Description of Artificial Sequence: Synthetic coding sequence
atgcccctggccgcctactgctacctgagagtggtgggcaagggcagctacggcgaggtgaccctggtgaagcacagaagagacggcaagcagtacctgcacgagaagcacatcctgcacagagacctgaagacccagaacgtgttcctgaccagaaccaacatcatcaaggtgggcgacctgggcatcgccagagtgctggagaaccactgcgacatggccagcaccctgatcggcaccccctactacatgagccccgagctgttcagcaacaagccctacaactacaagagcgacgtgtgggccctgggctgctgcgtgtacgagatggccaccctgaagcacgccttcaacgccaaggacatgaacagcctggtgtacagaatcatcgagggcaagctgccccccatgcccagagactacagccccgagctggccgagctgatcagaaccatgctgagcaagagacccgaggagagacccagcgtgagaagcatcctgagacagccctacatcaagagacagatcagcttcttcctggaggccaccaagatcaagaccagcaagaacaacatcaagaacggcgacagccagagcaagcccttcgccaccgtggtgagcggcgaggccgagagcaaccacgaggtgatccacccccagcccctgagcagcgagggcagccagacctacatcatgggcgagggcaagtgcctgagccaggagaagcccagagccagcggcctgctgaagagccccgccagcctgaaggcccacacctgcaagcaggacctgagcaacaccaccgagctggccaccatcagcagcgtgaacatcgacatcctgcccgccaagggcagagacagcgtgagcgacggcttcgtgcaggagaaccagcccagatacctggacgccagcaacgagctgggcggcatctgcagcatcagccaggtggaggaggagatgctgcaggacaacaccaagagcagcgcccagcccgagaacctgatccccatgtggagcagcgacatcgtgaccggcgagaagaacgagcccgtgaagcccctgcagcccctgatcaaggagcagaagcccaaggaccagagcctggccctgagccccaagctggagtgcagcggcaccatcctggcccacagcaacctgagactgctgggcagcagcgacagccccgccagcgccagcagagtggccggcatcaccggcgtgtgccaccacgcccaggaccaggtggccggcgagtgcatcatcgagaagcagggcagaatccaccccgacctgcagccccacaacagcggcagcgagcccagcctgagcagacagagaagacagaagagaagagagcagaccgagcacagaggcgagaagagacaggtgagaagagacctgttcgccttccaggagagcccccccagattcctgcccagccaccccatcgtgggcaaggtggacgtgaccagcacccagaaggaggccgagaaccagagaagagtggtgaccggcagcgtgagcagcagcagaagcagcgagatgagcagcagcaaggacagacccctgagcgccagagagagaagaagactgaagcagagccaggaggagatgagcagcagcggccccagcgtgagaaaggccagcctgagcgtggccggccccggcaagccccaggaggaggaccagcccctgcccgccagaagactgagcagcgactgcagcgtgacccaggagagaaagcagatccactgcctgagcgaggacgagctgagcagcagcaccagcagcaccgacaagagcgacggcgactacggcgagggcaagggccagaccaacgagatcaacgccctggtgcagctgatgacccagaccctgaagctggacagcaaggagagctgcgaggacgtgcccgtggccaaccccgtgagcgagttcaagctgcacagaaagtacagagacaccctgatcctgcacggcaaggtggccgaggaggccgaggagatccacttcaaggagctgcccagcgccatcatgcccggcagcgagaagatcagaagactggtggaggtgctgagaaccgacgtgatcagaggcctgggcgtgcagctgctggagcaggtgtacgacctgctggaggaggaggacgagttcgacagagaggtgagactgagagagcacatgggcgagaagtacaccacctacagcgtgaaggccagacagctgaagttcttcgaggagaacatgaacttctag

SEQ ID NO: 91151 - DNA, 942 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgcccggcgagcactacagcgagaagctgagagagctggtgagcatgtgcatctgccccgacccccaccagagacccgacatcggctacgtgcaccaggtggccaagcagatgcacatctggatgagcagcacctag

SEQ ID NO: 91152 - DNA, 624 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctgtag

SEQ ID NO: 91153 - DNA, 1044 bp, Artificial Sequence
  Description of Artificial Sequence: Synthetic coding sequence
atgcccagaagagaggtgtgctgggaggccgcccacttcagacaggaggagcagagcctgcccagacccagagtgagagccctggtgagactggcctgcagaatggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgcccggcgagcactacagcgagaagctgagagagctggtgagcatgtgcatctgccccgacccccaccagagacccgacatcggctacgtgcaccaggtggccaagcagatgcacatctggatgagcagcacctag

SEQ ID NO: 91154 - DNA, 738 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgcccggcgagcactacagcgagaagctgagagagctggtgagcatgtgcatctgccccgacccccaccagagacccgacatcggctacgtgcaccaggtggccaagcagatgcacatctggatgagcagcacctag

SEQ ID NO: 91155 - DNA, 942 bp, Artificial Sequence; identical to SEQ ID NO: 91151
  Description of Artificial Sequence: Synthetic coding sequence

SEQ ID NO: 91156 - DNA, 1044 bp, Artificial Sequence; identical to SEQ ID NO: 91153
  Description of Artificial Sequence: Synthetic coding sequence

SEQ ID NO: 91157 - DNA, 663 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccactag

SEQ ID NO: 91158 - DNA, 585 bp, Artificial Sequence
  Description of Artificial Sequence: Synthetic coding sequence
atgcccagaagagaggtgtgctgggaggccgcccacttcagacaggaggagcagagcctgcccagacccagagtgagagccctggtgagactggcctgcagaatggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtgtag

SEQ ID NO: 91159 - DNA, 669 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaactag

SEQ ID NO: 91160 - DNA, 660 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatctag

SEQ ID NO: 91161 - DNA, 516 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagatag

SEQ ID NO: 91162 - DNA, 606 bp, Artificial Sequence
  Description of Artificial Sequence: Synthetic coding sequence
atggccggccagcccggccacatgccccacggcggcagcagcaacaacctgtgccacaccctgggccccgtgcacccccccgacccccagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgtag

SEQ ID NO: 91163 - DNA, 1017 bp, Artificial Sequence
  Description of Artificial Sequence: Synthetic coding sequence
atggaggccaccggctgggacagcagatgcagccccggcacccaggtgagagccctggtgagactggcctgcagaatggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgcccggcgagcactacagcgagaagctgagagagctggtgagcatgtgcatctgccccgacccccaccagagacccgacatcggctacgtgcaccaggtggccaagcagatgcacatctggatgagcagcacctag

SEQ ID NO: 91164 - DNA, 996 bp, Artificial Sequence
  Description of Artificial Sequence: Synthetic coding sequence
atgggcagaagaagacccgcccccttcagagccctggtgagactggcctgcagaatggccggccagcccggccacatgccccacggcggcagcagcaacaacctgtgccacaccctgggccccgtgcacccccccgacccccagagacaccccaacaccctgagcttcagatgcagcctggccgacttccagatcgagaagaagatcggcagaggccagttcagcgaggtgtacaaggccacctgcctgctggacagaaagaccgtggccctgaagaaggtgcagatcttcgagatgatggacgccaaggccagacaggactgcgtgaaggagatcggcctgctgaagcagctgaaccaccccaacatcatcaagtacctggacagcttcatcgaggacaacgagctgaacatcgtgctggagctggccgacgccggcgacctgagccagatgatcaagtacttcaagaagcagaagagactgatccccgagagaaccgtgtggaagtacttcgtgcagctgtgcagcgccgtggagcacatgcacagcagaagagtgatgcacagagacatcaagcccgccaacgtgttcatcaccgccaccggcgtggtgaagctgggcgacctgggcctgggcagattcttcagcagcgagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgttcagcctgtgccagaagatcgagcagtgcgactacccccccctgcccggcgagcactacagcgagaagctgagagagctggtgagcatgtgcatctgccccgacccccaccagagacccgacatcggctacgtgcaccaggtggccaagcagatgcacatctggatgagcagcacctag

SEQ ID NO: 91165 - DNA, 942 bp, Artificial Sequence; identical to SEQ ID NO: 91151
  Description of Artificial Sequence: Synthetic coding sequence

SEQ ID NO: 91166 - DNA, 942 bp, Artificial Sequence; identical to SEQ ID NO: 91151
  Description of Artificial Sequence: Synthetic coding sequence

SEQ ID NO: 91167 - DNA, 909 bp, Artificial Sequence
  Description of Artificial Sequence: Synthetic coding sequence
atggacgagcagagccagggcatgcagggcccccccgtgccccagttccagccccagaaggccctgagacccgacatgggctacaacaccctggccaacttcagaatcgagaagaagatcggcagaggccagttcagcgaggtgtacagagccgcctgcctgctggacggcgtgcccgtggccctgaagaaggtgcagatcttcgacctgatggacgccaaggccagagccgactgcatcaaggagatcgacctgctgaagcagctgaaccaccccaacgtgatcaagtactacgccagcttcatcgaggacaacgagctgaacatcgtgctggagctggccgacgccggcgacctgagcagaatgatcaagcacttcaagaagcagaagagactgatccccgagagaaccgtgtggaagtacttcgtgcagctgtgcagcgccctggagcacatgcacagcagaagagtgatgcacagagacatcaagcccgccaacgtgttcatcaccgccaccggcgtggtgaagctgggcgacctgggcctgggcagattcttcagcagcaagaccaccgccgcccacagcctggtgggcaccccctactacatgagccccgagagaatccacgagaacggctacaacttcaagagcgacatctggagcctgggctgcctgctgtacgagatggccgccctgcagagccccttctacggcgacaagatgaacctgtacagcctgtgcaagaagatcgagcagtgcgactacccccccctgcccagcgaccactacagcgaggagctgagacagctggtgaacatgtgcatcaaccccgaccccgagaagagacccgacgtgacctacgtgtacgacgtggccaagagaatgcacgcctgcaccgccagcagctag

SEQ ID NO: 91168 - DNA, 249 bp, Artificial Sequence
  Description of Artificial Sequence: Synthetic coding sequence
atggacgagcagagccagggcatgcagggcccccccgtgccccagttccagccccagaaggccctgagacccgacatgggctacaacaccctggccaacttcagaatcgagaagaagatcggcagaggccagttcagcgaggtgtacagagccgcctgcctgctggacggcgtgcccgtggccctgaagaaggtgcagatcttcgacctgatggacgccaaggccagagccgactgcatcaaggagtag

SEQ ID NO: 91169 - DNA, 99 bp, Artificial Sequence
  Description of Artificial Sequence: Synthetic coding sequence
atggacgagcagagccagggcatgcagggcccccccgtgccccagttccagccccagaaggccctgagacccgacatgggctacaacaccctggcctag

SEQ ID NO: 91170 - DNA, 909 bp, Artificial Sequence; identical to SEQ ID NO: 91167
  Description of Artificial Sequence: Synthetic coding sequence

SEQ ID NO: 91171 - DNA, 189 bp, Artificial Sequence
  Description of Artificial Sequence: Synthetic coding sequence
atggacgagcagagccagggcatgcagggcccccccgtgccccagttccagccccagaaggccctgagacccgacatgggctacaacaccctggccaacttcagaatcgagaagaagatcggcagaggccagttcagcgaggtgtacagagccgcctgcctgctggacggcgtgcccgtggccctgtag

SEQ ID NO: 91172 - DNA, 3729 bp, Artificial Sequence
  Description of Artificial Sequence: Synthetic coding sequence
atggagaagtacgtgagactgcagaagatcggcgagggcagcttcggcaaggccatcctggtgaagagcaccgaggacggcagacagtacgtgatcaaggagatcaacatcagcagaatgagcagcaaggagagagaggagagcagaagagaggtggccgtgctggccaacatgaagcaccccaacatcgtgcagtacagagagagcttcgaggagaacggcagcctgtacatcgtgatggactactgcgagggcggcgacctgttcaagagaatcaacgcccagaagggcgtgctgttccaggaggaccagatcctggactggttcgtgcagatctgcctggccctgaagcacgtgcacgacagaaagatcctgcacagagacatcaagagccagaacatcttcctgaccaaggacggcaccgtgcagctgggcgacttcggcatcgccagagtgctgaacagcaccgtggagctggccagaacctgcatcggcaccccctactacctgagccccgagatctgcgagaacaagccctacaacaacaagagcgacatctgggccctgggctgcgtgctgtacgagctgtgcaccctgaagcacgccttcgaggccggcagcatgaagaacctggtgctgaagatcatcagcggcagcttcccccccgtgagcctgcactacagctacgacctgagaagcctggtgagccagctgttcaagagaaaccccagagacagacccagcgtgaacagcatcctggagaagggcttcatcgccaagagaatcgagaagttcctgagcccccagctgatcgccgaggagttctgcctgaagaccttcagcaagttcggcagccagcccatccccgccaagagacccgccagcggccagaacagcatcagcgtgatgcccgcccagaagatcaccaagcccgccgccaagtacggcatccccctggcctacaagaagtacggcgacaagaagctgcacgagaagaagcccctgcagaagcacaagcaggcccaccagacccccgagaagagagtgaacaccggcgaggagagaagaaagatcagcgaggaggccgccagaaagagaagactggagttcatcgagaaggagaagaagcagaaggaccagatcatcagcctgatgaaggccgagcagatgaagagacaggagaaggagagactggagagaatcaacagagccagagagcagggctggagaaacgtgctgagcgccggcggcagcggcgaggtgaaggcccccttcctgggcagcggcggcaccatcgcccccagcagcttcagcagcagaggccagtacgagcactaccacgccatcttcgaccagatgcagcagcagagagccgaggacaacgaggccaagtggaagagagagatctacggcagaggcctgcccgagagacagaagggccagctggccgtggagagagccaagcaggtggaggagttcctgcagagaaagagagaggccatgcagaacaaggccagagccgagggccacatgggcatcctgcagaacctggccgccatgtacggcggcagacccagcagcagcagaggcggcaagcccagaaacaaggaggaggaggtgtacctggccagactgagacagatcagactgcagaacttcaacgagagacagcagatcaaggccaagctgagaggcgagaagaaggaggccaaccacagcgagggccaggagggcagcgaggaggccgacatgagaagaaagaagatcgagagcctgaaggcccacgccaacgccagagccgccgtgctgaaggagcagctggagagaaagagaaaggaggcctacgagagagagaagaaggtgtgggaggagcacctggtggccaagggcgtgaagagcagcgacgtgagcccccccctgggccagcacgagaccggcggcagccccagcaagcagcagatgagaagcgtgatcagcgtgaccagcgccctgaaggaggtgggcgtggacagcagcctgaccgacaccagagagaccagcgaggagatgcagaagaccaacaacgccatcagcagcaagagagagatcctgagaagactgaacgagaacctgaaggcccaggaggacgagaagggcaagcagaacctgagcgacaccttcgagatcaacgtgcacgaggacgccaaggagcacgagaaggagaagagcgtgagcagcgacagaaagaagtgggaggccggcggccagctggtgatccccctggacgagctgaccctggacaccagcttcagcaccaccgagagacacaccgtgggcgaggtgatcaagctgggccccaacggcagccccagaagagcctggggcaagagccccaccgacagcgtgctgaagatcctgggcgaggccgagctgcagctgcagaccgagctgctggagaacaccaccatcagaagcgagatcagccccgagggcgagaagtacaagcccctgatcaccggcgagaagaaggtgcagtgcatcagccacgagatcaaccccagcgccatcgtggacagccccgtggagaccaagagccccgagttcagcgaggccagcccccagatgagcctgaagctggagggcaacctggaggagcccgacgacctggagaccgagatcctgcaggagcccagcggcaccaacaaggacgagagcctgccctgcaccatcaccgacgtgtggatcagcgaggagaaggagaccaaggagacccagagcgccgacagaatcaccatccaggagaacgaggtgagcgaggacggcgtgagcagcaccgtggaccagctgagcgacatccacatcgagcccggcaccaacgacagccagcacagcaagtgcgacgtggacaagagcgtgcagcccgagcccttcttccacaaggtggtgcacagcgagcacctgaacctggtgccccaggtgcagagcgtgcagtgcagccccgaggagagcttcgccttcagaagccacagccacctgccccccaagaacaagaacaagaacagcctgctgatcggcctgagcaccggcctgttcgacgccaacaaccccaagatgctgagaacctgcagcctgcccgacctgagcaagctgttcagaaccctgatggacgtgcccaccgtgggcgacgtgagacaggacaacctggagatcgacgagatcgaggacgagaacatcaaggagggccccagcgacagcgaggacatcgtgttcgaggagaccgacaccgacctgcaggagctgcaggccagcatggagcagctgctgagagagcagcccggcgaggagtacagcgaggaggaggagagcgtgctgaagaacagcgacgtggagcccaccgccaacggcaccgacgtggccgacgaggacgacaaccccagcagcgagagcgccctgaacgaggagtggcacagcgacaacagcgacggcgagatcgccagcgagtgcgagtgcgacagcgtgttcaaccacctggaggagctgagactgcacctggagcaggagatgggcttcgagaagttcttcgaggtgtacgagaagatcaaggccatccacgaggacgaggacgagaacatcgagatctgcagcaagatcgtgcagaacatcctgggcaacgagcaccagcacctgtacgccaagatcctgcacctggtgatggccgacggcgcctaccaggaggacaacgacgagtag

SEQ ID NO: 91173 - DNA, 1800 bp, Artificial Sequence
  Description of Artificial Sequence: Synthetic coding sequence
atgctgaagttccaggaggccgccaagtgcgtgagcggcagcaccgccatcagcacctaccccaagaccctgatcgccagaagatacgtgctgcagcagaagctgggcagcggcagcttcggcaccgtgtacctggtgagcgacaagaaggccaagagaggcgaggagctgaaggtgctgaaggagatcagcgtgggcgagctgaaccccaacgagaccgtgcaggccaacctggaggcccagctgctgagcaagctggaccaccccgccatcgtgaagttccacgccagcttcgtggagcaggacaacttctgcatcatcaccgagtactgcgagggcagagacctggacgacaagatccaggagtacaagcaggccggcaagatcttccccgagaaccagatcatcgagtggttcatccagctgctgctgggcgtggactacatgcacgagagaagaatcctgcacagagacctgaagagcaagaacgtgttcctgaagaacaacctgctgaagatcggcgacttcggcgtgagcagactgctgatgggcagctgcgacctggccaccaccctgaccggcaccccccactacatgagccccgaggccctgaagcaccagggctacgacaccaagagcgacatctggagcctggcctgcatcctgtacgagatgtgctgcatgaaccacgccttcgccggcagcaacttcctgagcatcgtgctgaagatcgtggagggcgacacccccagcctgcccgagagataccccaaggagctgaacgccatcatggagagcatgctgaacaagaaccccagcctgagacccagcgccatcgagatcctgaagatcccctacctggacgagcagctgcagaacctgatgtgcagatacagcgagatgaccctggaggacaagaacctggactgccagaaggaggccgcccacatcatcaacgccatgcagaagagaatccacctgcagaccctgagagccctgagcgaggtgcagaagatgacccccagagagagaatgagactgagaaagctgcaggccgccgacgagaaggccagaaagctgaagaagatcgtggaggagaagtacgaggagaacagcaagagaatgcaggagctgagaagcagaaacttccagcagctgagcgtggacgtgctgcacgagaagacccacctgaagggcatggaggagaaggaggagcagcccgagggcagactgagctgcagcccccaggacgaggacgaggagagatggcagggcagagaggaggagagcgacgagcccaccctggagaacctgcccgagagccagcccatccccagcatggacctgcacgagctggagagcatcgtggaggacgccaccagcgacctgggctaccacgagatccccgaggaccccctggtggccgaggagtactacgccgacgccttcgacagctactgcgaggagagcgacgaggaggaggaggagatcgccctggagagacccgagaaggagatcagaaacgagggcagccagcccgcctacagaaccaaccagcaggacagcgacatcgaggccctggccagatgcctggagaacgtgctgggctgcaccagcctggaccagccctgcagaagctggggccagaagtacctgaagagaagcatcatcaccagcagagagcagggcatcagaatgctggccaagcagagaagcgccagcgtgtggaagaagtggtgcctgaagcccgccaccgtgctgaagtggaccagcagctgcaccctgaagagcagctgctag

SEQ ID NO: 91174 - DNA, 459 bp, Artificial Sequence
  Description of Artificial Sequence: Synthetic coding sequence
atggacagcggcaccgaggagtacgagctgaacggcggcctgccccccggcacccccggcagccccgacgccagccccgccagatggggctggagacacggccccatcaacgtgaaccactacgccagcaagaagagcgccgccgagagcatgctggacatcgccctgctgatggccaacgccagccagctgaaggccgtggtggagcagggccccagcttcgccttctacgtgcccctggtggtgctgatcagcatcagcctggtgctgcagatcggcgtgggcgtgctgctgatcttcctggtgaagtacgacctgaacaaccccgccaagcacgccaagctggacttcctgaacaacctggccaccggcctggtgttcatcatcgtggtggtgaacatcttcatcaccgccttcggcgtgcagaagcccctgatggacatggccccccagcagtag

SEQ ID NO: 91175 - DNA, 567 bp, Artificial Sequence
  Description of Artificial Sequence: Synthetic coding sequence
atggccggcctgagcagacagctgtgcgccctgagccaccccaagaaggccgccgagacccagaccgccgagcccggcggcgcccacgccgtgtgcagcagacaccccgtgagagtgaagggcctggagggcagcgagatggagagcgccagagagaacatcgacctgcagcccggcagcagcgaccccagaagccagcccatcaacctgaaccactacgccaccaagaagagcgtggccgagagcatgctggacgtggccctgttcatgagcaacgccatgagactgaaggccgtgctggagcagggccccagcagccactactacaccaccctggtgaccctgatcagcctgagcctgctgctgcaggtggtgatcggcgtgctgctggtggtgatcgccagactgaacctgaacgaggtggagaagcagtggagactgaaccagctgaacaacgccgccaccatcctggtgttcttcaccgtggtgatcaacgtgttcatcaccgccttcggcgcccacaagaccggcttcctggccgccagagccagcagaaaccccctgtag

SEQ ID NO: 91176 - DNA, 273 bp, Artificial Sequence
  Description of Artificial Sequence: Synthetic coding sequence
atgctggacgtggccctgttcatgagcaacgccatgagactgaaggccgtgctggagcagggccccagcagccactactacaccaccctggtgaccctgatcagcctgagcctgctgctgcaggtggtgatcggcgtgctgctggtggtgatcggcgaggagcccagcctgcagagcgacctgctgcccagacacccctggctggccgagagaccccacgtgagccccggccccccctgcatcggcaccggcagcttcgccaccaccagatag

SEQ ID NO: 91177 - DNA, 1401 bp, Artificial Sequence
  Description of Artificial Sequence: Synthetic coding sequence
atgcccggcgacagcagccccggcaccctgcccctgtgggacgccagcctgagcccccccctgggccccgaccccggcggcttcagcagagccagccacgccggcgacaagagcagaccccccgcccccgagctgggcagccccggcgccgtgagacccagagtgggcagctgcgcccccggccccatggagctgagagtgagcaacaccagctgcgagaacggcagcctgctgcacctgtactgcagcagccaggaggtgctgtgccagatcgtgaacgacctgagccccgaggtgcccagcaacgccaccttccacagctggcaggagagaatcagacagaactacggcttctacatcggcctgggcctggccttcctgagcagcttcctgatcggcagcagcgtgatcctgaagaagaagggcctgctgagactggtggccaccggcgccaccagagccgtggacggcggcttcggctacctgaaggacgccatgtggtgggccggcttcctgaccatggccgccggcgaggtggccaacttcggcgcctacgccttcgcccccgccaccgtggtgacccccctgggcgccctgagcgtgctgatcagcgccatcctgagcagctacttcctgagagagagcctgaacctgctgggcaagctgggctgcgtgatctgcgtggccggcagcaccgtgatggtgatccacgcccccgaggaggagaaggtgaccaccatcatggagatggccagcaagatgaaggacaccggcttcatcgtgttcgccgtgctgctgctggtgagctgcctgatcctgatcttcgtgatcgcccccagatacggccagagaaacatcctgatctacatcatcatctgcagcgtgatcggcgccttcagcgtggccgccgtgaagggcctgggcatcaccatcaagaacttcttccagggcctgcccgtggtgagacaccccctgccctacatcctgagcctgatcctggccctgagcctgagcacccaggtgaacttcctgaacagagccctggacatcttcaacaccagcctggtgttccccatctactacgtgttcttcaccaccgtggtggtgaccagcagcatcatcctgttcaaggagtggtacagcatgagcgccgtggacatcgccggcaccctgagcggcttcgtgaccatcatcctgggcgtgttcatgctgcacgccttcaaggacctggacatcagctgcgccagcctgccccacatgcacaagaaccccccccccagccccgcccccgagcccaccgtgatcagactggaggacaagaacgtgctggtggacaacatcgagctggccagcaccagcagccccgaggagaagcccaaggtgttcatcatccacagctag

SEQ ID NO: 91178 - DNA, 1344 bp, Artificial Sequence
  Description of Artificial Sequence: Synthetic coding sequence
atgcccggcgacagcagccccggcaccctgcccctgtgggacgccagcctgagcccccccctgggccccgaccccggcggcttcagcagagccagccacgccggcgacaagagcagaccccccgcccccgagctgggcagccccggcgccgtgagacccagagtgggcagctgcgcccccggccccatggagctgagagtgagcaacaccagctgcgagaacggcagcctgctgcacctgtactgcagcagccaggaggtgctgtgccagatcgtgaacgacctgagccccgaggtgcccagcaacgccaccttccacagctggcaggagagaatcagacagaactacggcttctacatcggcctgggcctggccttcctgagcagcttcctgatcggcagcagcgtgatcctgaagaagaagggcctgctgagactggtggccaccggcgccaccagagccgtggccgccggcgaggtggccaacttcggcgcctacgccttcgcccccgccaccgtggtgacccccctgggcgccctgagcgtgctgatcagcgccatcctgagcagctacttcctgagagagagcctgaacctgctgggcaagctgggctgcgtgatctgcgtggccggcagcaccgtgatggtgatccacgcccccgaggaggagaaggtgaccaccatcatggagatggccagcaagatgaaggacaccggcttcatcgtgttcgccgtgctgctgctggtgagctgcctgatcctgatcttcgtgatcgcccccagatacggccagagaaacatcctgatctacatcatcatctgcagcgtgatcggcgccttcagcgtggccgccgtgaagggcctgggcatcaccatcaagaacttcttccagggcctgcccgtggtgagacaccccctgccctacatcctgagcctgatcctggccctgagcctgagcacccaggtgaacttcctgaacagagccctggacatcttcaacaccagcctggtgttccccatctactacgtgttcttcaccaccgtggtggtgaccagcagcatcatcctgttcaaggagtggtacagcatgagcgccgtggacatcgccggcaccctgagcggcttcgtgaccatcatcctgggcgtgttcatgctgcacgccttcaaggacctggacatcagctgcgccagcctgccccacatgcacaagaaccccccccccagccccgcccccgagcccaccgtgatcagactggaggacaagaacgtgctggtggacaacatcgagctggccagcaccagcagccccgaggagaagcccaaggtgttcatcatccacagctag

SEQ ID NO: 91179 - DNA, 8415 bp, Artificial Sequence
  Description of Artificial Sequence: Synthetic coding sequence
atgaacggcgacatgccccacgtgcccatcaccaccctggccggcatcgccagcctgaccgacctgctgaaccagctgcccctgcccagccccctgcccgccaccaccaccaagagcctgctgttcaacgccagaatcgccgaggaggtgaactgcctgctggcctgcagagacgacaacctggtgagccagctggtgcacagcctgaaccaggtgagcaccgaccacatcgagctgaaggacaacctgggcagcgacgaccccgagggcgacatccccgtgctgctgcaggccgtgctggccagaagccccaacgtgttcagagagaagagcatgcagaacagatacgtgcagagcggcatgatgatgagccagtacaagctgagccagaacagcatgcacagcagccccgccagcagcaactaccagcagaccaccatcagccacagccccagcagcagattcgtgcccccccagaccagcagcggcaacagattcatgccccagcagaacagccccgtgcccagcccctacgccccccagagccccgccggctacatgccctacagccaccccagcagctacaccacccacccccagatgcagcaggccagcgtgagcagccccatcgtggccggcggcctgagaaacatccacgacaacaaggtgagcggccccctgagcggcaacagcgccaaccaccacgccgacaaccccagacacggcagcagcgaggactacctgcacatggtgcacagactgagcagcgacgacggcgacagcagcaccatgagaaacgccgccagcttccccctgagaagcccccagcccgtgtgcagccccgccggcagcgagggcacccccaagggcagcagaccccccctgatcctgcagagccagagcctgccctgcagcagccccagagacgtgccccccgacatcctgctggacagccccgagagaaagcagaagaagcagaagaagatgaagctgggcaaggacgagaaggagcagagcgagaaggccgccatgtacgacatcatcagcagccccagcaaggacagcaccaagctgaccctgagactgagcagagtgagaagcagcgacatggaccagcaggaggacatgatcagcggcgtggagaacagcaacgtgagcgagaacgacatccccttcaacgtgcagtaccccggccagaccagcaagacccccatcaccccccaggacatcaacagacccctgaacgccgcccagtgcctgagccagcaggagcagaccgccttcctgcccgccaaccaggtgcccgtgctgcagcagaacaccagcgtggccgccaagcagccccagaccagcgtggtgcagaaccagcagcagatcagccagcagggccccatctacgacgaggtggagctggacgccctggccgagatcgagagaatcgagagagagagcgccatcgagagagagagattcagcaaggaggtgcaggacaaggacaagcccctgaagaagagaaagcaggacagctacccccaggaggccggcggcgccaccggcggcaacagacccgccagccaggagaccggcagcaccggcaacggcagcagacccgccctgatggtgagcatcgacctgcaccaggccggcagagtggacagccaggccagcatcacccaggacagcgacagcatcaagaagcccgaggagatcaagcagtgcaacgacgcccccgtgagcgtgctgcaggaggacatcgtgggcagcctgaagagcacccccgagaaccaccccgagacccccaagaagaagagcgaccccgagctgagcaagagcgagatgaagcagagcgagagcagactggccgagagcaagcccaacgagaacagactggtggagaccaagagcagcgagaacaagctggagaccaaggtggagacccagaccgaggagctgaagcagaacgagagcagaaccaccgagtgcaagcagaacgagagcaccatcgtggagcccaagcagaacgagaacagactgagcgacaccaagcccaacgacaacaagcagaacaacggcagaagcgagaccaccaagagcagacccgagacccccaagcagaagggcgagagcagacccgagacccccaagcagaagagcgacggccaccccgagacccccaagcagaagggcgacggcagacccgagacccccaagcagaagggcgagagcagacccgagacccccaagcagaagaacgagggcagacccgagacccccaagcacagacacgacaacagaagagacagcggcaagcccagcaccgagaagaagcccgaggtgagcaagcacaagcaggacaccaagagcgacagccccagactgaagagcgagagagccgaggccctgaagcagagacccgacggcagaagcgtgagcgagagcctgagaagagaccacgacaacaagcagaagagcgacgacagaggcgagagcgagagacacagaggcgaccagagcagagtgagaagacccgagaccctgagaagcagcagcagaaacgagcacggcatcaagagcgacagcagcaagaccgacaagctggagagaaagcacagacacgagagcggcgacagcagagagagacccagcagcggcgagcagaagagcagacccgacagccccagagtgaagcagggcgacagcaacaagagcagaagcgacaagctgggcttcaagagccccaccagcaaggacgacaagagaaccgagggcaacaagagcaaggtggacaccaacaaggcccaccccgacaacaaggccgagttccccagctacctgctgggcggcagaagcggcgccctgaagaacttcgtgatccccaagatcaagagagacaaggacggcaacgtgacccaggagaccaagaagatggagatgaagggcgagcccaaggacaaggtggagaagatcggcctggtggaggacctgaacaagggcgccaagcccgtggtggtgctgcagaagctgagcctggacgacgtgcagaagctgatcaaggacagagaggacaagagcagaagcagcctgaagcccatcaagaacaagcccagcaagagcaacaagggcagcatcgaccagagcgtgctgaaggagctgccccccgagctgctggccgagatcgagagcaccatgcccctgtgcgagagagtgaagatgaacaagagaaagagaagcaccgtgaacgagaagcccaagtacgccgagatcagcagcgacgaggacaacgacagcgacgaggccttcgagagcagcagaaagagacacaagaaggacgacgacaaggcctgggagtacgaggagagagacagaagaagcagcggcgaccacagaagaagcggccacagccacgagggcagaagaagcagcggcggcggcagatacagaaacagaagccccagcgacagcgacatggaggactacagccccccccccagcctgagcgaggtggccagaaagatgaagaagaaggagaagcagaagaagagaaaggcctacgagcccaagctgacccccgaggagatgatggacagcagcaccttcaagagattcaccgccagcatcgagaacatcctggacaacctggaggacatggacttcaccgccttcggcgacgacgacgagatcccccaggagctgctgctgggcaagcaccagctgaacgagctgggcagcgagagcgccaagatcaaggccatgggcatcatggacaagctgagcaccgacaagaccgtgaaggtgctgaacatcctggagaagaacatccaggacggcagcaagctgagcaccctgctgaaccacaacaacgacaccgaggaggaggagagactgtggagagacctgatcatggagagagtgaccaagagcgccgacgcctgcctgaccaccatcaacatcatgaccagccccaacatgcccaaggccgtgtacatcgaggacgtgatcgagagagtgatccagtacaccaagttccacctgcagaacaccctgtacccccagtacgaccccgtgtacagactggacccccacggcggcggcctgctgagcagcaaggccaagagagccaagtgcagcacccacaagcagagagtgatcgtgatgctgtacaacaaggtgtgcgacatcgtgagcagcctgagcgagctgctggagatccagctgctgaccgacaccaccatcctgcaggtgagcagcatgggcatcacccccttcttcgtggagaacgtgagcgagctgcagctgtgcgccatcaagctggtgaccgccgtgttcagcagatacgagaagcacagacagctgatcctggaggagatcttcaccagcctggccagactgcccaccagcaagagaagcctgagaaacttcagactgaacagcagcgacatggacggcgagcccatgtacatccagatggtgaccgccctggtgctgcagctgatccagtgcgtggtgcacctgcccagcagcgagaaggacagcaacgccgaggaggacagcaacaagaagatcgaccaggacgtggtgatcaccaacagctacgagaccgccatgagaaccgcccagaacttcctgagcatcttcctgaagaagtgcggcagcaagcagggcgaggaggactacagacccctgttcgagaacttcgtgcaggacctgctgagcaccgtgaacaagcccgagtggcccgccgccgagctgctgctgagcctgctgggcagactgctggtgcaccagttcagcaacaagagcaccgagatggccctgagagtggccagcctggactacctgggcaccgtggccgccagactgagaaaggacgccgtgaccagcaagatggaccagggcagcatcgagagaatcctgaagcaggtgagcggcggcgaggacgagatccagcagctgcagaaggccctgctggactacctggacgagaacaccgagaccgaccccagcctggtgttcagcagaaagttctacatcgcccagtggttcagagacaccaccctggagaccgagaaggccatgaagagccagaaggacgaggagagcagcgagggcacccaccacgccaaggagatcgagaccaccggccagatcatgcacagagccgagaacagaaagaagttcctgagaagcatcatcaagaccacccccagccagttcagcaccctgaagatgaacagcgacaccgtggactacgacgacgcctgcctgatcgtgagatacctggccagcatgagacccttcgcccagagcttcgacatctacctgacccagatcctgagagtgctgggcgagaacgccatcgccgtgagaaccaaggccatgaagtgcctgagcgaggtggtggccgtggaccccagcatcctggccagactggacatgcagagaggcgtgcacggcagactgatggacaacagcaccagcgtgagagaggccgccgtggagctgctgggcagattcgtgctgtgcagaccccagctggccgagcagtactacgacatgctgatcgagagaatcctggacaccggcatcagcgtgagaaagagagtgatcaagatcctgagagacatctgcatcgagcagcccaccttccccaagatcaccgagatgtgcgtgaagatgatcagaagagtgaacgacgaggagggcatcaagaagctggtgaacgagaccttccagaagctgtggttcacccccaccccccacaacgacaaggaggccatgaccagaaagatcctgaacatcaccgacgtggtggccgcctgcagagacaccggctacgactggttcgagcagctgctgcagaacctgctgaagagcgaggaggacagcagctacaagcccgtgaagaaggcctgcacccagctggtggacaacctggtggagcacatcctgaagtacgaggagagcctggccgacagcgacaacaagggcgtgaacagcggcagactggtggcctgcatcaccaccctgttcctgttcagcaagatcagaccccagctgatggtgaagcacgccatgaccatgcagccctacctgaccaccaagtgcagcacccagaacgacttcatggtgatctgcaacgtggccaagatcctggagctggtggtgcccctgatggagcaccccagcgagaccttcctggccaccatcgaggaggacctgatgaagctgatcatcaagtacggcatgaccgtggtgcagcactgcgtgagctgcctgggcgccgtggtgaacaaggtgacccagaacttcaagttcgtgtgggcctgcttcaacagatactacggcgccatcagcaagctgaagagccagcaccaggaggaccccaacaacaccagcctgctgaccaacaagcccgccctgctgagaagcctgttcaccgtgggcgccctgtgcagacacttcgacttcgacctggaggacttcaagggcaacagcaaggtgaacatcaaggacaaggtgctggagctgctgatgtacttcaccaagcacagcgacgaggaggtgcagaccaaggccatcatcggcctgggcttcgccttcatccagcaccccagcctgatgttcgagcaggaggtgaagaacctgtacaacaacatcctgagcgacaagaacagcagcgtgaacctgaagatccaggtgctgaagaacctgcagacctacctgcaggaggaggacaccagaatgcagcaggccgacagagactggaagaaggtggccaagcaggaggacctgaaggagatgggcgacgtgagcagcggcatgagcagcagcatcatgcagctgtacctgaagcaggtgctggaggccttcttccacacccagagcagcgtgagacacttcgccctgaacgtgatcgccctgaccctgaaccagggcctgatccaccccgtgcagtgcgtgccctacctgatcgccatgggcaccgaccccgagcccgccatgagaaacaaggccgaccagcagctggtggagatcgacaagaagtacgccggcttcatccacatgaaggccgtggccggcatgaagatgagctaccaggtgcagcaggccatcaacacctgcctgaaggaccccgtgagaggcttcagacaggacgagagcagcagcgccctgtgcagccacctgtacagcatgatcagaggcaacagacagcacagaagagccttcctgatcagcctgctgaacctgttcgacgacaccgccaagaccgacgtgaccatgctgctgtacatcgccgacaacctggcctgcttcccctaccagacccaggaggagcccctgttcatcatgcaccacatcgacatcaccctgagcgtgagcggcagcaacctgctgcagagcttcaaggagagcatggtgaaggacaagagaaaggagagaaagagcagccccagcaaggagaacgagagcagcgacagcgaggaggaggtgagcagacccagaaagagcagaaagagagtggacagcgacagcgacagcgacagcgaggacgacatcaacagcgtgatgaagtgcctgcccgagaacagcgcccccctgatcgagttcgccaacgtgagccagggcatcctgctgctgctgatgctgaagcagcacctgaagaacctgtgcggcttcagcgacagcaagatccagaagtacagccccagcgagagcgccaaggtgtacgacaaggccatcaacagaaagaccggcgtgcacttccaccccaagcagaccctggacttcctgagaagcgacatggccaacagcaagatcaccgaggaggtgaagagaagcatcgtgaagcagtacctggacttcaagctgctgatggagcacctggaccccgacgaggaggaggaggagggcgaggtgagcgccagcaccaacgccagaaacaaggccatcaccagcctgctgggcggcggcagccccaagaacaacaccgccgccgagaccgaggacgacgagagcgacggcgaggacagaggcggcggcaccagcggcagcctgagaagaagcaagagaaacagcgacagcaccgagctggccgcccagatgaacgagagcgtggacgtgatggacgtgatcgccatctgctgccccaagtacaaggacagaccccagatcgccagagtggtgcagaagaccagcagcggcttcagcgtgcagtggatggccggcagctacagcggcagctggaccgaggccaagagaagagacggcagaaagctggtgccctgggtggacaccatcaaggagagcgacatcatctacaagaagatcgccctgaccagcgccaacaagctgaccaacaaggtggtgcagaccctgagaagcctgtacgccgccaaggacggcaccagcagctag

SEQ ID NO: 91180 - DNA, 8094 bp, Artificial Sequence
  Description of Artificial Sequence: Synthetic coding sequence
atgaacggcgacatgccccacgtgcccatcaccaccctggccggcatcgccagcctgaccgacctgctgaaccagctgcccctgcccagccccctgcccgccaccaccaccaagagcctgctgttcaacgccagaatcgccgaggaggtgaactgcctgctggcctgcagagacgacaacctggtgagccagctggtgcacagcctgaaccaggtgagcaccgaccacatcgagctgaaggacaacctgggcagcgacgaccccgagggcgacatccccgtgctgctgcaggccgtgctggccagaagccccaacgtgttcagagagaagagcatgcagaacagatacgtgcagagcggcatgatgatgagccagtacaagctgagccagaacagcatgcacagcagccccgccagcagcaactaccagcagaccaccatcagccacagccccagcagcagattcgtgcccccccagaccagcagcggcaacagattcatgccccagcagaacagccccgtgcccagcccctacgccccccagagccccgccggctacatgccctacagccaccccagcagctacaccacccacccccagatgcagcaggccagcgtgagcagccccatcgtggccggcggcctgagaaacatccacgacaacaaggtgagcggccccctgagcggcaacagcgccaaccaccacgccgacaaccccagacacggcagcagcgaggactacctgcacatggtgcacagactgagcagcgacgacggcgacagcagcaccatgagaaacgccgccagcttccccctgagaagcccccagcccgtgtgcagccccgccggcagcgagggcacccccaagggcagcagaccccccctgatcctgcagagccagagcctgccctgcagcagccccagagacgtgccccccgacatcctgctggacagccccgagagaaagcagaagaagcagaagaagatgaagctgggcaaggacgagaaggagcagagcgagaaggccgccatgtacgacatcatcagcagccccagcaaggacagcaccaagctgaccctgagactgagcagagtgagaagcagcgacatggaccagcaggaggacatgatcagcggcgtggagaacagcaacgtgagcgagaacgacatccccttcaacgtgcagtaccccggccagaccagcaagacccccatcaccccccaggacatcaacagacccctgaacgccgcccagtgcctgagccagcaggagcagaccgccttcctgcccgccaaccaggtgcccgtgctgcagcagaacaccagcgtggccgccaagcagccccagaccagcgtggtgcagaaccagcagcagatcagccagcagggccccatctacgacgaggtggagctggacgccctggccgagatcgagagaatcgagagagagagcgccatcgagagagagagattcagcaaggaggtgcaggacaaggacaagcccctgaagaagagaaagcaggacagctacccccaggaggccggcggcgccaccggcggcaacagacccgccagccaggagaccggcagcaccggcaacggcagcagacccgccctgatggtgagcatcgacctgcaccaggccggcagagtggacagccaggccagcatcacccaggacagcgacagcatcaagaagcccgaggagatcaagcagtgcaacgacgcccccgtgagcgtgctgcaggaggacatcgtgggcagcctgaagagcacccccgagaaccaccccgagacccccaagaagaagagcgaccccgagctgagcaagagcgagatgaagcagagcgagagcagactggccgagagcaagcccaacgagaacagactggtggagaccaagagcagcgagaacaagctggagaccaaggtggagacccagaccgaggagctgaagcagaacgagagcagaaccaccgagtgcaagcagaacgagagcaccatcgtggagcccaagcagaacgagaacagactgagcgacaccaagcccaacgacaacaagcagaacaacggcagaagcgagaccaccaagagcagacccgagacccccaagcagaagggcgagagcagacccgagacccccaagcagaagagcgacggccaccccgagacccccaagcagaagggcgacggcagacccgagacccccaagcagaagggcgagagcagacccgagacccccaagcagaagaacgagggcagacccgagacccccaagcacagacacgacaacagaagagacagcggcaagcccagcaccgagaagaagcccgaggtgagcaagcacaagcaggacaccaagagcgacagccccagactgaagagcgagagagccgaggccctgaagcagagacccgacggcagaagcgtgagcgagagcctgagaagagaccacgacaacaagcagaagagcgacgacagaggcgagagcgagagacacagaggcgaccagagcagagtgagaagacccgagaccctgagaagcagcagcagaaacgagcacggcatcaagagcgacagcagcaagaccgacaagctggagagaaagcacagacacgagagcggcgacagcagagagagacccagcagcggcgagcagaagagcagacccgacagccccagagtgaagcagggcgacagcaacaagagcagaagcgacaagctgggcttcaagagccccaccagcaaggacgacaagagaaccgagggcaacaagagcaaggtggacaccaacaaggcccaccccgacaacaaggccgagttccccagctacctgctgggcggcagaagcggcgccctgaagaacttcgtgatccccaagatcaagagagacaaggacggcaacgtgacccaggagaccaagaagatggagatgaagggcgagcccaaggacaaggtggagaagatcggcctggtggaggacctgaacaagggcgccaagcccgtggtggtgctgcagaagctgagcctggacgacgtgcagaagctgatcaaggacagagaggacaagagcagaagcagcctgaagcccatcaagaacaagcccagcaagagcaacaagggcagcatcgaccagagcgtgctgaaggagctgccccccgagctgctggccgagatcgagagcaccatgcccctgtgcgagagagtgaagatgaacaagagaaagagaagcaccgtgaacgagaagcccaagtacgccgagatcagcagcgacgaggacaacgacagcgacgaggccttcgagagcagcagaaagagacacaagaaggacgacgacaaggcctgggagtacgaggagagagacagaagaagcagcggcgaccacagaagaagcggccacagccacgagggcagaagaagcagcggcggcggcagatacagaaacagaagccccagcgacagcgacatggaggactacagccccccccccagcctgagcgaggtggccagaaagatgaagaagaaggagaagcagaagaagagaaaggcctacgagcccaagctgacccccgaggagatgatggacagcagcaccttcaagagattcaccgccagcatcgagaacatcctggacaacctggaggacatggacttcaccgccttcggcgacgacgacgagatcccccaggagctgctgctgggcaagcaccagctgaacgagctgggcagcgagagcgccaagatcaaggccatgggcatcatggacaagctgagcaccgacaagaccgtgaaggtgctgaacatcctggagaagaacatccaggacggcagcaagctgagcaccctgctgaaccacaacaacgacaccgaggaggaggagagactgtggagagacctgatcatggagagagtgaccaagagcgccgacgcctgcctgaccaccatcaacatcatgaccagccccaacatgcccaaggccgtgtacatcgaggacgtgatcgagagagtgatccagtacaccaagttccacctgcagaacaccctgtacccccagtacgaccccgtgtacagactggacccccacggcggcggcctgctgagcagcaaggccaagagagccaagtgcagcacccacaagcagagagtgatcgtgatgctgtacaacaaggtgtgcgacatcgtgagcagcctgagcgagctgctggagatccagctgctgaccgacaccaccatcctgcaggtgagcagcatgggcatcacccccttcttcgtggagaacgtgagcgagctgcagctgtgcgccatcaagctggtgaccgccgtgttcagcagatacgagaagcacagacagctgatcctggaggagatcttcaccagcctggccagactgcccaccagcaagagaagcctgagaaacttcagactgaacagcagcgacatggacggcgagcccatgtacatccagatggtgaccgccctggtgctgcagctgatccagtgcgtggtgcacctgcccagcagcgagaaggacagcaacgccgaggaggacagcaacaagaagatcgaccaggacgtggtgatcaccaacagctacgagaccgccatgagaaccgcccagaacttcctgagcatcttcctgaagaagtgcggcagcaagcagggcgaggaggactacagacccctgttcgagaacttcgtgcaggacctgctgagcaccgtgaacaagcccgagtggcccgccgccgagctgctgctgagcctgctgggcagactgctggtgcaccagttcagcaacaagagcaccgagatggccctgagagtggccagcctggactacctgggcaccgtggccgccagactgagaaaggacgccgtgaccagcaagatggaccagggcagcatcgagagaatcctgaagcaggtgagcggcggcgaggacgagatccagcagctgcagaaggccctgctggactacctggacgagaacaccgagaccgaccccagcctggtgttcagcagaaagttctacatcgcccagtggttcagagacaccaccctggagaccgagaaggccatgaagagccagaaggacgaggagagcagcgagggcacccaccacgccaaggagatcgagaccaccggccagatcatgcacagagccgagaacagaaagaagttcctgagaagcatcatcaagaccacccccagccagttcagcaccctgaagatgaacagcgacaccgtggactacgacgacgcctgcctgatcgtgagatacctggccagcatgagacccttcgcccagagcttcgacatctacctgacccagatcctgagagtgctgggcgagaacgccatcgccgtgagaaccaaggccatgaagtgcctgagcgaggtggtggccgtggaccccagcatcctggccagactggacatgcagagaggcgtgcacggcagactgatggacaacagcaccagcgtgagagaggccgccgtggagctgctgggcagattcgtgctgtgcagaccccagctggccgagcagtactacgacatgctgatcgagagaatcctggacaccggcatcagcgtgagaaagagagtgatcaagatcctgagagacatctgcatcgagcagcccaccttccccaagatcaccgagatgtgcgtgaagatgatcagaagagtgaacgacgaggagggcatcaagaagctggtgaacgagaccttccagaagctgtggttcacccccaccccccacaacgacaaggaggccatgaccagaaagatcctgaacatcaccgacgtggtggccgcctgcagagacaccggctacgactggttcgagcagctgctgcagaacctgctgaagagcgaggaggacagcagctacaagcccgtgaagaaggcctgcacccagctggtggacaacctggtggagcacatcctgaagtacgaggagagcctggccgacagcgacaacaagggcgtgaacagcggcagactggtggcctgcatcaccaccctgttcctgttcagcaagatcagaccccagctgatggtgaagcacgccatgaccatgcagccctacctgaccaccaagtgcagcacccagaacgacttcatggtgatctgcaacgtggccaagatcctggagctggtggtgcccctgatggagcaccccagcgagaccttcctggccaccatcgaggaggacctgatgaagctgatcatcaagtacggcatgaccgtggtgcagcactgcgtgagctgcctgggcgccgtggtgaacaaggtgacccagaacttcaagttcgtgtgggcctgcttcaacagatactacggcgccatcagcaagctgaagagccagcaccaggaggaccccaacaacaccagcctgctgaccaacaagcccgccctgctgagaagcctgttcaccgtgggcgccctgtgcagacacttcgacttcgacctggaggacttcaagggcaacagcaaggtgaacatcaaggacaaggtgctggagctgctgatgtacttcaccaagcacagcgacgaggaggtgcagaccaaggccatcatcggcctgggcttcgccttcatccagcaccccagcctgatgttcgagcaggaggtgaagaacctgtacaacaacatcctgagcgacaagaacagcagcgtgaacctgaagatccaggtgctgaagaacctgcagacctacctgcaggaggaggacaccagaatgcagcaggccgacagagactggaagaaggtggccaagcaggaggacctgaaggagatgggcgacgtgagcagcggcatgagcagcagcatcatgcagctgtacctgaagcaggtgctggaggccttcttccacacccagagcagcgtgagacacttcgccctgaacgtgatcgccctgaccctgaaccagggcctgatccaccccgtgcagtgcgtgccctacctgatcgccatgggcaccgaccccgagcccgccatgagaaacaaggccgaccagcagctggtggagatcgacaagaagtacgccggcttcatccacatgaaggccgtggccggcatgaagatgagctaccaggtgcagcaggccatcaacacctgcctgaaggaccccgtgagaggcttcagacaggacgagagcagcagcgccctgtgcagccacctgtacagcatgatcagaggcaacagacagcacagaagagccttcctgatcagcctgctgaacctgttcgacgacaccgccaagaccgacgtgaccatgctgctgtacatcgccgacaacctggcctgcttcccctaccagacccaggaggagcccctgttcatcatgcaccacatcgacatcaccctgagcgtgagcggcagcaacctgctgcagagcttcaaggagagcatggtgaaggacaagagaaaggagagaaagagcagccccagcaaggagaacgagagcagcgacagcgaggaggaggtgagcagacccagaaagagcagaaagagagtggacagcgacagcgacagcgacagcgaggacgacatcaacagcgtgatgaagtgcctgcccgagaacagcgcccccctgatcgagttcgccaacgtgagccagggcatcctgctgctgctgatgctgaagcagcacctgaagaacctgtgcggcttcagcgacagcaagatccagaagtacagccccagcgagagcgccaaggtgtacgacaaggccatcaacagaaagaccggcgtgcacttccaccccaagcagaccctggacttcctgagaagcgacatggccaacagcaagatcaccgaggaggtgaagagaagcatcgtgaagcagtacctggacttcaagctgctgatggagcacctggaccccgacgaggaggaggaggagggcgaggtgagcgccagcaccaacgccagaaacaaggccatcaccagcctgctgggcggcggcagccccaagaacaacaccgccgccgagaccgaggacgacgagagcgacggcgaggacagaggcggcggcaccagcggcgtgagaagaagaagaagccagagaatcagccagagaatcacctag

SEQ ID NO: 91181 - DNA, 867 bp, Artificial Sequence
  Description of Artificial Sequence: Synthetic coding sequence
atggagagaccccagcccgacagcatgccccaggacctgagcgaggccctgaaggaggccaccaaggaggtgcacacccaggccgagaacgccgagttcatgagaaacttccagaagggccaggtgaccagagacggcttcaagctggtgatggccagcctgtaccacatctacgtggccctggaggaggagatcgagagaaacaaggagagccccgtgttcgcccccgtgtacttccccgaggagctgcacagaaaggccgccctggagcaggacctggccttctggtacggccccagatggcaggaggtgatcccctacacccccgccatgcagagatacgtgaagagactgcacgaggtgggcagaaccgagcccgagctgctggtggcccacgcctacaccagatacctgggcgacctgagcggcggccaggtgctgaagaagatcgcccagaaggccctggacctgcccagcagcggcgagggcctggccttcttcaccttccccaacatcgccagcgccaccaagttcaagcagctgtacagaagcagaatgaacagcctggagatgacccccgccgtgagacagagagtgatcgaggaggccaagaccgccttcctgctgaacatccagctgttcgaggagctgcaggagctgctgacccacgacaccaaggaccagagccccagcagagcccccggcctgagacagagagccagcaacaaggtgcaggacagcgcccccgtggagacccccagaggcaagccccccctgaacaccagaagccaggcccccctgctgagatgggtgctgaccctgagcttcctggtggccaccgtggccgtgggcctgtacgccatgtag

SEQ ID NO: 91182 - DNA, 4305 bp, Artificial Sequence
  Description of Artificial Sequence: Synthetic coding sequence
atggaggaccacatgttcggcgtgcagcagatccagcccaacgtgatcagcgtgagactgttcaagagaaaggtgggcggcctgggcttcctggtgaaggagagagtgagcaagccccccgtgatcatcagcgacctgatcagaggcggcgccgccgagcagagcggcctgatccaggccggcgacatcatcctggccgtgaacggcagacccctggtggacctgagctacgacagcgccctggaggtgctgagaggcatcgccagcgagacccacgtggtgctgatcctgagaggccccgagggcttcaccacccacctggagaccaccttcaccggcgacggcacccccaagaccatcagagtgacccagcccctgggcccccccaccaaggccgtggacctgagccaccagccccccgccggcaaggagcagcccctggccgtggacggcgccagcggccccggcaacggcccccagcacgcctacgacgacggccaggaggccggcagcctgccccacgccaacggcctggcccccagaccccccggccaggaccccgccaagaaggccaccagagtgagcctgcagggcagaggcgagaacaacgagctgctgaaggagatcgagcccgtgctgagcctgctgaccagcggcagcagaggcgtgaagggcggcgcccccgccaaggccgagatgaaggacatgggcatccaggtggacagagacctggacggcaagagccacaagcccctgcccctgggcgtggagaacgacagagtgttcaacgacctgtggggcaagggcaacgtgcccgtggtgctgaacaacccctacagcgagaaggagcagccccccaccagcggcaagcagagccccaccaagaacggcagccccagcaagtgccccagattcctgaaggtgaagaactgggagaccgaggtggtgctgaccgacaccctgcacctgaagagcaccctggagaccggctgcaccgagtacatctgcatgggcagcatcatgcaccccagccagcacgccagaagacccgaggacgtgagaaccaagggccagctgttccccctggccaaggagttcatcgaccagtactacagcagcatcaagagattcggcagcaaggcccacatggagagactggaggaggtgaacaaggagatcgacaccaccagcacctaccagctgaaggacaccgagctgatctacggcgccaagcacgcctggagaaacgccagcagatgcgtgggcagaatccagtggagcaagctgcaggtgttcgacgccagagactgcaccaccgcccacggcatgttcaactacatctgcaaccacgtgaagtacgccaccaacaagggcaacctgagaagcgccatcaccatcttcccccagagaaccgacggcaagcacgacttcagagtgtggaacagccagctgatcagatacgccggctacaagcagcccgacggcagcaccctgggcgaccccgccaacgtgcagttcaccgagatctgcatccagcagggctggaagccccccagaggcagattcgacgtgctgcccctgctgctgcaggccaacggcaacgaccccgagctgttccagatcccccccgagctggtgctggaggtgcccatcagacaccccaagttcgagtggttcaaggacctgggcctgaagtggtacggcctgcccgccgtgagcaacatgctgctggagatcggcggcctggagttcagcgcctgccccttcagcggctggtacatgggcaccgagatcggcgtgagagactactgcgacaacagcagatacaacatcctggaggaggtggccaagaagatgaacctggacatgagaaagaccagcagcctgtggaaggaccaggccctggtggagatcaacatcgccgtgctgtacagcttccagagcgacaaggtgaccatcgtggaccaccacagcgccaccgagagcttcatcaagcacatggagaacgagtacagatgcagaggcggctgccccgccgactgggtgtggatcgtgccccccatgagcggcagcatcacccccgtgttccaccaggagatgctgaactacagactgacccccagcttcgagtaccagcccgacccctggaacacccacgtgtggaagggcaccaacggcacccccaccaagagaagagccatcggcttcaagaagctggccgaggccgtgaagttcagcgccaagctgatgggccaggccatggccaagagagtgaaggccaccatcctgtacgccaccgagaccggcaagagccaggcctacgccaagaccctgtgcgagatcttcaagcacgccttcgacgccaaggtgatgagcatggaggagtacgacatcgtgcacctggagcacgagaccctggtgctggtggtgaccagcaccttcggcaacggcgacccccccgagaacggcgagaagttcggctgcgccctgatggagatgagacaccccaacagcgtgcaggaggagagaaagagctacaaggtgagattcaacagcgtgagcagctacagcgacagccagaagagcagcggcgacggccccgacctgagagacaacttcgagagcgccggccccctggccaacgtgagattcagcgtgttcggcctgggcagcagagcctacccccacttctgcgccttcggccacgccgtggacaccctgctggaggagctgggcggcgagagaatcctgaagatgagagagggcgacgagctgtgcggccaggaggaggccttcagaacctgggccaagaaggtgttcaaggccgcctgcgacgtgttctgcgtgggcgacgacgtgaacatcgagaaggccaacaacagcctgatcagcaacgacagaagctggaagagaaacaagttcagactgaccttcgtggccgaggcccccgagctgacccagggcctgagcaacgtgcacaagaagagagtgagcgccgccagactgctgagcagacagaacctgcagagccccaagagcagcagaagcaccatcttcgtgagactgcacaccaacggcagccaggagctgcagtaccagcccggcgaccacctgggcgtgttccccggcaaccacgaggacctggtgaacgccctgatcgagagactggaggacgccccccccgtgaaccagatggtgaaggtggagctgctggaggagagaaacaccgccctgggcgtgatcagcaactggaccgacgagctgagactgcccccctgcaccatcttccaggccttcaagtactacctggacatcaccaccccccccacccccctgcagctgcagcagttcgccagcctggccaccagcgagaaggagaagcagagactgctggtgctgagcaagggcctgcaggagtacgaggagtggaagtggggcaagaaccccaccatcgtggaggtgctggaggagttccccagcatccagatgcccgccaccctgctgctgacccagctgagcctgctgcagcccagatactacagcatcagcagcagccccgacatgtaccccgacgaggtgcacctgaccgtggccatcgtgagctacagaaccagagacggcgagggccccatccaccacggcgtgtgcagcagctggctgaacagaatccaggccgacgagctggtgccctgcttcgtgagaggcgcccccagcttccacctgcccagaaacccccaggtgccctgcatcctggtgggccccggcaccggcatcgcccccttcagaagcttctggcagcagagacagttcgacatccagcacaagggcatgaacccctgccccatggtgctggtgttcggctgcagacagagcaagatcgaccacatctacagagaggagaccctgcaggccaagaacaagggcgtgttcagagagctgtacaccgcctacagcagagagcccgacaagcccaagaagtacgtgcaggacatcctgcaggagcagctggccgagagcgtgtacagagccctgaaggagcagggcggccacatctacgtgtgcggcgacgtgaccatggccgccgacgtgctgaaggccatccagagaatcatgacccagcagggcaagctgagcgccgaggacgccggcgtgttcatcagcagaatgagagacgacaacagataccacgaggacatcttcggcgtgaccctgagaacctacgaggtgaccaacagactgagaagcgagagcatcgccttcatcgaggagagcaagaaggacaccgacgaggtgttcagcagctag

SEQ ID NO: 91183 - DNA, 4407 bp, Artificial Sequence
  Description of Artificial Sequence: Synthetic coding sequence
atggaggaccacatgttcggcgtgcagcagatccagcccaacgtgatcagcgtgagactgttcaagagaaaggtgggcggcctgggcttcctggtgaaggagagagtgagcaagccccccgtgatcatcagcgacctgatcagaggcggcgccgccgagcagagcggcctgatccaggccggcgacatcatcctggccgtgaacggcagacccctggtggacctgagctacgacagcgccctggaggtgctgagaggcatcgccagcgagacccacgtggtgctgatcctgagaggccccgagggcttcaccacccacctggagaccaccttcaccggcgacggcacccccaagaccatcagagtgacccagcccctgggcccccccaccaaggccgtggacctgagccaccagccccccgccggcaaggagcagcccctggccgtggacggcgccagcggccccggcaacggcccccagcacgcctacgacgacggccaggaggccggcagcctgccccacgccaacggcctggcccccagaccccccggccaggaccccgccaagaaggccaccagagtgagcctgcagggcagaggcgagaacaacgagctgctgaaggagatcgagcccgtgctgagcctgctgaccagcggcagcagaggcgtgaagggcggcgcccccgccaaggccgagatgaaggacatgggcatccaggtggacagagacctggacggcaagagccacaagcccctgcccctgggcgtggagaacgacagagtgttcaacgacctgtggggcaagggcaacgtgcccgtggtgctgaacaacccctacagcgagaaggagcagccccccaccagcggcaagcagagccccaccaagaacggcagccccagcaagtgccccagattcctgaaggtgaagaactgggagaccgaggtggtgctgaccgacaccctgcacctgaagagcaccctggagaccggctgcaccgagtacatctgcatgggcagcatcatgcaccccagccagcacgccagaagacccgaggacgtgagaaccaagggccagctgttccccctggccaaggagttcatcgaccagtactacagcagcatcaagagattcggcagcaaggcccacatggagagactggaggaggtgaacaaggagatcgacaccaccagcacctaccagctgaaggacaccgagctgatctacggcgccaagcacgcctggagaaacgccagcagatgcgtgggcagaatccagtggagcaagctgcaggtgttcgacgccagagactgcaccaccgcccacggcatgttcaactacatctgcaaccacgtgaagtacgccaccaacaagggcaacctgagaagcgccatcaccatcttcccccagagaaccgacggcaagcacgacttcagagtgtggaacagccagctgatcagatacgccggctacaagcagcccgacggcagcaccctgggcgaccccgccaacgtgcagttcaccgagatctgcatccagcagggctggaagccccccagaggcagattcgacgtgctgcccctgctgctgcaggccaacggcaacgaccccgagctgttccagatcccccccgagctggtgctggaggtgcccatcagacaccccaagttcgagtggttcaaggacctgggcctgaagtggtacggcctgcccgccgtgagcaacatgctgctggagatcggcggcctggagttcagcgcctgccccttcagcggctggtacatgggcaccgagatcggcgtgagagactactgcgacaacagcagatacaacatcctggaggaggtggccaagaagatgaacctggacatgagaaagaccagcagcctgtggaaggaccaggccctggtggagatcaacatcgccgtgctgtacagcttccagagcgacaaggtgaccatcgtggaccaccacagcgccaccgagagcttcatcaagcacatggagaacgagtacagatgcagaggcggctgccccgccgactgggtgtggatcgtgccccccatgagcggcagcatcacccccgtgttccaccaggagatgctgaactacagactgacccccagcttcgagtaccagcccgacccctggaacacccacgtgtggaagggcaccaacggcacccccaccaagagaagagccatcggcttcaagaagctggccgaggccgtgaagttcagcgccaagctgatgggccaggccatggccaagagagtgaaggccaccatcctgtacgccaccgagaccggcaagagccaggcctacgccaagaccctgtgcgagatcttcaagcacgccttcgacgccaaggtgatgagcatggaggagtacgacatcgtgcacctggagcacgagaccctggtgctggtggtgaccagcaccttcggcaacggcgacccccccgagaacggcgagaagttcggctgcgccctgatggagatgagacaccccaacagcgtgcaggaggagagaaagtaccccgagcccctgagattcttccccagaaagggcccccccctgcccaacggcgacaccgaggtgcacggcctggccgccgccagagacagccagcacagaagctacaaggtgagattcaacagcgtgagcagctacagcgacagccagaagagcagcggcgacggccccgacctgagagacaacttcgagagcgccggccccctggccaacgtgagattcagcgtgttcggcctgggcagcagagcctacccccacttctgcgccttcggccacgccgtggacaccctgctggaggagctgggcggcgagagaatcctgaagatgagagagggcgacgagctgtgcggccaggaggaggccttcagaacctgggccaagaaggtgttcaaggccgcctgcgacgtgttctgcgtgggcgacgacgtgaacatcgagaaggccaacaacagcctgatcagcaacgacagaagctggaagagaaacaagttcagactgaccttcgtggccgaggcccccgagctgacccagggcctgagcaacgtgcacaagaagagagtgagcgccgccagactgctgagcagacagaacctgcagagccccaagagcagcagaagcaccatcttcgtgagactgcacaccaacggcagccaggagctgcagtaccagcccggcgaccacctgggcgtgttccccggcaaccacgaggacctggtgaacgccctgatcgagagactggaggacgccccccccgtgaaccagatggtgaaggtggagctgctggaggagagaaacaccgccctgggcgtgatcagcaactggaccgacgagctgagactgcccccctgcaccatcttccaggccttcaagtactacctggacatcaccaccccccccacccccctgcagctgcagcagttcgccagcctggccaccagcgagaaggagaagcagagactgctggtgctgagcaagggcctgcaggagtacgaggagtggaagtggggcaagaaccccaccatcgtggaggtgctggaggagttccccagcatccagatgcccgccaccctgctgctgacccagctgagcctgctgcagcccagatactacagcatcagcagcagccccgacatgtaccccgacgaggtgcacctgaccgtggccatcgtgagctacagaaccagagacggcgagggccccatccaccacggcgtgtgcagcagctggctgaacagaatccaggccgacgagctggtgccctgcttcgtgagaggcgcccccagcttccacctgcccagaaacccccaggtgccctgcatcctggtgggccccggcaccggcatcgcccccttcagaagcttctggcagcagagacagttcgacatccagcacaagggcatgaacccctgccccatggtgctggtgttcggctgcagacagagcaagatcgaccacatctacagagaggagaccctgcaggccaagaacaagggcgtgttcagagagctgtacaccgcctacagcagagagcccgacaagcccaagaagtacgtgcaggacatcctgcaggagcagctggccgagagcgtgtacagagccctgaaggagcagggcggccacatctacgtgtgcggcgacgtgaccatggccgccgacgtgctgaaggccatccagagaatcatgacccagcagggcaagctgagcgccgaggacgccggcgtgttcatcagcagaatgagagacgacaacagataccacgaggacatcttcggcgtgaccctgagaacctacgaggtgaccaacagactgagaagcgagagcatcgccttcatcgaggagagcaagaaggacaccgacgaggtgttcagcagctag

SEQ ID NO: 91184 - DNA, 1224 bp, Artificial Sequence
  Description of Artificial Sequence: Synthetic coding sequence
atggaggaccacatgttcggcgtgcagcagatccagcccaacgtgatcagcgtgagactgttcaagagaaaggtgggcggcctgggcttcctggtgaaggagagagtgagcaagccccccgtgatcatcagcgacctgatcagaggcggcgccgccgagcagagcggcctgatccaggccggcgacatcatcctggccgtgaacggcagacccctggtggacctgagctacgacagcgccctggaggtgctgagaggcatcgccagcgagacccacgtggtgctgatcctgagaggccccgagggcttcaccacccacctggagaccaccttcaccggcgacggcacccccaagaccatcagagtgacccagcccctgggcccccccaccaaggccgtggacctgagccaccagccccccgccggcaaggagcagcccctggccgtggacggcgccagcggccccggcaacggcccccagcacgcctacgacgacggccaggaggccggcagcctgccccacgccaacggcctggcccccagaccccccggccaggaccccgccaagaaggccaccagagtgagcctgcagggcagaggcgagaacaacgagctgctgaaggagatcgagcccgtgctgagcctgctgaccagcggcagcagaggcgtgaagggcggcgcccccgccaaggccgagatgaaggacatgggcatccaggtggacagagacctggacggcaagagccacaagcccctgcccctgggcgtggagaacgacagagtgttcaacgacctgtggggcaagggcaacgtgcccgtggtgctgaacaacccctacagcgagaaggagcagatgagaaagctgagaatcaccgagggcttcggcgcccagagaggcagccacaaccacccccccccccaggagaacagccccccccagagaatggccgccccccccagcgtgcacgccagcagcagaagcagaaccggcagactgagatggttcagcctgacccccagcaccctgagagcccactggaagagagacgccctgagcaccagcgcctgggcccccagctgcatcctgctgagcatgcagggcggcctgaagaccagcgcccagaaggacagcagcagcctgagccccaagagcctgctgatcaacaccatccaccagctgaaggacctggcccccaagcccacctggaagggctggaagagatag

SEQ ID NO: 91185 - DNA, 3993 bp, Artificial Sequence
  Description of Artificial Sequence: Synthetic coding sequence
atggaggaccacatgttcggcgtgcagcagatccagcccaacgtgatcagcgtgagactgttcaagagaaaggtgggcggcctgggcttcctggtgaaggagagagtgagcaagccccccgtgatcatcagcgacctgatcagaggcggcgccgccgagcagagcggcctgatccaggccggcgacatcatcctggccgtgaacggcagacccctggtggacctgagctacgacagcgccctggaggtgctgagaggcatcgccagcgagacccacgtggtgctgatcctgagaggccccgagggcttcaccacccacctggagaccaccttcaccggcgacggcacccccaagaccatcagagtgacccagcccctgggcccccccaccaaggccgtggacctgagccaccagccccccgccggcaaggagcagcccctggccgtggacggcgccagcggccccggcaacggcccccagcacgcctacgacgacggccaggaggccggcagcctgccccacgccaacggcctggcccccagaccccccggccaggaccccgccaagaaggccaccagagtgagcctgcagggcagaggcgagaacaacgagctgctgaaggagatcgagcccgtgctgagcctgctgaccagcggcagcagaggcgtgaagggcggcgcccccgccaaggccgagatgaaggacatgggcatccaggtggacagagacctggacggcaagagccacaagcccctgcccctgggcgtggagaacgacagagtgttcaacgacctgtggggcaagggcaacgtgcccgtggtgctgaacaacccctacagcgagaaggagcagccccccaccagcggcaagcagagccccaccaagaacggcagccccagcaagtgccccagattcctgaaggtgaagaactgggagaccgaggtggtgctgaccgacaccctgcacctgaagagcaccctggagaccggctgcaccgagtacatctgcatgggcagcatcatgcaccccagccagcacgccagaagacccgaggacgtgagaaccaagggccagctgttccccctggccaaggagttcatcgaccagtactacagcagcatcaagagattcggcagcaaggcccacatggagagactggaggaggtgaacaaggagatcgacaccaccagcacctaccagctgaaggacaccgagctgatctacggcgccaagcacgcctggagaaacgccagcagatgcgtgggcagaatccagtggagcaagctgcaggtgttcgacgccagagactgcaccaccgcccacggcatgttcaactacatctgcaaccacgtgaagtacgccaccaacaagggcaacctgagaagcgccatcaccatcttcccccagagaaccgacggcaagcacgacttcagagtgtggaacagccagctgatcagatacgccggctacaagcagcccgacggcagcaccctgggcgaccccgccaacgtgcagttcaccgaggaggtggccaagaagatgaacctggacatgagaaagaccagcagcctgtggaaggaccaggccctggtggagatcaacatcgccgtgctgtacagcttccagagcgacaaggtgaccatcgtggaccaccacagcgccaccgagagcttcatcaagcacatggagaacgagtacagatgcagaggcggctgccccgccgactgggtgtggatcgtgccccccatgagcggcagcatcacccccgtgttccaccaggagatgctgaactacagactgacccccagcttcgagtaccagcccgacccctggaacacccacgtgtggaagggcaccaacggcacccccaccaagagaagagccatcggcttcaagaagctggccgaggccgtgaagttcagcgccaagctgatgggccaggccatggccaagagagtgaaggccaccatcctgtacgccaccgagaccggcaagagccaggcctacgccaagaccctgtgcgagatcttcaagcacgccttcgacgccaaggtgatgagcatggaggagtacgacatcgtgcacctggagcacgagaccctggtgctggtggtgaccagcaccttcggcaacggcgacccccccgagaacggcgagaagttcggctgcgccctgatggagatgagacaccccaacagcgtgcaggaggagagaaagagctacaaggtgagattcaacagcgtgagcagctacagcgacagccagaagagcagcggcgacggccccgacctgagagacaacttcgagagcgccggccccctggccaacgtgagattcagcgtgttcggcctgggcagcagagcctacccccacttctgcgccttcggccacgccgtggacaccctgctggaggagctgggcggcgagagaatcctgaagatgagagagggcgacgagctgtgcggccaggaggaggccttcagaacctgggccaagaaggtgttcaaggccgcctgcgacgtgttctgcgtgggcgacgacgtgaacatcgagaaggccaacaacagcctgatcagcaacgacagaagctggaagagaaacaagttcagactgaccttcgtggccgaggcccccgagctgacccagggcctgagcaacgtgcacaagaagagagtgagcgccgccagactgctgagcagacagaacctgcagagccccaagagcagcagaagcaccatcttcgtgagactgcacaccaacggcagccaggagctgcagtaccagcccggcgaccacctgggcgtgttccccggcaaccacgaggacctggtgaacgccctgatcgagagactggaggacgccccccccgtgaaccagatggtgaaggtggagctgctggaggagagaaacaccgccctgggcgtgatcagcaactggaccgacgagctgagactgcccccctgcaccatcttccaggccttcaagtactacctggacatcaccaccccccccacccccctgcagctgcagcagttcgccagcctggccaccagcgagaaggagaagcagagactgctggtgctgagcaagggcctgcaggagtacgaggagtggaagtggggcaagaaccccaccatcgtggaggtgctggaggagttccccagcatccagatgcccgccaccctgctgctgacccagctgagcctgctgcagcccagatactacagcatcagcagcagccccgacatgtaccccgacgaggtgcacctgaccgtggccatcgtgagctacagaaccagagacggcgagggccccatccaccacggcgtgtgcagcagctggctgaacagaatccaggccgacgagctggtgccctgcttcgtgagaggcgcccccagcttccacctgcccagaaacccccaggtgccctgcatcctggtgggccccggcaccggcatcgcccccttcagaagcttctggcagcagagacagttcgacatccagcacaagggcatgaacccctgccccatggtgctggtgttcggctgcagacagagcaagatcgaccacatctacagagaggagaccctgcaggccaagaacaagggcgtgttcagagagctgtacaccgcctacagcagagagcccgacaagcccaagaagtacgtgcaggacatcctgcaggagcagctggccgagagcgtgtacagagccctgaaggagcagggcggccacatctacgtgtgcggcgacgtgaccatggccgccgacgtgctgaaggccatccagagaatcatgacccagcagggcaagctgagcgccgaggacgccggcgtgttcatcagcagaatgagagacgacaacagataccacgaggacatcttcggcgtgaccctgagaacctacgaggtgaccaacagactgagaagcgagagcatcgccttcatcgaggagagcaagaaggacaccgacgaccaggtgttcaagacctag

SEQ ID NO: 91186 - DNA, 3621 bp, Artificial Sequence
  Description of Artificial Sequence: Synthetic coding sequence
atggaggaccacatgttcggcgtgcagcagatccagcccaacgtgatcagcgtgagactgttcaagagaaaggtgggcggcctgggcttcctggtgaaggagagagtgagcaagccccccgtgatcatcagcgacctgatcagaggcggcgccgccgagcagagcggcctgatccaggccggcgacatcatcctggccgtgaacggcagacccctggtggacctgagctacgacagcgccctggaggtgctgagaggcatcgccagcgagacccacgtggtgctgatcctgagaggccccgagggcttcaccacccacctggagaccaccttcaccggcgacggcacccccaagaccatcagagtgacccagcccctgggcccccccaccaaggccgtggacctgagccaccagccccccgccggcaaggagcagcccctggccgtggacggcgccagcggccccggcaacggcccccagcacgcctacgacgacggccaggaggccggcagcctgccccacgccaacggcctggcccccagaccccccggccaggaccccgccaagaaggccaccagagtgagcctgcagggcagaggcgagaacaacgagctgctgaaggagatcgagcccgtgctgagcctgctgaccagcggcagcagaggcgtgaagggcggcgcccccgccaaggccgagatgaaggacatgggcatccaggtggacagagacctggacggcaagagccacaagcccctgcccctgggcgtggagaacgacagagtgttcaacgacctgtggggcaagggcaacgtgcccgtggtgctgaacaacccctacagcgagaaggagcagccccccaccagcggcaagcagagccccaccaagaacggcagccccagcaagtgccccagattcctgaaggtgaagaactgggagaccgaggtggtgctgaccgacaccctgcacctgaagagcaccctggagaccggctgcaccgagtacatctgcatgggcagcatcatgcaccccagccagcacgccagaagacccgaggacgtgagaaccaagggccagctgttccccctggccaaggagttcatcgaccagtactacagcagcatcaagagattcggcagcaaggcccacatggagagactggaggaggtgaacaaggagatcgacaccaccagcacctaccagctgaaggacaccgagctgatctacggcgccaagcacgcctggagaaacgccagcagatgcgtgggcagaatccagtggagcaagctgcaggtgttcgacgccagagactgcaccaccgcccacggcatgttcaactacatctgcaaccacgtgaagtacgccaccaacaagggcaacctgagaagcgccatcaccatcttcccccagagaaccgacggcaagcacgacttcagagtgtggaacagccagctgatcagatacgccggctacaagcagcccgacggcagcaccctgggcgaccccgccaacgtgcagttcaccgagatctgcatccagcagggctggaagccccccagaggcagattcgacgtgctgcccctgctgctgcaggccaacggcaacgaccccgagctgttccagatcccccccgagctggtgctggaggtgcccatcagacaccccaagttcgagtggttcaaggacctgggcctgaagtggtacggcctgcccgccgtgagcaacatgctgctggagatcggcggcctggagttcagcgcctgccccttcagcggctggtacatgggcaccgagatcggcgtgagagactactgcgacaacagcagatacaacatcctggaggaggtggccaagaagatgaacctggacatgagaaagaccagcagcctgtggaaggaccaggccctggtggagatcaacatcgccgtgctgtacagcttccagagcgacaaggtgaccatcgtggaccaccacagcgccaccgagagcttcatcaagcacatggagaacgagtacagatgcagaggcggctgccccgccgactgggtgtggatcgtgccccccatgagcggcagcatcacccccgtgttccaccaggagatgctgaactacagactgacccccagcttcgagtaccagcccgacccctggaacacccacgtgtggaagggcaccaacggcacccccaccaagagaagagccatcggcttcaagaagctggccgaggccgtgaagttcagcgccaagctgatgggccaggccatggccaagagagtgaaggccaccatcctgtacgccaccgagaccggcaagagccaggcctacgccaagaccctgtgcgagatcttcaagcacgccttcgacgccaaggtgatgagcatggaggagtacgacatcgtgcacctggagcacgagaccctggtgctggtggtgaccagcaccttcggcaacggcgacccccccgagaacggcgagaagttcggctgcgccctgatggagatgagacaccccaacagcgtgcaggaggagagaaagagctacaaggtgagattcaacagcgtgagcagctacagcgacagccagaagagcagcggcgacggccccgacctgagagacaacttcgagagcgccggccccctggccaacgtgagattcagcgtgttcggcctgggcagcagagcctacccccacttctgcgccttcggccacgccgtggacaccctgctggaggagctgggcggcgagagaatcctgaagatgagagagggcgacgagctgtgcggccaggaggaggccttcagaacctgggccaagaaggtgttcaaggccgcctgcgacgtgttctgcgtgggcgacgacgtgaacatcgagaaggccaacaacagcctgatcagcaacgacagaagctggaagagaaacaagttcagactgaccttcgtggccgaggcccccgagctgacccagggcctgagcaacgtgcacaagaagagagtgagcgccgccagactgctgagcagacagaacctgcagagccccaagagcagcagaagcaccatcttcgtgagactgcacaccaacggcagccaggagctgcagtaccagcccggcgaccacctgggcgtgttccccggcaaccacgaggacctggtgaacgccctgatcgagagactggaggacgccccccccgtgaaccagatggtgaaggtggagctgctggaggagagaaacaccgccctgggcgtgatcagcaactggaccgacgagctgagactgcccccctgcaccatcttccaggccttcaagtactacctggacatcaccaccccccccacccccctgcagctgcagcagttcgccagcctggccaccagcgagaaggagaagcagagactgctggtgctgagcaagggcctgcaggagtacgaggagtggaagtggggcaagaaccccaccatcgtggaggtgctggaggagttccccagcatccagatgcccgccaccctgctgctgacccagctgagcctgctgcagcccagatactacagcatcagcagcagcccccacacccacaccctgagcgagaccagacccagccccctgcccctgagcagccagtgctgctag

SEQ ID NO: 91187 - DNA, 204 bp, Artificial Sequence
  Description of Artificial Sequence: Synthetic coding sequence
caccccaacagcgtgcaggaggagagaaagtaccccgagcccctgagattcttccccagaaagggcccccccctgcccaacggcgacaccgaggtgcacggcctggccgccgccagagacagccagcacagaagctacaaggtgagattcaacagcgtgagcagctacagcgacagccagaagagcagcggcgacggcccctag

SEQ ID NO: 91188 - DNA, 1521 bp, Artificial Sequence
  Description of Artificial Sequence: Synthetic coding sequence
atgcccagcaagaccaagtacaacctggtggacgacggccacgacctgagaatccccctgcacaacgaggacgccttccagcacggcatctgcttcgaggccaagtacgtgggcagcctggacgtgcccagacccaacagcagagtggagatcgtggccgccatgagaagaatcagatacgagttcaaggccaagaacatcaagaagaagaaggtgagcatcatggtgagcgtggacggcgtgaaggtgatcctgaagaagaagaagaagctgctgctgctgcagaagaaggagtggacctgggacgagagcaagatgctggtgatgcaggaccccatctacagaatcttctacgtgagccacgacagccaggacctgaagatcttcagctacatcgccagagacggcgccagcaacatcttcagatgcaacgtgttcaagagcaagaagaagagccaggccatgagaatcgtgagaaccgtgggccaggccttcgaggtgtgccacaagctgagcctgcagcacacccagcagaacgccgacggccaggaggacggcgagagcgagagaaacagcaacagcagcggcgaccccggcagacagctgaccggcgccgagagagccagcaccgccaccgccgaggagaccgacatcgacgccgtggaggtgcccctgcccggcaacgacgtgctggagttcagcagaggcgtgaccgacctggacgccgtgggcaaggagggcggcagccacaccggcagcaaggtgagccacccccaggagcccatgctgaccgccagccccagaatgctgctgcccagcagcagcagcaagccccccggcctgggcaccgagacccccctgagcacccaccaccagatgcagctgctgcagcagctgctgcagcagcagcagcagcagacccaggtggccgtggcccaggtgcacctgctgaaggaccagctggccgccgaggccgccgccagactggaggcccaggccagagtgcaccagctgctgctgcagaacaaggacatgctgcagcacatcagcctgctggtgaagcaggtgcaggagctggagctgaagctgagcggccagaacgccatgggcagccaggacagcctgctggagatcaccttcagaagcggcgccctgcccgtgctgtgcgaccccaccacccccaagcccgaggacctgcacagcccccccctgggcgccggcctggccgacttcgcccaccccgccggcagccccctgggcagaagagactgcctggtgaagctggagtgcttcagattcctgccccccgaggacacccccccccccgcccagggcgaggccctgctgggcggcctggagctgatcaagttcagagagagcggcatcgccagcgagtacgagagcaacaccgacgagagcgaggagagagacagctggagccaggaggagctgcccagactgctgaacgtgctgcagagacaggagctgggcgacggcctggacgacgagatcgccgtgtag

SEQ ID NO: 91189 - DNA, 636 bp, Artificial Sequence
  Description of Artificial Sequence: Synthetic coding sequence
atgagcctgagcagcctgtgccccgtgttcagcgccgccgccagcagcctgcaggtgcacctgctgaaggaccagctggccgccgaggccgccgccagactggaggcccaggccagagtgcaccagctgctgctgcagaacaaggacatgctgcagcacatcagcctgctggtgaagcaggtgcaggagctggagctgaagctgagcggccagaacgccatgggcagccaggacagcctgctggagatcaccttcagaagcggcgccctgcccgtgctgtgcgaccccaccacccccaagcccgaggacctgcacagcccccccctgggcgccggcctggccgacttcgcccaccccgccggcagccccctgggcagaagagactgcctggtgaagctggagtgcttcagattcctgccccccgaggacacccccccccccgcccagggcgaggccctgctgggcggcctggagctgatcaagttcagagagagcggcatcgccagcgagtacgagagcaacaccgacgagagcgaggagagagacagctggagccaggaggagctgcccagactgctgaacgtgctgcagagacaggagctgggcgacggcctggacgacgagatcgccgtgtag

SEQ ID NO: 91190 - DNA, 1506 bp, Artificial Sequence
  Description of Artificial Sequence: Synthetic coding sequence
atgcccagcaagaccaagtacaacctggtggacgacggccacgacctgagaatccccctgcacaacgaggacgccttccagcacggcatctgcttcgaggccaagtacgtgggcagcctggacgtgcccagacccaacagcagagtggagatcgtggccgccatgagaagaatcagatacgagttcaaggccaagaacatcaagaagaagaaggtgagcatcatggtgagcgtggacggcgtgaaggtgatcctgaagaagaagaagaagaagaaggagtggacctgggacgagagcaagatgctggtgatgcaggaccccatctacagaatcttctacgtgagccacgacagccaggacctgaagatcttcagctacatcgccagagacggcgccagcaacatcttcagatgcaacgtgttcaagagcaagaagaagagccaggccatgagaatcgtgagaaccgtgggccaggccttcgaggtgtgccacaagctgagcctgcagcacacccagcagaacgccgacggccaggaggacggcgagagcgagagaaacagcaacagcagcggcgaccccggcagacagctgaccggcgccgagagagccagcaccgccaccgccgaggagaccgacatcgacgccgtggaggtgcccctgcccggcaacgacgtgctggagttcagcagaggcgtgaccgacctggacgccgtgggcaaggagggcggcagccacaccggcagcaaggtgagccacccccaggagcccatgctgaccgccagccccagaatgctgctgcccagcagcagcagcaagccccccggcctgggcaccgagacccccctgagcacccaccaccagatgcagctgctgcagcagctgctgcagcagcagcagcagcagacccaggtggccgtggcccaggtgcacctgctgaaggaccagctggccgccgaggccgccgccagactggaggcccaggccagagtgcaccagctgctgctgcagaacaaggacatgctgcagcacatcagcctgctggtgaagcaggtgcaggagctggagctgaagctgagcggccagaacgccatgggcagccaggacagcctgctggagatcaccttcagaagcggcgccctgcccgtgctgtgcgaccccaccacccccaagcccgaggacctgcacagcccccccctgggcgccggcctggccgacttcgcccaccccgccggcagccccctgggcagaagagactgcctggtgaagctggagtgcttcagattcctgccccccgaggacacccccccccccgcccagggcgaggccctgctgggcggcctggagctgatcaagttcagagagagcggcatcgccagcgagtacgagagcaacaccgacgagagcgaggagagagacagctggagccaggaggagctgcccagactgctgaacgtgctgcagagacaggagctgggcgacggcctggacgacgagatcgccgtgtag

SEQ ID NO: 91191 - DNA, 2190 bp, Artificial Sequence
  Description of Artificial Sequence: Synthetic coding sequence
atggcctgcccctggaagttcctgttcaagaccaagttccaccagtacgccatgaacggcgagaaggacatcaacaacaacgtggagaaggccccctgcgccaccagcagccccgtgacccaggacgacctgcagtaccacaacctgagcaagcagcagaacgagagcccccagcccctggtggagaccggcaagaagagccccgagagcctggtgaagctggacgccacccccctgagcagccccagacacgtgagaatcaagaactggggcagcggcatgaccttccaggacaccctgcaccacaaggccaagggcatcctgacctgcagaagcaagagctgcctgggcagcatcatgacccccaagagcctgaccagaggccccagagacaagcccaccccccccgacgagctgctgccccaggccatcgagttcgtgaaccagtactacggcagcttcaaggaggccaagatcgaggagcacctggccagagtggaggccgtgaccaaggagatcgagaccaccggcacctaccagctgaccggcgacgagctgatcttcgccaccaagcaggcctggagaaacgcccccagatgcatcggcagaatccagtggagcaacctgcaggtgttcgacgccagaagctgcagcaccgccagagagatgttcgagcacatctgcagacacgtgagatacagcaccaacaacggcaacatcagaagcgccatcaccgtgttcccccagagaagcgacggcaagcacgacttcagagtgtggaacgcccagctgatcagatacgccggctaccagatgcccgacggcagcatcagaggcgaccccgccaacgtggagttcacccagctgtgcatcgacctgggctggaagcccaagtacggcagattcgacgtggtgcccctggtgctgcaggccaacggcagagaccccgagctgttcgagatcccccccgacctggtgctggaggtggccatggagcaccccaagtacgagtggttcagagagctggagctgaagtggtacgccctgcccgccgtggccaacatgctgctggaggtgggcggcctggagttccccggctgccccttcaacggctggtacatgggcaccgagatcggcgtgagagacttctgcgacgtgcagagatacaacatcctggaggaggtgggcagaagaatgggcctggagacccacaagctggccagcctgtggaaggaccaggccgtggtggagatcaacatcgccgtgctgcacagcttccagaagcagaacgtgaccatcatggaccaccacagcgccgccgagagcttcatgaagtacatgcagaacgagtacagaagcagaggcggctgccccgccgactggatctggctggtgccccccatgagcggcagcatcacccccgtgttccaccaggagatgctgaactacgtgctgagccccttctactactaccaggtggaggcctggaagacccacgtgtggcaggacgagaagagaagacccaagagaagagagatccccctgaaggtgctggtgaaggccgtgctgttcgcctgcatgctgatgagaaagaccatggccagcagagtgagagtgaccatcctgttcgccaccgagaccggcaagagcgaggccctggcctgggacctgggcgccctgttcagctgcgccttcaaccccaagaagctgaagaagagcctgttcatgctgaaggagctgaacaacaagttcagatacgccgtgttcggcctgggcagcagcatgtaccccagattctgcgccttcgcccacgacatcgaccagaagctgagccacctgggcgccagccagctgacccccatgggcgagggcgacgagctgagcggccaggaggacgccttcagaagctgggccgtgcagaccttcaaggccgcctgcgagaccttcgacgtgagaggcaagcagcacatccagatccccaagctgtacaccagcaacgtgacctgggacccccaccactacagactggtgcaggacagccagcccctgcccgccgccagcaccagccccagaatcccccccatcctggccagcagcagcggcctggcccaggccagcagacccagcgccgtgagcggcagcaacggcagcatgacccccagcaccagagagtgcggcgaggccgcctag

SEQ ID NO: 91192 - DNA, 3462 bp, Artificial Sequence
  Description of Artificial Sequence: Synthetic coding sequence
atggcctgcccctggaagttcctgttcaagaccaagttccaccagtacgccatgaacggcgagaaggacatcaacaacaacgtggagaaggccccctgcgccaccagcagccccgtgacccaggacgacctgcagtaccacaacctgagcaagcagcagaacgagagcccccagcccctggtggagaccggcaagaagagccccgagagcctggtgaagctggacgccacccccctgagcagccccagacacgtgagaatcaagaactggggcagcggcatgaccttccaggacaccctgcaccacaaggccaagggcatcctgacctgcagaagcaagagctgcctgggcagcatcatgacccccaagagcctgaccagaggccccagagacaagcccaccccccccgacgagctgctgccccaggccatcgagttcgtgaaccagtactacggcagcttcaaggaggccaagatcgaggagcacctggccagagtggaggccgtgaccaaggagatcgagaccaccggcacctaccagctgaccggcgacgagctgatcttcgccaccaagcaggcctggagaaacgcccccagatgcatcggcagaatccagtggagcaacctgcaggtgttcgacgccagaagctgcagcaccgccagagagatgttcgagcacatctgcagacacgtgagatacagcaccaacaacggcaacatcagaagcgccatcaccgtgttcccccagagaagcgacggcaagcacgacttcagagtgtggaacgcccagctgatcagatacgccggctaccagatgcccgacggcagcatcagaggcgaccccgccaacgtggagttcacccagctgtgcatcgacctgggctggaagcccaagtacggcagattcgacgtggtgcccctggtgctgcaggccaacggcagagaccccgagctgttcgagatcccccccgacctggtgctggaggtggccatggagcaccccaagtacgagtggttcagagagctggagctgaagtggtacgccctgcccgccgtggccaacatgctgctggaggtgggcggcctggagttccccggctgccccttcaacggctggtacatgggcaccgagatcggcgtgagagacttctgcgacgtgcagagatacaacatcctggaggaggtgggcagaagaatgggcctggagacccacaagctggccagcctgtggaaggaccaggccgtggtggagatcaacatcgccgtgctgcacagcttccagaagcagaacgtgaccatcatggaccaccacagcgccgccgagagcttcatgaagtacatgcagaacgagtacagaagcagaggcggctgccccgccgactggatctggctggtgccccccatgagcggcagcatcacccccgtgttccaccaggagatgctgaactacgtgctgagccccttctactactaccaggtggaggcctggaagacccacgtgtggcaggacgagaagagaagacccaagagaagagagatccccctgaaggtgctggtgaaggccgtgctgttcgcctgcatgctgatgagaaagaccatggccagcagagtgagagtgaccatcctgttcgccaccgagaccggcaagagcgaggccctggcctgggacctgggcgccctgttcagctgcgccttcaaccccaaggtggtgtgcatggacaagtacagactgagctgcctggaggaggagagactgctgctggtggtgaccagcaccttcggcaacggcgactgccccggcaacggcgagaagctgaagaagagcctgttcatgctgaaggagctgaacaacaagttcagatacgccgtgttcggcctgggcagcagcatgtaccccagattctgcgccttcgcccacgacatcgaccagaagctgagccacctgggcgccagccagctgacccccatgggcgagggcgacgagctgagcggccaggaggacgccttcagaagctgggccgtgcagaccttcaaggccgcctgcgagaccttcgacgtgagaggcaagcagcacatccagatccccaagctgtacaccagcaacgtgacctgggacccccaccactacagactggtgcaggacagccagcccctggacctgagcaaggccctgagcagcatgcacgccaagaacgtgttcaccatgagactgaagagcagacagaacctgcagagccccaccagcagcagagccaccatcctggtggagctgagctgcgaggacggccagggcctgaactacctgcccggcgagcacctgggcgtgtgccccggcaaccagcccgccctggtgcagggcatcctggagagagtggtggacggccccaccccccaccagaccgtgagactggaggccctggacgagagcggcagctactgggtgagcgacaagagactgcccccctgcagcctgagccaggccctgacctacttcctggacatcaccaccccccccacccagctgctgctgcagaagctggcccaggtggccaccgaggagcccgagagacagagactggaggccctgtgccagcccagcgagtacagcaagtggaagttcaccaacagccccaccttcctggaggtgctggaggagttccccagcctgagagtgagcgccggcttcctgctgagccagctgcccatcctgaagcccagattctacagcatcagcagcagcagagaccacacccccaccgagatccacctgaccgtggccgtggtgacctaccacaccagagacggccagggccccctgcaccacggcgtgtgcagcacctggctgaacagcctgaagccccaggaccccgtgccctgcttcgtgagaaacgccagcggcttccacctgcccgaggaccccagccacccctgcatcctgatcggccccggcaccggcatcgcccccttcagaagcttctggcagcagagactgcacgacagccagcacaagggcgtgagaggcggcagaatgaccctggtgttcggctgcagaagacccgacgaggaccacatctaccaggaggagatgctggagatggcccagaagggcgtgctgcacgccgtgcacaccgcctacagcagactgcccggcaagcccaaggtgtacgtgcaggacatcctgagacagcagctggccagcgaggtgctgagagtgctgcacaaggagcccggccacctgtacgtgtgcggcgacgtgagaatggccagagacgtggcccacaccctgaagcagctggtggccgccaagctgaagctgaacgaggagcaggtggaggactacttcttccagctgaagagccagaagagataccacgaggacatcttcggcgccgtgttcccctacgaggccaagaaggacagagtggccgtgcagcccagcagcctggagatgagcgccctgtag

SEQ ID NO: 91193 - DNA, 3345 bp, Artificial Sequence
  Description of Artificial Sequence: Synthetic coding sequence
atggcctgcccctggaagttcctgttcaagaccaagttccaccagtacgccatgaacggcgagaaggacatcaacaacaacgtggagaaggccccctgcgccaccagcagccccgtgacccaggacgacctgcagtaccacaacctgagcaagcagcagaacgagagcccccagcccctggtggagaccggcaagaagagccccgagagcctggtgaagctggacgccacccccctgagcagccccagacacgtgagaatcaagaactggggcagcggcatgaccttccaggacaccctgcaccacaaggccaagggcatcctgacctgcagaagcaagagctgcctgggcagcatcatgacccccaagagcctgaccagaggccccagagacaagcccaccccccccgacgagctgctgccccaggccatcgagttcgtgaaccagtactacggcagcttcaaggaggccaagatcgaggagcacctggccagagtggaggccgtgaccaaggagatcgagaccaccggcacctaccagctgaccggcgacgagctgatcttcgccaccaagcaggcctggagaaacgcccccagatgcatcggcagaatccagtggagcaacctgcaggtgttcgacgccagaagctgcagcaccgccagagagatgttcgagcacatctgcagacacgtgagatacagcaccaacaacggcaacatcagaagcgccatcaccgtgttcccccagagaagcgacggcaagcacgacttcagagtgtggaacgcccagctgtgcatcgacctgggctggaagcccaacggcagagaccccgagctgttcgagatcccccccgacctggtgctggaggtggccatggagcaccccaagtacgagtggttcagagagctggagctgaagtggtacgccctgcccgccgtggccaacatgctgctggaggtgggcggcctggagttccccggctgccccttcaacggctggtacatgggcaccgagatcggcgtgagagacttctgcgacgtgcagagatacaacatcctggaggaggtgggcagaagaatgggcctggagacccacaagctggccagcctgtggaaggaccaggccgtggtggagatcaacatcgccgtgctgcacagcttccagaagcagaacgtgaccatcatggaccaccacagcgccgccgagagcttcatgaagtacatgcagaacgagtacagaagcagaggcggctgccccgccgactggatctggctggtgccccccatgagcggcagcatcacccccgtgttccaccaggagatgctgaactacgtgctgagccccttctactactaccaggtggaggcctggaagacccacgtgtggcaggacgagaagagaagacccaagagaagagagatccccctgaaggtgctggtgaaggccgtgctgttcgcctgcatgctgatgagaaagaccatggccagcagagtgagagtgaccatcctgttcgccaccgagaccggcaagagcgaggccctggcctgggacctgggcgccctgttcagctgcgccttcaaccccaaggtggtgtgcatggacaagtacagactgagctgcctggaggaggagagactgctgctggtggtgaccagcaccttcggcaacggcgactgccccggcaacggcgagaagctgaagaagagcctgttcatgctgaaggagctgaacaacaagttcagatacgccgtgttcggcctgggcagcagcatgtaccccagattctgcgccttcgcccacgacatcgaccagaagctgagccacctgggcgccagccagctgacccccatgggcgagggcgacgagctgagcggccaggaggacgccttcagaagctgggccgtgcagaccttcaaggccgcctgcgagaccttcgacgtgagaggcaagcagcacatccagatccccaagctgtacaccagcaacgtgacctgggacccccaccactacagactggtgcaggacagccagcccctggacctgagcaaggccctgagcagcatgcacgccaagaacgtgttcaccatgagactgaagagcagacagaacctgcagagccccaccagcagcagagccaccatcctggtggagctgagctgcgaggacggccagggcctgaactacctgcccggcgagcacctgggcgtgtgccccggcaaccagcccgccctggtgcagggcatcctggagagagtggtggacggccccaccccccaccagaccgtgagactggaggccctggacgagagcggcagctactgggtgagcgacaagagactgcccccctgcagcctgagccaggccctgacctacttcctggacatcaccaccccccccacccagctgctgctgcagaagctggcccaggtggccaccgaggagcccgagagacagagactggaggccctgtgccagcccagcgagtacagcaagtggaagttcaccaacagccccaccttcctggaggtgctggaggagttccccagcctgagagtgagcgccggcttcctgctgagccagctgcccatcctgaagcccagattctacagcatcagcagcagcagagaccacacccccaccgagatccacctgaccgtggccgtggtgacctaccacaccagagacggccagggccccctgcaccacggcgtgtgcagcacctggctgaacagcctgaagccccaggaccccgtgccctgcttcgtgagaaacgccagcggcttccacctgcccgaggaccccagccacccctgcatcctgatcggccccggcaccggcatcgcccccttcagaagcttctggcagcagagactgcacgacagccagcacaagggcgtgagaggcggcagaatgaccctggtgttcggctgcagaagacccgacgaggaccacatctaccaggaggagatgctggagatggcccagaagggcgtgctgcacgccgtgcacaccgcctacagcagactgcccggcaagcccaaggtgtacgtgcaggacatcctgagacagcagctggccagcgaggtgctgagagtgctgcacaaggagcccggccacctgtacgtgtgcggcgacgtgagaatggccagagacgtggcccacaccctgaagcagctggtggccgccaagctgaagctgaacgaggagcaggtggaggactacttcttccagctgaagagccagaagagataccacgaggacatcttcggcgccgtgttcccctacgaggccaagaaggacagagtggccgtgcagcccagcagcctggagatgagcgccctgtag

SEQ ID NO: 91194 - DNA, 3612 bp, Artificial Sequence
  Description of Artificial Sequence: Synthetic coding sequence
atgggcaacctgaagagcgtggcccaggagcccggccccccctgcggcctgggcctgggcctgggcctgggcctgtgcggcaagcagggccccgccacccccgcccccgagcccagcagagcccccgccagcctgctgccccccgcccccgagcacagcccccccagcagccccctgacccagccccccgagggccccaagttccccagagtgaagaactgggaggtgggcagcatcacctacgacaccctgagcgcccaggcccagcaggacggcccctgcacccccagaagatgcctgggcagcctggtgttccccagaaagctgcagggcagacccagccccggcccccccgcccccgagcagctgctgagccaggccagagacttcatcaaccagtactacagcagcatcaagagaagcggcagccaggcccacgagcagagactgcaggaggtggaggccgaggtggccgccaccggcacctaccagctgagagagagcgagctggtgttcggcgccaagcaggcctggagaaacgcccccagatgcgtgggcagaatccagtggggcaagctgcaggtgttcgacgccagagactgcagaagcgcccaggagatgttcacctacatctgcaaccacatcaagtacgccaccaacagaggcaacctgagaagcgccatcaccgtgttcccccagagatgccccggcagaggcgacttcagaatctggaacagccagctggtgagatacgccggctacagacagcaggacggcagcgtgagaggcgaccccgccaacgtggagatcaccgagctgtgcatccagcacggctggacccccggcaacggcagattcgacgtgctgcccctgctgctgcaggcccccgacgacccccccgagctgttcctgctgccccccgagctggtgctggaggtgcccctggagcaccccaccctggagtggttcgccgccctgggcctgagatggtacgccctgcccgccgtgagcaacatgctgctggagatcggcggcctggagttccccgccgcccccttcagcggctggtacatgagcaccgagatcggcaccagaaacctgtgcgacccccacagatacaacatcctggaggacgtggccgtgtgcatggacctggacaccagaaccaccagcagcctgtggaaggacaaggccgccgtggagatcaacgtggccgtgctgcacagctaccagctggccaaggtgaccatcgtggaccaccacgccgccaccgccagcttcatgaagcacctggagaacgagcagaaggccagaggcggctgccccgccgactgggcctggatcgtgccccccatcagcggcagcctgacccccgtgttccaccaggagatggtgaactacttcctgagccccgccttcagataccagcccgacccctggaagggcagcgccgccaagggcaccggcatcaccagaaagaagaccttcaaggaggtggccaacgccgtgaagatcagcgccagcctgatgggcaccgtgatggccaagagagtgaaggccaccatcctgtacggcagcgagaccggcagagcccagagctacgcccagcagctgggcagactgttcagaaaggccttcgaccccagagtgctgtgcatggacgagtacgacgtggtgagcctggagcacgagaccctggtgctggtggtgaccagcaccttcggcaacggcgacccccccgagaacggcgagagcttcgccgccgccctgatggagatgagcggcccctacaacagcagccccagacccgagcagcacaagagctacaagatcagattcaacagcatcagctgcagcgaccccctggtgagcagctggagaagaaagagaaaggagagcagcaacaccgacagcgccggcgccctgggcaccctgagattctgcgtgttcggcctgggcagcagagcctacccccacttctgcgccttcgccagagccgtggacaccagactggaggagctgggcggcgagagactgctgcagctgggccagggcgacgagctgtgcggccaggaggaggccttcagaggctgggcccaggccgccttccaggccgcctgcgagaccttctgcgtgggcgaggacgccaaggccgccgccagagacatcttcagccccaagagaagctggaagagacagagatacagactgagcgcccaggccgagggcctgcagctgctgcccggcctgatccacgtgcacagaagaaagatgttccaggccaccatcagaagcgtggagaacctgcagagcagcaagagcaccagagccaccatcctggtgagactggacaccggcggccaggagggcctgcagtaccagcccggcgaccacatcggcgtgtgcccccccaacagacccggcctggtggaggccctgctgagcagagtggaggacccccccgcccccaccgagcccgtggccgtggagcagctggagaagggcagccccggcggccccccccccggctgggtgagagaccccagactgcccccctgcaccctgagacaggccctgaccttcttcctggacatcaccagcccccccagcccccagctgctgagactgctgagcaccctggccgaggagcccagagagcagcaggagctggaggccctgagccaggaccccagaagatacgaggagtggaagtggttcagatgccccaccctgctggaggtgctggagcagttccccagcgtggccctgcccgcccccctgctgctgacccagctgcccctgctgcagcccagatactacagcgtgagcagcgcccccagcacccaccccggcgagatccacctgaccgtggccgtgctggcctacagaacccaggacggcctgggccccctgcactacggcgtgtgcagcacctggctgagccagctgaagcccggcgaccccgtgccctgcttcatcagaggcgcccccagcttcagactgccccccgaccccagcctgccctgcatcctggtgggccccggcaccggcatcgcccccttcagaggcttctggcaggagagactgcacgacatcgagagcaagggcctgcagcccacccccatgaccctggtgttcggctgcagatgcagccagctggaccacctgtacagagacgaggtgcagaacgcccagcagagaggcgtgttcggcagagtgctgaccgccttcagcagagagcccgacaaccccaagacctacgtgcaggacatcctgagaaccgagctggccgccgaggtgcacagagtgctgtgcctggagagaggccacatgttcgtgtgcggcgacgtgaccatggccaccaacgtgctgcagaccgtgcagagaatcctggccaccgagggcgacatggagctggacgaggccggcgacgtgatcggcgtgctgagagaccagcagagataccacgaggacatcttcggcctgaccctgagaacccaggaggtgaccagcagaatcagaacccagagcttcagcctgcaggagagacagctgagaggcgccgtgccctgggccttcgacccccccggcagcgacaccaacagcccctag

SEQ ID NO: 91195 - DNA, 2994 bp, Artificial Sequence
  Description of Artificial Sequence: Synthetic coding sequence
atgttcacctacatctgcaaccacatcaagtacgccaccaacagaggcaacctgagaagcgccatcaccgtgttcccccagagatgccccggcagaggcgacttcagaatctggaacagccagctggtgagatacgccggctacagacagcaggacggcagcgtgagaggcgaccccgccaacgtggagatcaccgagctgtgcatccagcacggctggacccccggcaacggcagattcgacgtgctgcccctgctgctgcaggcccccgacgacccccccgagctgttcctgctgccccccgagctggtgctggaggtgcccctggagcaccccaccctggagtggttcgccgccctgggcctgagatggtacgccctgcccgccgtgagcaacatgctgctggagatcggcggcctggagttccccgccgcccccttcagcggctggtacatgagcaccgagatcggcaccagaaacctgtgcgacccccacagatacaacatcctggaggacgtggccgtgtgcatggacctggacaccagaaccaccagcagcctgtggaaggacaaggccgccgtggagatcaacgtggccgtgctgcacagctaccagctggccaaggtgaccatcgtggaccaccacgccgccaccgccagcttcatgaagcacctggagaacgagcagaaggccagaggcggctgccccgccgactgggcctggatcgtgccccccatcagcggcagcctgacccccgtgttccaccaggagatggtgaactacttcctgagccccgccttcagataccagcccgacccctggaagggcagcgccgccaagggcaccggcatcaccagaaagaagaccttcaaggaggtggccaacgccgtgaagatcagcgccagcctgatgggcaccgtgatggccaagagagtgaaggccaccatcctgtacggcagcgagaccggcagagcccagagctacgcccagcagctgggcagactgttcagaaaggccttcgaccccagagtgctgtgcatggacgagtacgacgtggtgagcctggagcacgagaccctggtgctggtggtgaccagcaccttcggcaacggcgacccccccgagaacggcgagagcttcgccgccgccctgatggagatgagcggcccctacaacagcagccccagacccgagcagcacaagagctacaagatcagattcaacagcatcagctgcagcgaccccctggtgagcagctggagaagaaagagaaaggagagcagcaacaccgacagcgccggcgccctgggcaccctgagattctgcgtgttcggcctgggcagcagagcctacccccacttctgcgccttcgccagagccgtggacaccagactggaggagctgggcggcgagagactgctgcagctgggccagggcgacgagctgtgcggccaggaggaggccttcagaggctgggcccaggccgccttccaggccgcctgcgagaccttctgcgtgggcgaggacgccaaggccgccgccagagacatcttcagccccaagagaagctggaagagacagagatacagactgagcgcccaggccgagggcctgcagctgctgcccggcctgatccacgtgcacagaagaaagatgttccaggccaccatcagaagcgtggagaacctgcagagcagcaagagcaccagagccaccatcctggtgagactggacaccggcggccaggagggcctgcagtaccagcccggcgaccacatcggcgtgtgcccccccaacagacccggcctggtggaggccctgctgagcagagtggaggacccccccgcccccaccgagcccgtggccgtggagcagctggagaagggcagccccggcggccccccccccggctgggtgagagaccccagactgcccccctgcaccctgagacaggccctgaccttcttcctggacatcaccagcccccccagcccccagctgctgagactgctgagcaccctggccgaggagcccagagagcagcaggagctggaggccctgagccaggaccccagaagatacgaggagtggaagtggttcagatgccccaccctgctggaggtgctggagcagttccccagcgtggccctgcccgcccccctgctgctgacccagctgcccctgctgcagcccagatactacagcgtgagcagcgcccccagcacccaccccggcgagatccacctgaccgtggccgtgctggcctacagaacccaggacggcctgggccccctgcactacggcgtgtgcagcacctggctgagccagctgaagcccggcgaccccgtgccctgcttcatcagaggcgcccccagcttcagactgccccccgaccccagcctgccctgcatcctggtgggccccggcaccggcatcgcccccttcagaggcttctggcaggagagactgcacgacatcgagagcaagggcctgcagcccacccccatgaccctggtgttcggctgcagatgcagccagctggaccacctgtacagagacgaggtgcagaacgcccagcagagaggcgtgttcggcagagtgctgaccgccttcagcagagagcccgacaaccccaagacctacgtgcaggacatcctgagaaccgagctggccgccgaggtgcacagagtgctgtgcctggagagaggccacatgttcgtgtgcggcgacgtgaccatggccaccaacgtgctgcagaccgtgcagagaatcctggccaccgagggcgacatggagctggacgaggccggcgacgtgatcggcgtgctgagagaccagcagagataccacgaggacatcttcggcctgaccctgagaacccaggaggtgaccagcagaatcagaacccagagcttcagcctgcaggagagacagctgagaggcgccgtgccctgggccttcgacccccccggcagcgacaccaacagcccctag

SEQ ID NO: 91196 - DNA, 1521 bp, Artificial Sequence
  Description of Artificial Sequence: Synthetic coding sequence
atgagagaccccctgaccgactgcccctacaacaaggtgtacaagaacctgaaggagttcagccagaacggcgagaacttctgcaagcaggtgaccagcgtgctgcagcagagagccaacctggagatcagctacgccaagggcctgcagaagctggccagcaagctgagcaaggccctgcagaacaccagaaagagctgcgtgagcagcgcctgggcctgggccagcgagggcatgaagagcaccgccgacctgcaccagaagctgggcaaggccatcgagctggaggccatcaagcccacctaccaggtgctgaacgtgcaggagaagaagagaaagagcctggacaacgaggtggagaagaccgccaacctggtgatcagcaactggaaccagcagatcaaggccaagaagaagctgatggtgagcaccaagaagcacgaggccctgttccagctggtggagagcagcaagcagagcatgaccgagaaggagaagagaaagctgctgaacaagctgaccaagagcaccgagaagctggagaaggaggacgagaactactaccagaagaacatggccggctacagcaccagactgaagtgggagaacaccctggagaactgctaccagagcatcctggagctggagaaggagagaatccagctgctgtgcaacaacctgaaccagtacagccagcacatcagcctgttcggccagaccctgaccacctgccacacccagatccactgcgccatcagcaagatcgacatcgagaaggacatccaggccgtgatggaggagaccgccatcctgagcaccgagaacaagagcgagttcctgctgaccgactacttcgaggaggaccccaacagcgccatggacaaggagagaagaaagagcctgctgaagcccaagctgctgagactgcagagagacatcgagaaggccagcaaggacaaggagggcctggagagaatgctgaagacctacagcagcaccagcagcttcagcgacgccaagagccagaaggacaccgccgccctgatggacgagaacaacctgaagctggacctgctggaggccaacagctacaagctgagcagcatgctggccgagctggagcagagaccccagcccagccacccctgcagcaacagcatcttcagatggagagagaaggagcacacccacagctacgtgaagatcagcagacccttcctgatgaagagactggagaacatcgtgagcaaggccagcagcggcggccagagcaaccccggcagcagcacccccgcccccggcgccgcccagctgagcagcagactgtgcaaggccctgtacagcttccaggccagacaggacgacgagctgaacctggagaagggcgacatcgtgatcatccacgagaagaaggagggcggctggtggttcggcagcctgaacggcaagaagggccacttccccgccgcctacgtggaggagctgcccagcaacgccggcaacaccgccaccaaggcctag

SEQ ID NO: 91197 - DNA, 1287 bp, Artificial Sequence
  Description of Artificial Sequence: Synthetic coding sequence
atgaagagcaccgccgacctgcaccagaagctgggcaaggccatcgagctggaggccatcaagcccacctaccaggtgctgaacgtgcaggagaagaagagaaagagcctggacaacgaggtggagaagaccgccaacctggtgatcagcaactggaaccagcagatcaaggccaagaagaagctgatggtgagcaccaagaagcacgaggccctgttccagctggtggagagcagcaagcagagcatgaccgagaaggagaagagaaagctgctgaacaagctgaccaagagcaccgagaagctggagaaggaggacgagaactactaccagaagaacatggccggctacagcaccagactgaagtgggagaacaccctggagaactgctaccagagcatcctggagctggagaaggagagaatccagctgctgtgcaacaacctgaaccagtacagccagcacatcagcctgttcggccagaccctgaccacctgccacacccagatccactgcgccatcagcaagatcgacatcgagaaggacatccaggccgtgatggaggagaccgccatcctgagcaccgagaacaagagcgagttcctgctgaccgactacttcgaggaggaccccaacagcgccatggacaaggagagaagaaagagcctgctgaagcccaagctgctgagactgcagagagacatcgagaaggccagcaaggacaaggagggcctggagagaatgctgaagacctacagcagcaccagcagcttcagcgacgccaagagccagaaggacaccgccgccctgatggacgagaacaacctgaagctggacctgctggaggccaacagctacaagctgagcagcatgctggccgagctggagcagagaccccagcccagccacccctgcagcaacagcatcttcagatggagagagaaggagcacacccacagctacgtgaagatcagcagacccttcctgatgaagagactggagaacatcgtgagcaaggccagcagcggcggccagagcaaccccggcagcagcacccccgcccccggcgccgcccagctgagcagcagactgtgcaaggccctgtacagcttccaggccagacaggacgacgagctgaacctggagaagggcgacatcgtgatcatccacgagaagaaggagggcggctggtggttcggcagcctgaacggcaagaagggccacttccccgccgcctacgtggaggagctgcccagcaacgccggcaacaccgccaccaaggcctag

SEQ ID NO: 91198 - DNA, 1692 bp, Artificial Sequence
  Description of Artificial Sequence: Synthetic coding sequence
atgagagaccccctgaccgactgcccctacaacaaggtgtacaagaacctgaaggagttcagccagaacggcgagaacttctgcaagcaggtgaccagcgtgctgcagcagagagccaacctggagatcagctacgccaagggcctgcagaagctggccagcaagctgagcaaggccctgcagaacaccagaaagagctgcgtgagcagcgcctgggcctgggccagcgagggcatgaagagcaccgccgacctgcaccagaagctgggcaaggccatcgagctggaggccatcaagcccacctaccaggtgctgaacgtgcaggagaagaagagaaagagcctggacaacgaggtggagaagaccgccaacctggtgatcagcaactggaaccagcagatcaaggccaagaagaagctgatggtgagcaccaagaagcacgaggccctgttccagctggtggagagcagcaagcagagcatgaccgagaaggagaagagaaagctgctgaacaagctgaccaagagcaccgagaagctggagaaggaggacgagaactactaccagaagaacatggccggctacagcaccagactgaagtgggagaacaccctggagaactgctaccaggtgacccacagcatctgcctgtacgccttctgggtgaagagagcctggggcaagtgcgtgagcgacctgagataccaggacaccttcctgcccggcaacctgccccccctgtggttcggctacgacatcgtgaagagactgatcatgagactgtgcagcgtgtgcctgcagagcatcctggagctggagaaggagagaatccagctgctgtgcaacaacctgaaccagtacagccagcacatcagcctgttcggccagaccctgaccacctgccacacccagatccactgcgccatcagcaagatcgacatcgagaaggacatccaggccgtgatggaggagaccgccatcctgagcaccgagaacaagagcgagttcctgctgaccgactacttcgaggaggaccccaacagcgccatggacaaggagagaagaaagagcctgctgaagcccaagctgctgagactgcagagagacatcgagaaggccagcaaggacaaggagggcctggagagaatgctgaagacctacagcagcaccagcagcttcagcgacgccaagagccagaaggacaccgccgccctgatggacgagaacaacctgaagctggacctgctggaggccaacagctacaagctgagcagcatgctggccgagctggagcagagaccccagcccagccacccctgcagcaacagcatcttcagatggagagagaaggagcacacccacagctacgtgaagatcagcagacccttcctgatgaagagactggagaacatcgtgagcaaggccagcagcggcggccagagcaaccccggcagcagcacccccgcccccggcgccgcccagctgagcagcagactgtgcaaggccctgtacagcttccaggccagacaggacgacgagctgaacctggagaagggcgacatcgtgatcatccacgagaagaaggagggcggctggtggttcggcagcctgaacggcaagaagggccacttccccgccgcctacgtggaggagctgcccagcaacgccggcaacaccgccaccaaggcctag

SEQ ID NO: 91199 - DNA, 1692 bp, Artificial Sequence; identical to SEQ ID NO: 91198
  Description of Artificial Sequence: Synthetic coding sequence

SEQ ID NO: 91200 - DNA, 939 bp, Artificial Sequence
  Description of Artificial Sequence: Synthetic coding sequence
atgaccttcggcctgagaaagagactgagcgaggagagaggcttcagcctgatgcccagagccatggccatcagcagcagcagctgcgagctgcccctggtggccgtgtgccaggtgaccagcacccccgacaagcagcagaacttcaagacctgcgccgagctggtgagagaggccgccagactgggcgcctgcctggccttcctgcccgaggccttcgacttcatcgccagagaccccgccgagaccctgcacctgagcgagcccctgggcggcaagctgctggaggagtacacccagctggccagagagtgcggcctgtggctgagcctgggcggcttccacgagagaggccaggactgggagcagacccagaagatctacaactgccacgtgctgctgaacagcaagggcgccgtggtggccacctacagaaagacccacctgtgcgacgtggagatccccggccagggccccatgtgcgagagcaacagcaccatgcccggccccagcctggagagccccgtgagcacccccgccggcaagatcggcctggccgtgtgctacgacatgagattccccgagctgagcctggccctggcccaggccggcgccgagatcctgacctaccccagcgccttcggcagcatcaccggccccgcccactgggaggtgctgctgagagccagagccatcgagacccagtgctacgtggtggccgccgcccagtgcggcagacaccacgagaagagagccagctacggccacagcatggtggtggacccctggggcaccgtggtggccagatgcagcgagggccccggcctgtgcctggccagaatcgacctgaactacctgagacagctgagaagacacctgcccgtgttccagcacagaagacccgacctgtacggcaacctgggccaccccctgagctag

SEQ ID NO: 91201 - DNA, 732 bp, Artificial Sequence
  Description of Artificial Sequence: Synthetic coding sequence
atgctgggcttcatcaccagacccccccacagattcctgagcctgctgtgccccggcctgagaatcccccagctgagcgtgctgtgcgcccagcccagacccagagccatggccatcagcagcagcagctgcgagctgcccctggtggccgtgtgccaggtgaccagcacccccgacaagcagcagaacttcaagacctgcgccgagctggtgagagaggccgccagactgggcgcctgcctggccttcctgcccgaggccttcgacttcatcgccagagaccccgccgagaccctgcacctgagcgagcccctgggcggcaagctgctggaggagtacacccagctggccagagagtgcggcctgtggctgagcctgggcggcttccacgagagaggccaggactgggagcagacccagaagatctacaactgccacgtgctgctgaacagcaagggcgccgtggtggccacctacagaaagacccacctgtgcgacgtggagatccccggccagggccccatgtgcgagagcaacagcaccatgcccggccccagcctggagagccccgtgagcacccccgccggcaagatcggcctggccgtgtgctacgacatgagattccccgagctgagcctggccctggcccaggccggcgccgagatcctgacctaccccagcgccttcggcagcatcaccggccccgcccactgggagcccgtgagcagctag

SEQ ID NO: 91202 - DNA, 984 bp, Artificial Sequence
  Description of Artificial Sequence: Synthetic coding sequence
atgctgggcttcatcaccagacccccccacagattcctgagcctgctgtgccccggcctgagaatcccccagctgagcgtgctgtgcgcccagcccagacccagagccatggccatcagcagcagcagctgcgagctgcccctggtggccgtgtgccaggtgaccagcacccccgacaagcagcagaacttcaagacctgcgccgagctggtgagagaggccgccagactgggcgcctgcctggccttcctgcccgaggccttcgacttcatcgccagagaccccgccgagaccctgcacctgagcgagcccctgggcggcaagctgctggaggagtacacccagctggccagagagtgcggcctgtggctgagcctgggcggcttccacgagagaggccaggactgggagcagacccagaagatctacaactgccacgtgctgctgaacagcaagggcgccgtggtggccacctacagaaagacccacctgtgcgacgtggagatccccggccagggccccatgtgcgagagcaacagcaccatgcccggccccagcctggagagccccgtgagcacccccgccggcaagatcggcctggccgtgtgctacgacatgagattccccgagctgagcctggccctggcccaggccggcgccgagatcctgacctaccccagcgccttcggcagcatcaccggccccgcccactgggaggtgctgctgagagccagagccatcgagacccagtgctacgtggtggccgccgcccagtgcggcagacaccacgagaagagagccagctacggccacagcatggtggtggacccctggggcaccgtggtggccagatgcagcgagggccccggcctgtgcctggccagaatcgacctgaactacctgagacagctgagaagacacctgcccgtgttccagcacagaagacccgacctgtacggcaacctgggccaccccctgagctag

SEQ ID NO: 91203 - DNA, 876 bp, Artificial Sequence
  Description of Artificial Sequence: Synthetic coding sequence
atggccatcagcagcagcagctgcgagctgcccctggtggccgtgtgccaggtgaccagcacccccgacaagcagcagaacttcaagacctgcgccgagctggtgagagaggccgccagactgggcgcctgcctggccttcctgcccgaggccttcgacttcatcgccagagaccccgccgagaccctgcacctgagcgagcccctgggcggcaagctgctggaggagtacacccagctggccagagagtgcggcctgtggctgagcctgggcggcttccacgagagaggccaggactgggagcagacccagaagatctacaactgccacgtgctgctgaacagcaagggcgccgtggtggccacctacagaaagacccacctgtgcgacgtggagatccccggccagggccccatgtgcgagagcaacagcaccatgcccggccccagcctggagagccccgtgagcacccccgccggcaagatcggcctggccgtgtgctacgacatgagattccccgagctgagcctggccctggcccaggccggcgccgagatcctgacctaccccagcgccttcggcagcatcaccggccccgcccactgggaggtgctgctgagagccagagccatcgagacccagtgctacgtggtggccgccgcccagtgcggcagacaccacgagaagagagccagctacggccacagcatggtggtggacccctggggcaccgtggtggccagatgcagcgagggccccggcctgtgcctggccagaatcgacctgaactacctgagacagctgagaagacacctgcccgtgttccagcacagaagacccgacctgtacggcaacctgggccaccccctgagctag

SEQ ID NO: 91204 - DNA, 822 bp, Artificial Sequence
  Description of Artificial Sequence: Synthetic coding sequence
atgagcctgaccaacaccaagaccggcttcagcgtgaaggacatcctggacctgcccgacaccaacgacgaggagggcagcgtggccgagggccccgaggaggagaacgagggccccgagcccgccaagagagccggccccctgggccagggcgccctggacgccgtgcagagcctgcccctgaagaaccccttctacgacagcagcgacaacccctacaccagatggctggccagcaccgagggcctgcagtacagcctgcacggcctggccgccggcgcccccccccaggacagcagcagcaagagccccgagcccagcgccgacgagagccccgacaacgacaaggagacccccggcggcggcggcgacgccggcaagaagagaaagagaagagtgctgttcagcaaggcccagacctacgagctggagagaagattcagacagcagagatacctgagcgcccccgagagagagcacctggccagcctgatcagactgacccccacccaggtgaagatctggttccagaaccacagatacaagatgaagagagccagagccgagaagggcatggaggtgacccccctgcccagccccagaagagtggccgtgcccgtgctggtgagagacggcaagccctgccacgccctgaaggcccaggacctggccgccgccaccttccaggccggcatccccttcagcgcctacagcgcccagagcctgcagcacatgcagtacaacgcccagtacagcagcgccagcaccccccagtaccccaccgcccaccccctggtgcaggcccagcagtggacctggtag

SEQ ID NO: 91205 - DNA, 1065 bp, Artificial Sequence
  Description of Artificial Sequence: Synthetic coding sequence
atgagcctgagccccaagcacaccacccccttcagcgtgagcgacatcctgagccccatcgaggagacctacaagaagttcagcggcgccatggacggcgccccccccggcctgggcgcccccctgggcgccgccgccgcctacagagcccccccccccggccccagcagccaggccgccaccgtggccggcatgcagcccagccacgccatggccggccacaacgccgccgccgccgccgccgccgccgccgccgccgccgccgccgccgccacctaccacatgccccccggcgtgagccagttcccccacggcgccatgggcagctactgcaacggcggcctgggcaacatgggcgagctgcccgcctacaccgacggcatgagaggcggcgccgccaccggctggtacggcgccaaccccgaccccagatacagcagcatcagcagattcatgggccccagcgccggcgtgaacgtggccggcatgggcagcctgaccggcatcgccgacgccgccaagagcctgggccccctgcacgccgccgccgccgccgccgcccccagaagaaagagaagagtgctgttcagccaggcccaggtgtacgagctggagagaagattcaagcagcagaagtacctgagcgcccccgagagagagcacctggccagcatgatccacctgacccccacccaggtgaagatctggttccagaaccacagatacaagatgaagagacaggccaaggacaaggccgcccagcagctgcagcaggagggcggcctgggccccccccccccccccccccccagccccagaagagtggccgtgcccgtgctggtgaaggacggcaagccctgccagaacggcgccagcacccccacccccggccaggccggcccccagccccccgcccccacccccgcccccgagctggaggagctgagccccagcccccccgccctgcacggccccggcggcggcctggccgccctggacgccgccgccggcgagtacagcggcggcgtgctgggcgccaacctgctgtacggcagaacctggtag

SEQ ID NO: 91206 - DNA, 975 bp, Artificial Sequence
  Description of Artificial Sequence: Synthetic coding sequence
atgttccccagccccgccctgacccccacccccttcagcgtgaaggacatcctgaacctggagcagcagcagagaagcctggccgccgccggcgagctgagcgccagactggaggccaccctggcccccagcagctgcatgctggccgccttcaagcccgaggcctacgccggccccgaggccgccgcccccggcctgcccgagctgagagccgagctgggcagagcccccagccccgccaagtgcgccagcgccttccccgccgcccccgccttctaccccagagcctacagcgaccccgaccccgccaaggaccccagagccgagaagaaggagctgtgcgccctgcagaaggccgtggagctggagaagaccgaggccgacaacgccgagagacccagagccagaagaagaagaaagcccagagtgctgttcagccaggcccaggtgtacgagctggagagaagattcaagcagcagagatacctgagcgcccccgagagagaccagctggccagcgtgctgaagctgaccagcacccaggtgaagatctggttccagaacagaagatacaagtgcaagagacagagacaggaccagaccctggagctggtgggcctgcccccccccccccccccccccgccagaagaatcgccgtgcccgtgctggtgagagacggcaagccctgcctgggcgacagcgccccctacgcccccgcctacggcgtgggcctgaacccctacggctacaacgcctaccccgcctaccccggctacggcggcgccgcctgcagccccggctacagctgcaccgccgcctaccccgccggccccagccccgcccagcccgccaccgccgccgccaacaacaacttcgtgaacttcggcgtgggcgacctgaacgccgtgcagagccccggcatcccccagagcaacagcggcgtgagcaccctgcacggcatcagagcctggtag

SEQ ID NO: 91207 - DNA, 339 bp, Artificial Sequence
  Description of Artificial Sequence: Synthetic coding sequence
atgttccccagccccgccctgacccccacccccttcagcgtgaaggacatcctgaacctggagcagcagcagagaagcctggccgccgccggcgagctgagcgccagactggaggccaccctggcccccagcagctgcatgctggccgccttcaagcccgaggcctacgccggccccgaggccgccgcccccggcctgcccgagctgagagccgagctgggcagagcccccagccccgccaagtgcgccagcgccttccccgccgcccccgccttctaccccagagcctacagcgaccccgaccccgccaaggaccccagagccgagaagaaggcctag

SEQ ID NO: 91208 - DNA, 456 bp, Artificial Sequence
  Description of Artificial Sequence: Synthetic coding sequence
atgttccccagccccgccctgacccccacccccttcagcgtgaaggacatcctgaacctggagcagcagcagagaagcctggccgccgccggcgagctgagcgccagactggaggccaccctggcccccagcagctgcatgctggccgccttcaagcccgaggcctacgccggccccgaggccgccgcccccggcctgcccgagctgagagccgagctgggcagagcccccagccccgccaagtgcgccagcgccttccccgccgcccccgccttctaccccagagcctacagcgaccccgaccccgccaaggaccccagagccgagaagaagggctgcgagctgcccagaggccagagaccccccgtgctgttcagcagcgccctgagccagcccgacttcctgcagatgctgagcgagacctgcagatggctgcccgtgcacctggccgagtag

SEQ ID NO: 91209 - DNA, 906 bp, Artificial Sequence
  Description of Artificial Sequence: Synthetic coding sequence
atgctgctgagccccgtgaccagcacccccttcagcgtgaaggacatcctgagactggagagagagagaagctgccccgccgccagcccccaccccagagtgagaaagagccccgagaacttccagtacctgagaatggacgccgagcccagaggcagcgaggtgcacaacgccggcggcggcggcggcgacagaaagctggacggcagcgagccccccggcggcccctgcgaggccgtgctggagatggacgccgagagaatgggcgagccccagcccggcctgaacgccgccagccccctgggcggcggcaccagagtgcccgagagaggcgtgggcaacagcggcgacagcgtgagaggcggcagaagcgagcagcccaaggccagacagagaagaaagcccagagtgctgttcagccaggcccaggtgctggccctggagagaagattcaagcagcagagatacctgagcgcccccgagagagagcacctggccagcgccctgcagctgaccagcacccaggtgaagatctggttccagaacagaagatacaagtgcaagagacagagacaggacaagagcctggagctggccggccaccccctgacccccagaagagtggccgtgcccgtgctggtgagagacggcaagccctgcctgggccccggccccggcgcccccgccttccccagcccctacagcgccgccgtgagcccctacagctgctacggcggctacagcggcgccccctacggcgccggctacggcacctgctacgccggcgcccccagcggccccgccccccacacccccctggccagcgccggcttcggccacggcggccagaacgccaccccccagggccacctggccgccaccctgcagggcgtgagagcctggtag

SEQ ID NO: 91210 - DNA, 660 bp, Artificial Sequence
  Description of Artificial Sequence: Synthetic coding sequence
atggacgccgagagaatgggcgagccccagcccggcctgaacgccgccagccccctgggcggcggcaccagagtgcccgagagaggcgtgggcaacagcggcgacagcgtgagaggcggcagaagcgagcagcccaaggccagacagagaagaaagcccagagtgctgttcagccaggcccaggtgctggccctggagagaagattcaagcagcagagatacctgagcgcccccgagagagagcacctggccagcgccctgcagctgaccagcacccaggtgaagatctggttccagaacagaagatacaagtgcaagagacagagacaggacaagagcctggagctggccggccaccccctgacccccagaagagtggccgtgcccgtgctggtgagagacggcaagccctgcctgggccccggccccggcgcccccgccttccccagcccctacagcgccgccgtgagcccctacagctgctacggcggctacagcggcgccccctacggcgccggctacggcacctgctacgccggcgcccccagcggccccgccccccacacccccctggccagcgccggcttcggccacggcggccagaacgccaccccccagggccacctggccgccaccctgcagggcgtgagagcctggtag

SEQ ID NO: 91211 - DNA, 720 bp, Artificial Sequence
  Description of Artificial Sequence: Synthetic coding sequence
atggccaccagcggcagactgagcttcaccgtgagaagcctgctggacctgcccgagcaggacgcccagcacctgcccagaagagagcccgagcccagagccccccagcccgacccctgcgccgcctggctggacagcgagagaggccactaccccagcagcgacgagagcagcctggagaccagcccccccgacagcagccagagacccagcgccagacccgccagccccggcagcgacgccgagaagagaaagaagagaagagtgctgttcagcaaggcccagaccctggagctggagagaagattcagacagcagagatacctgagcgcccccgagagagagcagctggccagcctgctgagactgacccccacccaggtgaagatctggttccagaaccacagatacaagctgaagagagccagagcccccggcgccgccgagagccccgacctggccgccagcgccgagctgcacgccgcccccggcctgctgagaagagtggtggtgcccgtgctggtgagagacggccagccctgcggcggcggcggcggcggcgaggtgggcaccgccgccgcccaggagaagtgcggcgccccccccgccgccgcctgccccctgcccggctaccccgccttcggccccggcagcgccctgggcctgttccccgcctaccagcacctggccagccccgccctggtgagctggaactggtag

SEQ ID NO: 91212 - DNA, 1002 bp, Artificial Sequence
  Description of Artificial Sequence: Synthetic coding sequence
atggccgtgagaggcgccaacaccctgaccagcttcagcatccaggccatcctgaacaagaaggaggagagaggcggcctggccgcccccgagggcagacccgcccccggcggcaccgccgccagcgtggccgccgcccccgccgtgtgctgctggagactgttcggcgagagagacgccggcgccctgggcggcgccgaggacagcctgctggccagccccgccggcaccagaaccgccgccggcagaaccgccgagagccccgagggctgggacagcgacagcgccctgagcgaggagaacgagagcagaagaagatgcgccgacgccagaggcgccagcggcgccggcctggccggcggcagcctgagcctgggccagcccgtgtgcgagctggccgccagcaaggacctggaggaggaggccgccggcagaagcgacagcgagatgagcgccagcgtgagcggcgacagaagccccagaaccgaggacgacggcgtgggccccagaggcgcccacgtgagcgccctgtgcagcggcgccggcggcggcggcggcagcggccccgccggcgtggccgaggaggaggaggagcccgccgcccccaagcccagaaagaagagaagcagagccgccttcagccacgcccaggtgttcgagctggagagaagattcaaccaccagagatacctgagcggccccgagagagccgacctggccgccagcctgaagctgaccgagacccaggtgaagatctggttccagaacagaagatacaagaccaagagaagacagatggccgccgacctgctggccagcgcccccgccgccaagaaggtggccgtgaaggtgctggtgagagacgaccagagacagtacctgcccggcgaggtgctgagaccccccagcctgctgcccctgcagcccagctactactacccctactactgcctgcccggctgggccctgagcacctgcgccgccgccgccggcacccagtag

SEQ ID NO: 91213 - DNA, 798 bp, Artificial Sequence
  Description of Artificial Sequence: Synthetic coding sequence
atggagagcaacctgcagggcaccttcctgctgaacaacacccccctggcccagttccccgagatgaaggcccccgtgtgccagtacagcgtgcagaacagcttctacaagctgagcccccccggcctgggcccccagctggccgccggcaccccccacggcatcaccgacatcctgagcagacccgtggccgcccccaacaacagcctgctgagcggctacccccacgtggccggcttcggcggcctgagcagccagggcgtgtactacagcccccaggtgggcaacttcagcaaggccggcaacgagtaccccaccagaaccagaaactgctgggccgacaccggccaggactggagaggcggcagacagtgcagcaacacccccgaccccctgagcgacagcatccacaagaagaagcacaccagacccaccttcaccggccaccagatcttcgccctggagaagaccttcgagcagaccaagtacctggccggccccgagagagccagactggcctacagcctgggcatgaccgagagccaggtgaaggtgtggttccagaacagaagaaccaagtggagaaagaagagcgccctggagcccagcagcagcacccccagagcccccggcggcgccggcgccggcgccggcggcgacagagcccccagcgagaacgaggacgacgagtacaacaagcccctggaccccgacagcgacgacgagaagatcagactgctgctgagaaagcacagagccgccttcagcgtgctgagcctgggcgcccacagcgtgtag

SEQ ID NO: 91214 - DNA, 408 bp, Artificial Sequence
  Description of Artificial Sequence: Synthetic coding sequence
atgcagcagggccagctggcccccggcagcagactgtgcagcggcccctggggcctgcccgagctgcagcccgccgcccccagcagcagcgccgcccagctgccctggggcgagagctggggcgaggaggccgacacccccgcctgcctgagcgccagcggcgtgtggttccagaacagaagaaccaagtggagaaagaagagcgccctggagcccagcagcagcacccccagagcccccggcggcgccggcgccggcgccggcggcgacagagcccccagcgagaacgaggacgacgagtacaacaagcccctggaccccgacagcgacgacgagaagatcagactgctgctgagaaagcacagagccgccttcagcgtgctgagcctgggcgcccacagcgtgtag

SEQ ID NO: 91215 - DNA, 2928 bp, Artificial Sequence
  Description of Artificial Sequence: Synthetic coding sequence
atgagatggggccaccacctgcccagagccagctggggcagcggcttcagaagagccctgcagagacccgacgacagaatccccttcctgatccactggagctggcccctgcagggcgagagacccttcggcccccccagagccttcatcagacaccacggcagcagcgtggacagcgcccccccccccggcagacacggcagactgttccccagcgccagcgccaccgaggccatccagagacacagaagaaacctggccgagtggttcagcagactgcccagagaggagagacagttcggccccaccttcgccctggacaccgtgcacgtggaccccgtgatcagagagagcacccccgacgagctgctgagaccccccgccgagctggccctggagcaccagcccccccaggccggcctgccccccctggccctgagccagctgttcaaccccgacgcctgcggcagaagagtgcagaccgtggtgctgtacggcaccgtgggcaccggcaagagcaccctggtgagaaagatggtgctggactggtgctacggcagactgcccgccttcgagctgctgatccccttcagctgcgaggacctgagcagcctgggccccgcccccgccagcctgtgccagctggtggcccagagatacacccccctgaaggaggtgctgcccctgatggccgccgccggcagccacctgctgttcgtgctgcacggcctggagcacctgaacctggacttcagactggccggcaccggcctgtgcagcgaccccgaggagccccaggagcccgccgccatcatcgtgaacctgctgagaaagtacatgctgccccaggccagcatcctggtgaccaccagacccagcgccatcggcagaatccccagcaagtacgtgggcagatacggcgagatctgcggcttcagcgacaccaacctgcagaagctgtacttccagctgagactgaaccagccctactgcggctacgccgtgggcggcagcggcgtgagcgccacccccgcccagagagaccacctggtgcagatgctgagcagaaacctggagggccaccaccagatcgccgccgcctgcttcctgcccagctactgctggctggtgtgcgccaccctgcacttcctgcacgcccccacccccgccggccagaccctgaccagcatctacaccagcttcctgagactgaacttcagcggcgagaccctggacagcaccgaccccagcaacctgagcctgatggcctacgccgccagaaccatgggcaagctggcctacgagggcgtgagcagcagaaagacctacttcagcgaggaggacgtgtgcggctgcctggaggccggcatcagaaccgaggaggagttccagctgctgcacatcttcagaagagacgccctgagattcttcctggccccctgcgtggagcccggcagagccggcaccttcgtgttcaccgtgcccgccatgcaggagtacctggccgccctgtacatcgtgctgggcctgagaaagaccaccctgcagaaggtgggcaaggaggtggccgagctggtgggcagagtgggcgaggacgtgagcctggtgctgggcatcatggccaagctgctgcccctgagagccctgcccctgctgttcaacctgatcaaggtggtgcccagagtgttcggcagaatggtgggcaagagcagagaggccgtggcccaggccatggtgctggagatgttcagagaggaggactactacaacgacgacgtgctggaccagatgggcgccagcatcctgggcgtggagggccccagaagacaccccgacgagccccccgaggacgaggtgttcgagctgttccccatgttcatgggcggcctgctgagcgcccacaacagagccgtgctggcccagctgggctgccccatcaagaacctggacgccctggagaacgcccaggccatcaagaagaagctgggcaagctgggcagacaggtgctgccccccagcgagctgctggaccacctgttcttccactacgagttccagaaccagagattcagcgccgaggtgctgagcagcctgagacagctgaacctggccggcgtgagaatgacccccgtgaagtgcaccgtggtggccgccgtgctgggcagcggcagacacgccctggacgaggtgaacctggccagctgccagctggaccccgccggcctgagaaccctgctgcccgtgttcctgagagccagaaagctgggcctgcagctgaacagcctgggccccgaggcctgcaaggacctgagagacctgctgctgcacgaccagtgccagatcaccaccctgagactgagcaacaaccccctgaccgccgccggcgtggccgtgctgatggagggcctggccggcaacaccagcgtgacccacctgagcctgctgcacaccggcctgggcgacgagggcctggagctgctggccgcccagctggacagaaacagacagctgcaggagctgaacgtggcctacaacggcgccggcgacaccgccgccctggccctggccagagccgccagagagcaccccagcctggagctgctgcacctgtacttcaacgagctgagcagcgagggcagacaggtgctgagagacctgggcggcgccgccgagggcggcgccagagtggtggtgagcctgaccgagggcaccgccgtgagcgagtactggagcgtgatcctgagcgaggtgcagagaaacctgaacagctgggacagagccagagtgcagagacacctggagctgctgctgagagacctggaggacagcagaggcgccaccctgaacccctggagaaaggcccagctgctgagagtggagggcgaggtgagagccctgctggagcagctgggcagcagcggcagctag

SEQ ID NO: 91216 - DNA, 345 bp, Artificial Sequence
  Description of Artificial Sequence: Synthetic coding sequence
ggcatcagcaagctgaagatggtgaaccagtgcttcggcctgggcgacggcacctgcctgctgagcatccagctggagggccccaagcacgtggccttcggctggcccgagtgccccgaggcccccctgcccaccctgccccccccccccctgaaggagcccctgaccgtgagccccagaggcagccacctgatgagcgccatgcccggcgtgagccccagcagatgcgtgggcagcttccccagctgcctgatgctgacctgcggccacagaggctgcccccacatcggcgccttcagcagcagcagctgccccctgtgccacaacggcatgatggcctggtag

SEQ ID NO: 91217 - DNA, 2928 bp, Artificial Sequence; identical to SEQ ID NO: 91215
  Description of Artificial Sequence: Synthetic coding sequence

SEQ ID NO: 91218 - DNA, 2766 bp, Artificial Sequence
  Description of Artificial Sequence: Synthetic coding sequence
atgagatggggccaccacctgcccagagccagctggggcagcggcttcagaagagccctgcagagacccgacgacagaatccccttcctgatccactggagctggcccctgcagggcgagagacccttcggcccccccagagccttcatcagacaccacggcagcagcgtggacagcgcccccccccccggcagacacggcagactgttccccagcgccagcgccaccgaggccatccagagacacagaagaaacctggccgagtggttcagcagactgcccagagaggagagacagttcggccccaccttcgccctggacaccgtgcacgtggaccccgtgatcagagagagcacccccgacgagctgctgagaccccccgccgagctggccctggagcaccagcccccccaggccggcctgccccccctggccctgagccagctgttcaaccccgacgcctgcggcagaagagtgcagaccgtggtgctgtacggcaccgtgggcaccggcaagagcaccctggtgagaaagatggtgctggactggtgctacggcagactgcccgccttcgagctgctgatccccttcagctgcgaggacctgagcagcctgggccccgcccccgccagcctgtgccagctggtggcccagagatacacccccctgaaggaggtgctgcccctgatggccgccgccggcagccacctgctgttcgtgctgcacggcctggagcacctgaacctggacttcagactggccggcaccggcctgtgcagcgaccccgaggagccccaggagcccgccgccatcatcgtgaacctgctgagaaagtacatgctgccccaggccagcatcctggtgaccaccagacccagcgccatcggcagaatccccagcaagtacgtgggcagatacggcgagatctgcggcttcagcgacaccaacctgcagaagctgtacttccagctgagactgaaccagccctactgcggctacgccgtgggcggcagcggcgtgagcgccacccccgcccagagagaccacctggtgcagatgctgagcagaaacctggagggccaccaccagatcgccgccgcctgcttcctgcccagctactgctggctggtgtgcgccaccctgcacttcctgcacgcccccacccccgccggccagaccctgaccagcatctacaccagcttcctgagactgaacttcagcggcgagaccctggacagcaccgaccccagcaacctgagcctgatggcctacgccgccagaaccatgggcaagctggcctacgagggcgtgagcagcagaaagacctacttcagcgaggaggacgtgtgcggctgcctggaggccggcatcagaaccgaggaggagttccagctgctgcacatcttcagaagagacgccctgagattcttcctggccccctgcgtggagcccggcagagccggcaccttcgtgttcaccgtgcccgccatgcaggagtacctggccgccctgtacatcgtgctgggcctgagaaagaccaccctgcagaaggtgggcaaggaggtggccgagctggtgggcagagtgggcgaggacgtgagcctggtgctgggcatcatggccaagctgctgcccctgagagccctgcccctgctgttcaacctgatcaaggtggtgcccagagtgttcggcagaatggtgggcaagagcagagaggccgtggcccaggccatggtgctggagatgttcagagaggaggactactacaacgacgacgtgctggaccagatgggcgccagcatcctgggcgtggagggccccagaagacaccccgacgagccccccgaggacgaggtgttcgagctgttccccatgttcatgggcggcctgctgagcgcccacaacagagccgtgctggcccagctgggctgccccatcaagaacctggacgccctggagaacgcccaggccatcaagaagaagctgggcaagctgggcagacaggtgctgccccccagcgagctgctggaccacctgttcttccactacgagttccagaaccagagattcagcgccgaggtgctgagcagcctgagacagctgaacctggccggcgtgagaatgacccccgtgaagtgcaccgtggtggccgccgtgctgggcagcggcagacacgccctggacgaggtgaacctggccagctgccagctggaccccgccggcctgagaaccctgctgcccgtgttcctgagagccagaaagctgggcctgcagctgaacagcctgggccccgaggcctgcaaggacctgagagacctgctgctgcacgaccagtgccagatcaccaccctgagactgagcaacaaccccctgaccgccgccggcgtggccgtgctgatggagggcctggccggcaacaccagcgtgacccacctgagcctgctgcacaccggcctgggcgacgagggcctggagctgctggccgcccagctggacagaaacagacagctgcaggagctgaacgtggcctacaacggcgccggcgacaccgccgccctggccctggccagagccgccagagagcaccccagcctggagctgctgcagggcgtggccatccagatgtgctggaagctgcccctgctgccctacgcccacctgtggacccccagaatgcccagccactggtgcttcctgctgatcctgatgccccccctgccccagtggtacgacggcctggtggcccccagaggcagatgcacctag

SEQ ID NO: 91219 - DNA, 2928 bp, Artificial Sequence; identical to SEQ ID NO: 91215
  Description of Artificial Sequence: Synthetic coding sequence

SEQ ID NO: 91220 - DNA, 2766 bp, Artificial Sequence; identical to SEQ ID NO: 91218
  Description of Artificial Sequence: Synthetic coding sequence

SEQ ID NO: 91221 - DNA, 3111 bp, Artificial Sequence
  Description of Artificial Sequence: Synthetic coding sequence
atgaagatggccagcaccagatgcaagctggccagatacctggaggacctggaggacgtggacctgaagaagttcaagatgcacctggaggactaccccccccagaagggctgcatccccctgcccagaggccagaccgagaaggccgaccacgtggacctggccaccctgatgatcgacttcaacggcgaggagaaggcctgggccatggccgtgtggatcttcgccgccatcaacagaagagacctgtacgagaaggccaagagagacgagcccaagtggggcagcgacaacgccagagtgagcaaccccaccgtgatctgccaggaggacagcatcgaggaggagtggatgggcctgctggagtacctgagcagaatcagcatctgcaagatgaagaaggactacagaaagaagtacagaaagtacgtgagaagcagattccagtgcatcgaggacagaaacgccagactgggcgagagcgtgagcctgaacaagagatacaccagactgagactgatcaaggagcacagaagccagcaggagagagagcaggagctgctggccatcggcaagaccaagacctgcgagagccccgtgagccccatcaagatggagctgctgttcgaccccgacgacgagcacagcgagcccgtgcacaccgtggtgttccagggcgccgccggcatcggcaagaccatcctggccagaaagatgatgctggactgggccagcggcaccctgtaccaggacagattcgactacctgttctacatccactgcagagaggtgagcctggtgacccagagaagcctgggcgacctgatcatgagctgctgccccgaccccaacccccccatccacaagatcgtgagaaagcccagcagaatcctgttcctgatggacggcttcgacgagctgcagggcgccttcgacgagcacatcggccccctgtgcaccgactggcagaaggccgagagaggcgacatcctgctgagcagcctgatcagaaagaagctgctgcccgaggccagcctgctgatcaccaccagacccgtggccctggagaagctgcagcacctgctggaccaccccagacacgtggagatcctgggcttcagcgaggccaagagaaaggagtacttcttcaagtacttcagcgacgaggcccaggccagagccgccttcagcctgatccaggagaacgaggtgctgttcaccatgtgcttcatccccctggtgtgctggatcgtgtgcaccggcctgaagcagcagatggagagcggcaagagcctggcccagaccagcaagaccaccaccgccgtgtacgtgttcttcctgagcagcctgctgcagcccagaggcggcagccaggagcacggcctgtgcgcccacctgtggggcctgtgcagcctggccgccgacggcatctggaaccagaagatcctgttcgaggagagcgacctgagaaaccacggcctgcagaaggccgacgtgagcgccttcctgagaatgaacctgttccagaaggaggtggactgcgagaagttctacagcttcatccacatgaccttccaggagttcttcgccgccatgtactacctgctggaggaggagaaggagggcagaaccaacgtgcccggcagcagactgaagctgcccagcagagacgtgaccgtgctgctggagaactacggcaagttcgagaagggctacctgatcttcgtggtgagattcctgttcggcctggtgaaccaggagagaaccagctacctggagaagaagctgagctgcaagatcagccagcagatcagactggagctgctgaagtggatcgaggtgaaggccaaggccaagaagctgcagatccagcccagccagctggagctgttctactgcctgtacgagatgcaggaggaggacttcgtgcagagagccatggactacttccccaagatcgagatcaacctgagcaccagaatggaccacatggtgagcagcttctgcatcgagaactgccacagagtggagagcctgagcctgggcttcctgcacaacatgcccaaggaggaggaggaggaggagaaggagggcagacacctggacatggtgcagtgcgtgctgcccagcagcagccacgccgcctgcagccacggcctggtgaacagccacctgaccagcagcttctgcagaggcctgttcagcgtgctgagcaccagccagagcctgaccgagctggacctgagcgacaacagcctgggcgaccccggcatgagagtgctgtgcgagaccctgcagcaccccggctgcaacatcagaagactgtggctgggcagatgcggcctgagccacgagtgctgcttcgacatcagcctggtgctgagcagcaaccagaagctggtggagctggacctgagcgacaacgccctgggcgacttcggcatcagactgctgtgcgtgggcctgaagcacctgctgtgcaacctgaagaagctgtggctggtgagctgctgcctgaccagcgcctgctgccaggacctggccagcgtgctgagcaccagccacagcctgaccagactgtacgtgggcgagaacgccctgggcgacagcggcgtggccatcctgtgcgagaaggccaagaacccccagtgcaacctgcagaagctgggcctggtgaacagcggcctgaccagcgtgtgctgcagcgccctgagcagcgtgctgagcaccaaccagaacctgacccacctgtacctgagaggcaacaccctgggcgacaagggcatcaagctgctgtgcgagggcctgctgcaccccgactgcaagctgcaggtgctggagctggacaactgcaacctgaccagccactgctgctgggacctgagcaccctgctgaccagcagccagagcctgagaaagctgagcctgggcaacaacgacctgggcgacctgggcgtgatgatgttctgcgaggtgctgaagcagcagagctgcctgctgcagaacctgggcctgagcgagatgtacttcaactacgagaccaagagcgccctggagaccctgcaggaggagaagcccgagctgaccgtggtgttcgagcccagctggtag

SEQ ID NO: 91222 - DNA, 2769 bp, Artificial Sequence
  Description of Artificial Sequence: Synthetic coding sequence
atgaagatggccagcaccagatgcaagctggccagatacctggaggacctggaggacgtggacctgaagaagttcaagatgcacctggaggactaccccccccagaagggctgcatccccctgcccagaggccagaccgagaaggccgaccacgtggacctggccaccctgatgatcgacttcaacggcgaggagaaggcctgggccatggccgtgtggatcttcgccgccatcaacagaagagacctgtacgagaaggccaagagagacgagcccaagtggggcagcgacaacgccagagtgagcaaccccaccgtgatctgccaggaggacagcatcgaggaggagtggatgggcctgctggagtacctgagcagaatcagcatctgcaagatgaagaaggactacagaaagaagtacagaaagtacgtgagaagcagattccagtgcatcgaggacagaaacgccagactgggcgagagcgtgagcctgaacaagagatacaccagactgagactgatcaaggagcacagaagccagcaggagagagagcaggagctgctggccatcggcaagaccaagacctgcgagagccccgtgagccccatcaagatggagctgctgttcgaccccgacgacgagcacagcgagcccgtgcacaccgtggtgttccagggcgccgccggcatcggcaagaccatcctggccagaaagatgatgctggactgggccagcggcaccctgtaccaggacagattcgactacctgttctacatccactgcagagaggtgagcctggtgacccagagaagcctgggcgacctgatcatgagctgctgccccgaccccaacccccccatccacaagatcgtgagaaagcccagcagaatcctgttcctgatggacggcttcgacgagctgcagggcgccttcgacgagcacatcggccccctgtgcaccgactggcagaaggccgagagaggcgacatcctgctgagcagcctgatcagaaagaagctgctgcccgaggccagcctgctgatcaccaccagacccgtggccctggagaagctgcagcacctgctggaccaccccagacacgtggagatcctgggcttcagcgaggccaagagaaaggagtacttcttcaagtacttcagcgacgaggcccaggccagagccgccttcagcctgatccaggagaacgaggtgctgttcaccatgtgcttcatccccctggtgtgctggatcgtgtgcaccggcctgaagcagcagatggagagcggcaagagcctggcccagaccagcaagaccaccaccgccgtgtacgtgttcttcctgagcagcctgctgcagcccagaggcggcagccaggagcacggcctgtgcgcccacctgtggggcctgtgcagcctggccgccgacggcatctggaaccagaagatcctgttcgaggagagcgacctgagaaaccacggcctgcagaaggccgacgtgagcgccttcctgagaatgaacctgttccagaaggaggtggactgcgagaagttctacagcttcatccacatgaccttccaggagttcttcgccgccatgtactacctgctggaggaggagaaggagggcagaaccaacgtgcccggcagcagactgaagctgcccagcagagacgtgaccgtgctgctggagaactacggcaagttcgagaagggctacctgatcttcgtggtgagattcctgttcggcctggtgaaccaggagagaaccagctacctggagaagaagctgagctgcaagatcagccagcagatcagactggagctgctgaagtggatcgaggtgaaggccaaggccaagaagctgcagatccagcccagccagctggagctgttctactgcctgtacgagatgcaggaggaggacttcgtgcagagagccatggactacttccccaagatcgagatcaacctgagcaccagaatggaccacatggtgagcagcttctgcatcgagaactgccacagagtggagagcctgagcctgggcttcctgcacaacatgcccaaggaggaggaggaggaggagaaggagggcagacacctggacatggtgcagtgcgtgctgcccagcagcagccacgccgcctgcagccacggcctgggcagatgcggcctgagccacgagtgctgcttcgacatcagcctggtgctgagcagcaaccagaagctggtggagctggacctgagcgacaacgccctgggcgacttcggcatcagactgctgtgcgtgggcctgaagcacctgctgtgcaacctgaagaagctgtggctggtgaacagcggcctgaccagcgtgtgctgcagcgccctgagcagcgtgctgagcaccaaccagaacctgacccacctgtacctgagaggcaacaccctgggcgacaagggcatcaagctgctgtgcgagggcctgctgcaccccgactgcaagctgcaggtgctggagctggacaactgcaacctgaccagccactgctgctgggacctgagcaccctgctgaccagcagccagagcctgagaaagctgagcctgggcaacaacgacctgggcgacctgggcgtgatgatgttctgcgaggtgctgaagcagcagagctgcctgctgcagaacctgggcctgagcgagatgtacttcaactacgagaccaagagcgccctggagaccctgcaggaggagaagcccgagctgaccgtggtgttcgagcccagctggtag

SEQ ID NO: 91223 - DNA, 2940 bp, Artificial Sequence
  Description of Artificial Sequence: Synthetic coding sequence
atgaagatggccagcaccagatgcaagctggccagatacctggaggacctggaggacgtggacctgaagaagttcaagatgcacctggaggactaccccccccagaagggctgcatccccctgcccagaggccagaccgagaaggccgaccacgtggacctggccaccctgatgatcgacttcaacggcgaggagaaggcctgggccatggccgtgtggatcttcgccgccatcaacagaagagacctgtacgagaaggccaagagagacgagcccaagtggggcagcgacaacgccagagtgagcaaccccaccgtgatctgccaggaggacagcatcgaggaggagtggatgggcctgctggagtacctgagcagaatcagcatctgcaagatgaagaaggactacagaaagaagtacagaaagtacgtgagaagcagattccagtgcatcgaggacagaaacgccagactgggcgagagcgtgagcctgaacaagagatacaccagactgagactgatcaaggagcacagaagccagcaggagagagagcaggagctgctggccatcggcaagaccaagacctgcgagagccccgtgagccccatcaagatggagctgctgttcgaccccgacgacgagcacagcgagcccgtgcacaccgtggtgttccagggcgccgccggcatcggcaagaccatcctggccagaaagatgatgctggactgggccagcggcaccctgtaccaggacagattcgactacctgttctacatccactgcagagaggtgagcctggtgacccagagaagcctgggcgacctgatcatgagctgctgccccgaccccaacccccccatccacaagatcgtgagaaagcccagcagaatcctgttcctgatggacggcttcgacgagctgcagggcgccttcgacgagcacatcggccccctgtgcaccgactggcagaaggccgagagaggcgacatcctgctgagcagcctgatcagaaagaagctgctgcccgaggccagcctgctgatcaccaccagacccgtggccctggagaagctgcagcacctgctggaccaccccagacacgtggagatcctgggcttcagcgaggccaagagaaaggagtacttcttcaagtacttcagcgacgaggcccaggccagagccgccttcagcctgatccaggagaacgaggtgctgttcaccatgtgcttcatccccctggtgtgctggatcgtgtgcaccggcctgaagcagcagatggagagcggcaagagcctggcccagaccagcaagaccaccaccgccgtgtacgtgttcttcctgagcagcctgctgcagcccagaggcggcagccaggagcacggcctgtgcgcccacctgtggggcctgtgcagcctggccgccgacggcatctggaaccagaagatcctgttcgaggagagcgacctgagaaaccacggcctgcagaaggccgacgtgagcgccttcctgagaatgaacctgttccagaaggaggtggactgcgagaagttctacagcttcatccacatgaccttccaggagttcttcgccgccatgtactacctgctggaggaggagaaggagggcagaaccaacgtgcccggcagcagactgaagctgcccagcagagacgtgaccgtgctgctggagaactacggcaagttcgagaagggctacctgatcttcgtggtgagattcctgttcggcctggtgaaccaggagagaaccagctacctggagaagaagctgagctgcaagatcagccagcagatcagactggagctgctgaagtggatcgaggtgaaggccaaggccaagaagctgcagatccagcccagccagctggagctgttctactgcctgtacgagatgcaggaggaggacttcgtgcagagagccatggactacttccccaagatcgagatcaacctgagcaccagaatggaccacatggtgagcagcttctgcatcgagaactgccacagagtggagagcctgagcctgggcttcctgcacaacatgcccaaggaggaggaggaggaggagaaggagggcagacacctggacatggtgcagtgcgtgctgcccagcagcagccacgccgcctgcagccacggcctggtgaacagccacctgaccagcagcttctgcagaggcctgttcagcgtgctgagcaccagccagagcctgaccgagctggacctgagcgacaacagcctgggcgaccccggcatgagagtgctgtgcgagaccctgcagcaccccggctgcaacatcagaagactgtggctgggcagatgcggcctgagccacgagtgctgcttcgacatcagcctggtgctgagcagcaaccagaagctggtggagctggacctgagcgacaacgccctgggcgacttcggcatcagactgctgtgcgtgggcctgaagcacctgctgtgcaacctgaagaagctgtggctggtgaacagcggcctgaccagcgtgtgctgcagcgccctgagcagcgtgctgagcaccaaccagaacctgacccacctgtacctgagaggcaacaccctgggcgacaagggcatcaagctgctgtgcgagggcctgctgcaccccgactgcaagctgcaggtgctggagctggacaactgcaacctgaccagccactgctgctgggacctgagcaccctgctgaccagcagccagagcctgagaaagctgagcctgggcaacaacgacctgggcgacctgggcgtgatgatgttctgcgaggtgctgaagcagcagagctgcctgctgcagaacctgggcctgagcgagatgtacttcaactacgagaccaagagcgccctggagaccctgcaggaggagaagcccgagctgaccgtggtgttcgagcccagctggtag

SEQ ID NO: 91224 - DNA, 2940 bp, Artificial Sequence; identical to SEQ ID NO: 91223
  Description of Artificial Sequence: Synthetic coding sequence

SEQ ID NO: 91225 - DNA, 2940 bp, Artificial Sequence
  Description of Artificial Sequence: Synthetic coding sequence
atgaagatggccagcaccagatgcaagctggccagatacctggaggacctggaggacgtggacctgaagaagttcaagatgcacctggaggactaccccccccagaagggctgcatccccctgcccagaggccagaccgagaaggccgaccacgtggacctggccaccctgatgatcgacttcaacggcgaggagaaggcctgggccatggccgtgtggatcttcgccgccatcaacagaagagacctgtacgagaaggccaagagagacgagcccaagtggggcagcgacaacgccagagtgagcaaccccaccgtgatctgccaggaggacagcatcgaggaggagtggatgggcctgctggagtacctgagcagaatcagcatctgcaagatgaagaaggactacagaaagaagtacagaaagtacgtgagaagcagattccagtgcatcgaggacagaaacgccagactgggcgagagcgtgagcctgaacaagagatacaccagactgagactgatcaaggagcacagaagccagcaggagagagagcaggagctgctggccatcggcaagaccaagacctgcgagagccccgtgagccccatcaagatggagctgctgttcgaccccgacgacgagcacagcgagcccgtgcacaccgtggtgttccagggcgccgccggcatcggcaagaccatcctggccagaaagatgatgctggactgggccagcggcaccctgtaccaggacagattcgactacctgttctacatccactgcagagaggtgagcctggtgacccagagaagcctgggcgacctgatcatgagctgctgccccgaccccaacccccccatccacaagatcgtgagaaagcccagcagaatcctgttcctgatggacggcttcgacgagctgcagggcgccttcgacgagcacatcggccccctgtgcaccgactggcagaaggccgagagaggcgacatcctgctgagcagcctgatcagaaagaagctgctgcccgaggccagcctgctgatcaccaccagacccgtggccctggagaagctgcagcacctgctggaccaccccagacacgtggagatcctgggcttcagcgaggccaagagaaaggagtacttcttcaagtacttcagcgacgaggcccaggccagagccgccttcagcctgatccaggagaacgaggtgctgttcaccatgtgcttcatccccctggtgtgctggatcgtgtgcaccggcctgaagcagcagatggagagcggcaagagcctggcccagaccagcaagaccaccaccgccgtgtacgtgttcttcctgagcagcctgctgcagcccagaggcggcagccaggagcacggcctgtgcgcccacctgtggggcctgtgcagcctggccgccgacggcatctggaaccagaagatcctgttcgaggagagcgacctgagaaaccacggcctgcagaaggccgacgtgagcgccttcctgagaatgaacctgttccagaaggaggtggactgcgagaagttctacagcttcatccacatgaccttccaggagttcttcgccgccatgtactacctgctggaggaggagaaggagggcagaaccaacgtgcccggcagcagactgaagctgcccagcagagacgtgaccgtgctgctggagaactacggcaagttcgagaagggctacctgatcttcgtggtgagattcctgttcggcctggtgaaccaggagagaaccagctacctggagaagaagctgagctgcaagatcagccagcagatcagactggagctgctgaagtggatcgaggtgaaggccaaggccaagaagctgcagatccagcccagccagctggagctgttctactgcctgtacgagatgcaggaggaggacttcgtgcagagagccatggactacttccccaagatcgagatcaacctgagcaccagaatggaccacatggtgagcagcttctgcatcgagaactgccacagagtggagagcctgagcctgggcttcctgcacaacatgcccaaggaggaggaggaggaggagaaggagggcagacacctggacatggtgcagtgcgtgctgcccagcagcagccacgccgcctgcagccacggcctgggcagatgcggcctgagccacgagtgctgcttcgacatcagcctggtgctgagcagcaaccagaagctggtggagctggacctgagcgacaacgccctgggcgacttcggcatcagactgctgtgcgtgggcctgaagcacctgctgtgcaacctgaagaagctgtggctggtgagctgctgcctgaccagcgcctgctgccaggacctggccagcgtgctgagcaccagccacagcctgaccagactgtacgtgggcgagaacgccctgggcgacagcggcgtggccatcctgtgcgagaaggccaagaacccccagtgcaacctgcagaagctgggcctggtgaacagcggcctgaccagcgtgtgctgcagcgccctgagcagcgtgctgagcaccaaccagaacctgacccacctgtacctgagaggcaacaccctgggcgacaagggcatcaagctgctgtgcgagggcctgctgcaccccgactgcaagctgcaggtgctggagctggacaactgcaacctgaccagccactgctgctgggacctgagcaccctgctgaccagcagccagagcctgagaaagctgagcctgggcaacaacgacctgggcgacctgggcgtgatgatgttctgcgaggtgctgaagcagcagagctgcctgctgcagaacctgggcctgagcgagatgtacttcaactacgagaccaagagcgccctggagaccctgcaggaggagaagcccgagctgaccgtggtgttcgagcccagctggtag

SEQ ID NO: 91226 - DNA, 3111 bp, Artificial Sequence; identical to SEQ ID NO: 91221
  Description of Artificial Sequence: Synthetic coding sequence

SEQ ID NO: 91227 - DNA, 1512 bp, Artificial Sequence
  Description of Artificial Sequence: Synthetic coding sequence
atggagtacatggccgagagcaccgacagaagccccggccacatcctgtgctgcgagtgcggcgtgcccatcagccccaaccccgccaacatctgcgtggcctgcctgagaagcaaggtggacatcagccagggcatccccaagcaggtgagcatcagcttctgcaagcagtgccagagatacttccagccccccggcacctggatccagtgcgccctggagagcagagagctgctggccctgtgcctgaagaagatcaaggcccccctgagcaaggtgagactggtggacgccggcttcgtgtggaccgagccccacagcaagagactgaaggtgaagctgaccatccagaaggaggtgatgaacggcgccatcctgcagcaggtgttcgtggtggactacgtggtgcagagccagatgtgcggcgactgccacagagtggaggccaaggacttctggaaggccgtgatccaggtgagacagaagaccctgcacaagaagaccttctactacctggagcagctgatcctgaagtacggcatgcaccagaacaccctgagaatcaaggagatccacgacggcctggacttctactacagcagcaagcagcacgcccagaagatggtggagttcctgcagtgcaccgtgccctgcagatacaaggccagccagagactgatcagccaggacatccacagcaacacctacaactacaagagcaccttcagcgtggagatcgtgcccatctgcaaggacaacgtggtgtgcctgagccccaagctggcccagagcctgggcaacatgaaccagatctgcgtgtgcatcagagtgaccagcgccatccacctgatcgaccccaacaccctgcaggtggccgacatcgacggcagcaccttctggagccaccccttcaacagcctgtgccaccccaagcagctggaggagttcatcgtgatggagtgcagcatcgtgcaggacatcaagagagccgccggcgccggcatgatcagcaagaagcacaccctgggcgaggtgtgggtgcagaagaccagcgagatgaacaccgacaagcagtacttctgcagaacccacctgggccacctgctgaaccccggcgacctggtgctgggcttcgacctggccaactgcaacctgaacgacgagcacgtgaacaagatgaacagcgacagagtgcccgacgtggtgctgatcaagaagagctacgacagaaccaagagacagagaagaagaaactggaagctgaaggagctggccagagagagagagaacatggacaccgacgacgagagacagtaccaggacttcctggaggacctggaggaggacgaggccatcagaaagaacgtgaacatctacagagacagcgccatccccgtggagagcgacaccgacgacgagggcgcccccagaatcagcctggccgagatgctggaggacctgcacatcagccaggacgccaccggcgaggagggcgccagcatgctgacctag

SEQ ID NO: 91228 - DNA, 1512 bp, Artificial Sequence; identical to SEQ ID NO: 91227
  Description of Artificial Sequence: Synthetic coding sequence

SEQ ID NO: 91229 - DNA, 471 bp, Artificial Sequence
  Description of Artificial Sequence: Synthetic coding sequence
atggagtacatggccgagagcaccgacagaagccccggccacatcctgtgctgcgagtgcggcgtgcccatcagccccaaccccgccaacatctgcgtggcctgcctgagaagcaaggtggacatcagccagggcatccccaagcaggtgagcatcagcttctgcaagcagtgccagagatacttccagccccccggcacctggatccagtgcgccctggagagcagagagctgctggccctgtgcctgaagaagatcaaggcccccctgagcaaggtgagactggtggacgccggcttcgtgtggaccgagccccacagcaagagactgaaggtgaagctgaccatccagaaggaggtgatgaacggcgccatcctgcagcaggtgttcgtggtggactacgtggtgcagagccagatgtgcggcgactgccacagagtggaggccaaggacttctggaaggccgtgtag

SEQ ID NO: 91230 - DNA, 657 bp, Artificial Sequence
  Description of Artificial Sequence: Synthetic coding sequence
atggagtacatggccgagagcaccgacagaagccccggccacatcctgtgctgcgagtgcggcgtgcccatcagccccaaccccgccaacatctgcgtggcctgcctgagaagcaaggtggacatcagccagggcatccccaagcaggtgagcatcagcttctgcaagcagtgccagagatacttccagccccccggcacctggatccagtgcgccctggagagcagagagctgctggccctgtgcctgaagaagatcaaggcccccctgagcaaggtgagactggtggacgccggcttcgtgtggaccgagccccacagcaagagactgaaggtgaagctgaccatccagaaggaggtgatgaacggcgccatcctgcagcaggtgttcgtggtggactacgtggtgcagagccagatgtgcggcgactgccacagagtggaggccaaggacttctggaaggccgtgatccaggtgagacagaagaccctgcacaagaagaccttctactacctggagcagctgatcctgaagtacggcatgcaccagaacaccctgagaatcaaggagatccacgacggcctggacttctactacagcagcaagcagcacgcccagaagatggtggagttcctgcagtgcaccgtgccctgctag

SEQ ID NO: 91231 - DNA, 297 bp, Artificial Sequence
  Description of Artificial Sequence: Synthetic coding sequence
atggagtacatggccgagagcaccgacagaagccccggccacatcctgtgctgcgagtgcggcgtgcccatcagccccaaccccgccaacatctgcgtggcctgcctgagaagcaaggtggacatcagccagggcatccccaagcaggtgagcatcagcttctgcaagcagtgccagagatacttccagccccccggcacctggatccagtgcgccctggagagcagagagctgctggccctgtgcctgaagaagatcaaggcccccctgagcaaggtgagactggtggacgcctag

SEQ ID NO: 91232 - DNA, 489 bp, Artificial Sequence
  Description of Artificial Sequence: Synthetic coding sequence
atggagtacatggccgagagcaccgacagaagccccggccacatcctgtgctgcgagtgcggcgtgcccatcagccccaaccccgccaacatctgcgtggcctgcctgagaagcaaggtggacatcagccagggcatccccaagcaggtgagcatcagcttctgcaagcagtgccagagatacttccagccccccggcacctggatccagtgcgccctggagagcagagagctgctggccctgtgcctgaagaagatcaaggcccccctgagcaaggtgagactggtggacgccggcttcgtgtggaccgagccccacagcaagagactgaaggtgaagctgaccatccagaaggaggtgatgaacggcgccatcctgcagcaggtgttcgtggtggactacgtggtgcagagccagatgtgcggcgactgccacagagtggaggccaaggacttctggaaggccgtgatccaggtgagacagaagtag

SEQ ID NO: 91233 - DNA, 657 bp, Artificial Sequence; identical to SEQ ID NO: 91230
  Description of Artificial Sequence: Synthetic coding sequence

SEQ ID NO: 91234 - DNA, 1152 bp, Artificial Sequence
  Description of Artificial Sequence: Synthetic coding sequence
atgaacggcgccatcctgcagcaggtgttcgtggtggactacgtggtgcagagccagatgtgcggcgactgccacagagtggaggccaaggacttctggaaggccgtgatccaggtgagacagaagaccctgcacaagaagaccttctactacctggagcagctgatcctgaagtacggcatgcaccagaacaccctgagaatcaaggagatccacgacggcctggacttctactacagcagcaagcagcacgcccagaagatggtggagttcctgcagtgcaccgtgccctgcagatacaaggccagccagagactgatcagccaggacatccacagcaacacctacaactacaagagcaccttcagcgtggagatcgtgcccatctgcaaggacaacgtggtgtgcctgagccccaagctggcccagagcctgggcaacatgaaccagatctgcgtgtgcatcagagtgaccagcgccatccacctgatcgaccccaacaccctgcaggtggccgacatcgacggcagcaccttctggagccaccccttcaacagcctgtgccaccccaagcagctggaggagttcatcgtgatggagtgcagcatcgtgcaggacatcaagagagccgccggcgccggcatgatcagcaagaagcacaccctgggcgaggtgtgggtgcagaagaccagcgagatgaacaccgacaagcagtacttctgcagaacccacctgggccacctgctgaaccccggcgacctggtgctgggcttcgacctggccaactgcaacctgaacgacgagcacgtgaacaagatgaacagcgacagagtgcccgacgtggtgctgatcaagaagagctacgacagaaccaagagacagagaagaagaaactggaagctgaaggagctggccagagagagagagaacatggacaccgacgacgagagacagtaccaggacttcctggaggacctggaggaggacgaggccatcagaaagaacgtgaacatctacagagacagcgccatccccgtggagagcgacaccgacgacgagggcgcccccagaatcagcctggccgagatgctggaggacctgcacatcagccaggacgccaccggcgaggagggcgccagcatgctgacctag

SEQ ID NO: 91235 - DNA, 2949 bp, Artificial Sequence
  Description of Artificial Sequence: Synthetic coding sequence
atgagcagcaagatggtgatcagcgagcccggcctgaactgggacatcagccccaagaacggcctgaagaccttcttcagcagagagaactacaaggaccacagcatggcccccagcctgaaggagctgagagtgctgagcaacagaagaatcggcgagaacctgaacgccagcgccagcagcgtggagaacgagcccgccgtgagcagcgccacccaggccaaggagaaggtgaagaccaccatcggcatggtgctgctgcccaagcccagagtgccctaccccagattcagcagattcagccagagagagcagagaagctacgtggacctgctggtgaagtacgccaagatccccgccaacagcaaggccgtgggcatcaacaagaacgactacctgcagtacctggacatgaagaagcacgtgaacgaggaggtgaccgagttcctgaagttcctgcagaacagcgccaagaagtgcgcccaggactacaacatgctgagcgacgacgccagactgttcaccgagaagatcctgagagcctgcatcgagcaggtgaagaagtacagcgagttctacaccctgcacgaggtgaccagcctgatgggcttcttccccttcagagtggagatgggcctgaagctggagaagaccctgctggccctgggcagcgtgaagtacgtgaagaccgtgttccccagcatgcccatcaagctgcagctgagcaaggacgacatcgccaccatcgagaccagcgagcagaccgccgaggccatgcactacgacatcagcaaggaccccaacgccgagaagctggtgagcagataccacccccagatcgccctgaccagccagagcctgttcaccctgctgaacaaccacggccccacctacaaggagcagtgggagatccccgtgtgcatccaggtgatccccgtggccggcagcaagcccgtgaaggtgatctacatcaacagccccctgccccagaagaagatgaccatgagagagagaaaccagatcttccacgaggtgcccctgaagttcatgatgagcaagaacaccagcgtgcccgtgagcgccgtgttcatggacaagcccgaggagttcatcagcgagatggacatgagctgcgaggtgaacgagtgcagaaagatcgagagcctggagaacctgtacctggacttcgacgacgacgtgaccgagctggagaccttcggcgtgaccaccaccaaggtgagcaagagccccagccccgccagcaccagcaccgtgcccaacatgaccgacgcccccaccgcccccaaggccggcaccaccaccgtggcccccagcgcccccgacatcagcgccaacagcagaagcctgagccagatcctgatggagcagctgcagaaggagaagcagctggtgaccggcatggacggcggccccgaggagtgcaagaacaaggacgaccagggcttcgagagctgcgagaaggtgagcaacagcgacaagcccctgatccaggacagcgacctgaagaccagcgacgccctgcagctggagaacagccaggagatcgagaccagcaacaagaacgacatgaccatcgacatcctgcacgccgacggcgagagacccaacgtgctggagaacctggacaacagcaaggagaagaccgtgggcagcgaggccgccaagaccgaggacaccgtgctgtgcagcagcgacaccgacgaggagtgcctgatcatcgacaccgagtgcaagaacaacagcgacggcaagaccgccgtggtgggcagcaacctgagcagcagacccgccagccccaacagcagcagcggccaggccagcgtgggcaaccagaccaacaccgcctgcagccccgaggagagctgcgtgctgaagaagcccatcaagagagtgtacaagaagttcgaccccgtgggcgagatcctgaagatgcaggacgagctgctgaagcccatcagcagaaaggtgcccgagctgcccctgatgaacctggagaacagcaagcagcccagcgtgagcgagcagctgagcggccccagcgacagcagcagctggcccaagagcggctggcccagcgccttccagaagcccaagggcagactgccctacgagctgcaggactacgtggaggacaccagcgagtacctggccccccaggagggcaacttcgtgtacaagctgttcagcctgcaggacctgctgctgctggtgagatgcagcgtgcagagaatcgagaccagacccagaagcaagaagagaaagaagatcagaagacagttccccgtgtacgtgctgcccaaggtggagtaccaggcctgctacggcgtggaggccctgaccgagagcgagctgtgcagactgtggaccgagagcctgctgcacagcaacagcagcttctacgtgggccacatcgacgccttcaccagcaagctgttcctgctggaggagatcaccagcgaggagctgaaggagaagctgagcgccctgaagatcagcaacctgttcaacatcctgcagcacatcctgaagaagctgagcagcctgcaggagggcagctacctgctgagccacgccgccgaggacagcagcctgctgatctacaaggccagcgacggcaaggtgaccagaaccgcctacaacctgtacaagacccactgcggcctgcccggcgtgcccagcagcctgagcgtgccctgggtgcccctggaccccagcctgctgctgccctaccacatccaccacggcagaatcccctgcaccttcccccccaagagcctggacaccaccacccagcagaagatcggcggcaccagaatgcccaccagaagccacagaaaccccgtgagcatggagaccaagagcagctgcctgcccgcccagcaggtggagaccgagggcgtggccccccacaagagaaagatcacctag

SEQ ID NO: 91236 - DNA, 2538 bp, Artificial Sequence
  Description of Artificial Sequence: Synthetic coding sequence
atgaagaagcacgtgaacgaggaggtgaccgagttcctgaagttcctgcagaacagcgccaagaagtgcgcccaggactacaacatgctgagcgacgacgccagactgttcaccgagaagatcctgagagcctgcatcgagcaggtgaagaagtacagcgagttctacaccctgcacgaggtgaccagcctgatgggcttcttccccttcagagtggagatgggcctgaagctggagaagaccctgctggccctgggcagcgtgaagtacgtgaagaccgtgttccccagcatgcccatcaagctgcagctgagcaaggacgacatcgccaccatcgagaccagcgagcagaccgccgaggccatgcactacgacatcagcaaggaccccaacgccgagaagctggtgagcagataccacccccagatcgccctgaccagccagagcctgttcaccctgctgaacaaccacggccccacctacaaggagcagtgggagatccccgtgtgcatccaggtgatccccgtggccggcagcaagcccgtgaaggtgatctacatcaacagccccctgccccagaagaagatgaccatgagagagagaaaccagatcttccacgaggtgcccctgaagttcatgatgagcaagaacaccagcgtgcccgtgagcgccgtgttcatggacaagcccgaggagttcatcagcgagatggacatgagctgcgaggtgaacgagtgcagaaagatcgagagcctggagaacctgtacctggacttcgacgacgacgtgaccgagctggagaccttcggcgtgaccaccaccaaggtgagcaagagccccagccccgccagcaccagcaccgtgcccaacatgaccgacgcccccaccgcccccaaggccggcaccaccaccgtggcccccagcgcccccgacatcagcgccaacagcagaagcctgagccagatcctgatggagcagctgcagaaggagaagcagctggtgaccggcatggacggcggccccgaggagtgcaagaacaaggacgaccagggcttcgagagctgcgagaaggtgagcaacagcgacaagcccctgatccaggacagcgacctgaagaccagcgacgccctgcagctggagaacagccaggagatcgagaccagcaacaagaacgacatgaccatcgacatcctgcacgccgacggcgagagacccaacgtgctggagaacctggacaacagcaaggagaagaccgtgggcagcgaggccgccaagaccgaggacaccgtgctgtgcagcagcgacaccgacgaggagtgcctgatcatcgacaccgagtgcaagaacaacagcgacggcaagaccgccgtggtgggcagcaacctgagcagcagacccgccagccccaacagcagcagcggccaggccagcgtgggcaaccagaccaacaccgcctgcagccccgaggagagctgcgtgctgaagaagcccatcaagagagtgtacaagaagttcgaccccgtgggcgagatcctgaagatgcaggacgagctgctgaagcccatcagcagaaaggtgcccgagctgcccctgatgaacctggagaacagcaagcagcccagcgtgagcgagcagctgagcggccccagcgacagcagcagctggcccaagagcggctggcccagcgccttccagaagcccaagggcagactgccctacgagctgcaggactacgtggaggacaccagcgagtacctggccccccaggagggcaacttcgtgtacaagctgttcagcctgcaggacctgctgctgctggtgagatgcagcgtgcagagaatcgagaccagacccagaagcaagaagagaaagaagatcagaagacagttccccgtgtacgtgctgcccaaggtggagtaccaggcctgctacggcgtggaggccctgaccgagagcgagctgtgcagactgtggaccgagagcctgctgcacagcaacagcagcttctacgtgggccacatcgacgccttcaccagcaagctgttcctgctggaggagatcaccagcgaggagctgaaggagaagctgagcgccctgaagatcagcaacctgttcaacatcctgcagcacatcctgaagaagctgagcagcctgcaggagggcagctacctgctgagccacgccgccgaggacagcagcctgctgatctacaaggccagcgacggcaaggtgaccagaaccgcctacaacctgtacaagacccactgcggcctgcccggcgtgcccagcagcctgagcgtgccctgggtgcccctggaccccagcctgctgctgccctaccacatccaccacggcagaatcccctgcaccttcccccccaagagcctggacaccaccacccagcagaagatcggcggcaccagaatgcccaccagaagccacagaaaccccgtgagcatggagaccaagagcagctgcctgcccgcccagcaggtggagaccgagggcgtggccccccacaagagaaagatcacctag

SEQ ID NO: 91237 - DNA, 1017 bp, Artificial Sequence
  Description of Artificial Sequence: Synthetic coding sequence
atgagcagcaagatggtgatcagcgagcccggcctgaactgggacatcagccccaagaacggcctgaagaccttcttcagcagagagaactacaaggaccacagcatggcccccagcctgaaggagctgagagtgctgagcaacagaagaatcggcgagaacctgaacgccagcgccagcagcgtggagaacgagcccgccgtgagcagcgccacccaggccaaggagaaggtgaagaccaccatcggcatggtgctgctgcccaagcccagagtgccctaccccagattcagcagattcagccagagagagcagagaagctacgtggacctgctggtgaagtacgccaagatccccgccaacagcaaggccgtgggcatcaacaagaacgactacctgcagtacctggacatgaagaagcacgtgaacgaggaggtgaccgagttcctgaagttcctgcagaacagcgccaagaagtgcgcccaggactacaacatgctgagcgacgacgccagactgttcaccgagaagatcctgagagcctgcatcgagcaggtgaagaagtacagcgagttctacaccctgcacgaggtgaccagcctgatgggcttcttccccttcagagtggagatgggcctgaagctggagaagaccctgctggccctgggcagcgtgaagtacgtgaagaccgtgttccccagcatgcccatcaagctgcagctgagcaaggacgacatcgccaccatcgagaccagcgagcagaccgccgaggccatgcactacgacatcagcaaggaccccaacgccgagaagctggtgagcagataccacccccagatcgccctgaccagccagagcctgttcaccctgctgaacaaccacggccccacctacaaggagcagtgggagatccccgtgtgcatccaggtgatccccgtggccggcagcaagcccgtgaaggtgatctacatcaacagccccctgccccagaagaagatgaccatgagagagagatag

SEQ ID NO: 91238 - DNA, 438 bp, Artificial Sequence
  Description of Artificial Sequence: Synthetic coding sequence
atgagcagcaagatggtgatcagcgagcccggcctgaactgggacatcagccccaagaacggcctgaagaccttcttcagcagagagaactacaaggaccacagcatggcccccagcctgaaggagctgagagtgctgagcaacagaagaatcggcgagaacctgaacgccagcgccagcagcgtggagaacgagcccgccgtgagcagcgccacccaggccaaggagaaggtgaagaccaccatcggcatggtgctgctgcccaagcccagagtgccctaccccagattcagcagattcagccagagagagcagagaagctacgtggacctgctggtgaagtacgccaagatccccgccaacagcaaggccgtgggcatcaacaagaacgactacctgcagtacctggacatgaagaagcacgtgaacgaggagtag

SEQ ID NO: 91239 - DNA, 300 bp, Artificial Sequence
  Description of Artificial Sequence: Synthetic coding sequence
atgagcagcaagatggtgatcagcgagcccggcctgaactgggacatcagccccaagaacggcctgaagaccttcttcagcagagagaactacaaggaccacagcatggcccccagcctgaaggagctgagagtgctgagcaacagaagaatcggcgagaacctgaacgccagcgccagcagcgtggagaacgagcccgccgtgagcagcgccacccaggccaaggagaaggtgaagaccaccatcggcatggtgctgctgcccaagcccagagtgccctaccccagattcagcagatag

SEQ ID NO: 91240 - DNA, 285 bp, Artificial Sequence
  Description of Artificial Sequence: Synthetic coding sequence
atgagcagcaagatggtgatcagcgagcccggcctgaactgggacatcagccccaagaacggcctgaagaccttcttcagcagagagaactacaaggaccacagcatggcccccagcctgaaggagctgagagtgctgagcaacagaagaatcggcgagaacctgaacgccagcgccagcagcgtggagaacgagcccgccgtgagcagcgccacccaggccaaggagaaggtgaagaccaccatcggcatggtgctgctgcccaagcccagagtgccctactag

SEQ ID NO: 91241 - DNA, 846 bp, Artificial Sequence
  Description of Artificial Sequence: Synthetic coding sequence
atgggccagaagaagcagagacccgccagagccggccagccccacagcagcagcgacgccgcccaggcccccgccgagcagccccacagcagcagcgacgccgcccaggccccctgccccagagagagatgcctgggcccccccaccacccccggcccctacagaagcatctacttcagcagccccaagggccacctgaccagactgggcctggagttcttcgaccagcccgccgtgcccctggccagagccttcctgggccaggtgctggtgagaagactgcccaacggcaccgagctgagaggcagaatcgtggagaccgaggcctacctgggccccgaggacgaggccgcccacagcagaggcggcagacagacccccagaaacagaggcatgttcatgaagcccggcaccctgtacgtgtacatcatctacggcatgtacttctgcatgaacatcagcagccagggcgacggcgcctgcgtgctgctgagagccctggagcccctggagggcctggagaccatgagacagctgagaagcaccctgagaaagggcaccgccagcagagtgctgaaggacagagagctgtgcagcggccccagcaagctgtgccaggccctggccatcaacaagagcttcgaccagagagacctggcccaggacgaggccgtgtggctggagagaggccccctggagcccagcgagcccgccgtggtggccgccgccagagtgggcgtgggccacgccggcgagtgggccagaaagcccctgagattctacgtgagaggcagcccctgggtgagcgtggtggacagagtggccgagcaggacacccaggcctag

SEQ ID NO: 91242 - DNA, 924 bp, Artificial Sequence
  Description of Artificial Sequence: Synthetic coding sequence
atggaggccgacaaggacgacacccagcagatcctgaaggagcacagccccgacgagttcatcaaggacgagcagaacaagggcctgatcgacgagatcaccaagaagaacatccagctgaagaaggagatccagaagctggagaccgagctgcaggaggccaccaaggagttccagatcaaggaggacatccccgagaccaagatgaagttcctgagcgtggagacccccgagaacgacagccagctgagcaacatcagctgcagcttccaggtgagcagcaaggtgccctacgagatccagaagggccaggccctgatcaccttcgagaaggaggaggtggcccagaacgtggtgagcatgagcaagcaccacgtgcagatcaaggacgtgaacctggaggtgaccgccaagcccgtgcccctgaacagcggcgtgagattccaggtgtacgtggaggtgagcaagatgaagatcaacgtgaccgagatccccgacaccctgagagaggaccagatgagagacaagctggagctgagcttcagcaagagcagaaacggcggcggcgaggtggacagagtggactacgacagacagagcggcagcgccgtgatcaccttcgtggagatcggcgtggccgacaagatcctgaagaagaaggagtaccccctgtacatcaaccagacctgccacagagtgaccgtgagcccctacaccgagatccacctgaagaagtaccagatcttcagcggcaccagcaagagaaccgtgctgctgaccggcatggagggcatccagatggacgaggagatcgtggaggacctgatcaacatccacttccagagagccaagaacggcggcggcgaggtggacgtggtgaagtgcagcctgggccagccccacatcgcctacttcgaggagtag

SEQ ID NO: 91243 - DNA, 90 bp, Artificial Sequence
  Description of Artificial Sequence: Synthetic coding sequence
atggaggccgacaaggacgacacccagcagatcctgaaggagcacagccccgacgagttcatcaaggacgagcagaacaagggcctgtag

SEQ ID NO: 91244 - DNA, 1185 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcacccccaagggcaacagacccgtgatcctgacctaccacgacatcggcatgaaccacaagacctgctacaaccccctgttcaactacgaggacatgcaggagatcacccagcacttcgccgtgtgccacgtggacgcccccggccagcaggacggcgccgccagcttccccgccggctacatgtaccccagcatggaccagctggccgagatgctgcccggcgtgctgcagcagttcggcctgaagagcatcatcggcatgggcaccggcgccggcgcctacatcctgaccagattcgccctgaacaaccccgagatggtggagggcctggtgctgatcaacgtgaacccctgcgccgagggctggatggactgggccgccagcaagatcagcggctggacccaggccctgcccgacatggtggtgagccacctgttcggcaaggaggagatgcagagcaacgtggaggtggtgcacacctacagacagcacatcgtgaacgacatgaaccccggcaacctgcacctgttcatcaacgcctacaacagcagaagagacctggagatcgagagacccatgcccggcacccacaccgtgaccctgcagtgccccgccctgctggtggtgggcgacagcagccccgccgtggacgccgtggtggagtgcaacagcaagctggaccccaccaagaccaccctgctgaagatggccgactgcggcggcctgccccagatcagccagcccgccaagctggccgaggccttcaagtacttcgtgcagggcatgggctacatgcccagcgccagcatgaccagactgatgagaagcagaaccgccagcggcagcagcgtgaccagcctggacggcaccagaagcagaagccacaccagcgagggcaccagaagcagaagccacaccagcgagggcaccagaagcagaagccacaccagcgagggcgcccacctggacatcacccccaacagcggcgccgccggcaacagcgccggccccaagagcatggaggtgagctgctag

SEQ ID NO: 91245 - DNA, 975 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcacccccaagggcaacagacccgtgatcctgacctaccacgacatcggcatgaaccacaagacctgcgcctacatcctgaccagattcgccctgaacaaccccgagatggtggagggcctggtgctgatcaacgtgaacccctgcgccgagggctggatggactgggccgccagcaagatcagcggctggacccaggccctgcccgacatggtggtgagccacctgttcggcaaggaggagatgcagagcaacgtggaggtggtgcacacctacagacagcacatcgtgaacgacatgaaccccggcaacctgcacctgttcatcaacgcctacaacagcagaagagacctggagatcgagagacccatgcccggcacccacaccgtgaccctgcagtgccccgccctgctggtggtgggcgacagcagccccgccgtggacgccgtggtggagtgcaacagcaagctggaccccaccaagaccaccctgctgaagatggccgactgcggcggcctgccccagatcagccagcccgccaagctggccgaggccttcaagtacttcgtgcagggcatgggctacatgcccagcgccagcatgaccagactgatgagaagcagaaccgccagcggcagcagcgtgaccagcctggacggcaccagaagcagaagccacaccagcgagggcaccagaagcagaagccacaccagcgagggcaccagaagcagaagccacaccagcgagggcgcccacctggacatcacccccaacagcggcgccgccggcaacagcgccggccccaagagcatggaggtgagctgctag

SEQ ID NO: 91246 - DNA, 1185 bp, Artificial Sequence; identical to SEQ ID NO: 91244
  Description of Artificial Sequence: Synthetic coding sequence

SEQ ID NO: 91247 - DNA, 498 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcacccccaagggcaacagacccgtgatcctgacctaccacgacatcggcatgaaccacaagacctgctacaaccccctgttcaactacgaggacatgcaggagatcacccagcacttcgccgtgtgccacgtggacgcccccggccagcaggacggcgccgccagcttccccgccggctacatgtaccccagcatggaccagctggccgagatgctgcccggcgtgctgcagcagttcggcctgaagagcatcatcggcatgggcaccggcgccggcgcctacatcctgaccagattcgccctgaacaaccccgagatggtggagggcctggtgctgatcaacgtgtag

SEQ ID NO: 91248 - DNA, 477 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcacccccaagggcaacagacccgtgatcctgacctaccacgacatcggcatgaaccacaagacctgctacaaccccctgttcaactacgaggacatgcaggagatcacccagcacttcgccgtgtgccacgtggacgcccccggccagcaggacggcgccgccagcttccccgccggctacatgtaccccagcatggaccagctggccgagatgctgcccggcgtgctgcagcagttcggcctgaagagcatcatcggcatgggcaccggcgccggcgcctacatcctgaccagattcgccctgaacaaccccgagatggtggagtag

SEQ ID NO: 91249 - DNA, 402 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcacccccaagggcaacagacccgtgatcctgacctaccacgacatcggcatgaaccacaagacctgctacaaccccctgttcaactacgaggacatgcaggagatcacccagcacttcgccgtgtgccacgtggacgcccccggccagcaggacggcgccgccagcttccccgccggctacatgtaccccagcatggaccagctggccgagatgctgcccggcgtgctgcagcagttcggcctgaagagctag

SEQ ID NO: 91250 - DNA, 477 bp, Artificial Sequence; identical to SEQ ID NO: 91248
  Description of Artificial Sequence: Synthetic coding sequence

SEQ ID NO: 91251 - DNA, 669 bp, Artificial Sequence
  Description of Artificial Sequence: Synthetic coding sequence
atggactgggccgccagcaagatcagcggctggacccaggccctgcccgacatggtggtgagccacctgttcggcaaggaggagatgcagagcaacgtggaggtggtgcacacctacagacagcacatcgtgaacgacatgaaccccggcaacctgcacctgttcatcaacgcctacaacagcagaagagacctggagatcgagagacccatgcccggcacccacaccgtgaccctgcagtgccccgccctgctggtggtgggcgacagcagccccgccgtggacgccgtggtggagtgcaacagcaagctggaccccaccaagaccaccctgctgaagatggccgactgcggcggcctgccccagatcagccagcccgccaagctggccgaggccttcaagtacttcgtgcagggcatgggctacatgcccagcgccagcatgaccagactgatgagaagcagaaccgccagcggcagcagcgtgaccagcctggacggcaccagaagcagaagccacaccagcgagggcaccagaagcagaagccacaccagcgagggcaccagaagcagaagccacaccagcgagggcgcccacctggacatcacccccaacagcggcgccgccggcaacagcgccggccccaagagcatggaggtgagctgctag

SEQ ID NO: 91252 - DNA, 450 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcaggagcaggacatcgagaccctgcacggcagcgtgcacgtgaccctgtgcggcaccccccccgccaagctggccgaggccttcaagtacttcgtgcagggcatgggctacatgcccagcgccagcatgaccagactgatgagaagcagaaccgccagcggcagcagcgtgaccagcctggacggcaccagaagcagaagccacaccagcgagggcaccagaagcagaagccacaccagcgagggcaccagaagcagaagccacaccagcgagggcgcccacctggacatcacccccaacagcggcgccgccggcaacagcgccggccccaagagcatggaggtgagctgctag

SEQ ID NO: 91253 - DNA, 942 bp, Artificial Sequence
  Description of Artificial Sequence: Synthetic coding sequence
atgcaggagatcacccagcacttcgccgtgtgccacgtggacgcccccggccagcaggacggcgccgccagcttccccgccggctacatgtaccccagcatggaccagctggccgagatgctgcccggcgtgctgcagcagttcggcctgaagagcatcatcggcatgggcaccggcgccggcgcctacatcctgaccagattcgccctgaacaaccccgagatggtggagggcctggtgctgatcaacgtgaacccctgcgccgagggctggatggactgggccgccagcaagatcagcggctggacccaggccctgcccgacatggtggtgagccacctgttcggcaaggaggagatgcagagcaacgtggaggtggtgcacacctacagacagcacatcgtgaacgacatgaaccccggcaacctgcacctgttcatcaacgcctacaacagcagaagagacctggagatcgagagacccatgcccggcacccacaccgtgaccctgcagtgccccgccctgctggtggtgggcgacagcagccccgccgtggacgccgtggtggagtgcaacagcaagctggaccccaccaagaccaccctgctgaagatggccgactgcggcggcctgccccagatcagccagcccgccaagctggccgaggccttcaagtacttcgtgcagggcatgggctacatgcccagcgccagcatgaccagactgatgagaagcagaaccgccagcggcagcagcgtgaccagcctggacggcaccagaagcagaagccacaccagcgagggcaccagaagcagaagccacaccagcgagggcaccagaagcagaagccacaccagcgagggcgcccacctggacatcacccccaacagcggcgccgccggcaacagcgccggccccaagagcatggaggtgagctgctag

SEQ ID NO: 91254 - DNA, 288 bp, Artificial Sequence
  Description of Artificial Sequence: Synthetic coding sequence
atgagcagagagatgcaggacgtggacctggccgaggtgaagcccctggtggagaagggcgagaccatcaccggcctgctgcaggagttcgacgtgcagaccaagcccgccaccacccccagcagcaccaccagaacctgcagaagaagccccagcaccctgcccagcgccacctggacccccctggccagcagaaccgcccagccccccagcccccagggcacctgcacccccccctggatcagctggctgaagtgcttcctggagagcttcaacagcctgggctag

SEQ ID NO: 91255 - DNA, 1491 bp, Artificial Sequence
  Description of Artificial Sequence: Synthetic coding sequence
atggccgacgagagcgagaccgccgtgaagccccccgccccccccctgccccagatgatggagggcaacggcaacggccacgagcactgcagcgactgcgagaacgaggaggacaacagctacaacagaggcggcctgagccccgccaacgacaccggcgccaagaagaagaagaagaagcagaagaagaagaaggagaagggcagcgagaccgacagcgcccaggaccagcccgtgaagatgaacagcctgcccgccgagagaatccaggagatccagaaggccatcgagctgttcagcgtgggccagggccccgccaagaccatggaggaggccagcaagagaagctaccagttctgggacacccagcccgtgcccaagctgggcgaggtggtgaacacccacggccccgtggagcccgacaaggacaacatcagacaggagccctacaccctgccccagggcttcacctgggacgccctggacctgggcgacagaggcgtgctgaaggagctgtacaccctgctgaacgagaactacgtggaggacgacgacaacatgttcagattcgactacagccccgagttcctgctgtgggccctgagaccccccggctggctgccccagtggcactgcggcgtgagagtggtgagcagcagaaagctggtgggcttcatcagcgccatccccgccaacatccacatctacgacaccgagaagaagatggtggagatcaacttcctgtgcgtgcacaagaagctgagaagcaagagagtggcccccgtgctgatcagagagatcaccagaagagtgcacctggagggcatcttccaggccgtgtacaccgccggcgtggtgctgcccaagcccgtgggcacctgcagatactggcacagaagcctgaaccccagaaagctgatcgaggtgaagttcagccacctgagcagaaacatgaccatgcagagaaccatgaagctgtacagactgcccgagacccccaagaccgccggcctgagacccatggagaccaaggacatccccgtggtgcaccagctgctgaccagatacctgaagcagttccacctgacccccgtgatgagccaggaggaggtggagcactggttctacccccaggagaacatcatcgacaccttcgtggtggagaacgccaacggcgaggtgaccgacttcctgagcttctacaccctgcccagcaccatcatgaaccaccccacccacaagagcctgaaggccgcctacagcttctacaacgtgcacacccagacccccctgctggacctgatgagcgacgccctggtgctggccaagatgaagggcttcgacgtgttcaacgccctggacctgatggagaacaagaccttcctggagaagctgaagttcggcatcggcgacggcaacctgcagtactacctgtacaactggaagtgccccagcatgggcgccgagaaggtgggcctggtgctgcagtag

SEQ ID NO: 91256 - DNA, 414 bp, Artificial Sequence
  Description of Artificial Sequence: Synthetic coding sequence
atggccgacgagagcgagaccgccgtgaagccccccgccccccccctgccccagatgatggagggcaacggcaacggccacgagcactgcagcgactgcgagaacgaggaggacaacagctacaacagaggcggcctgagccccgccaacgacaccggcgccaagaagaagaagaagaagcagaagaagaagaaggagaagggcagcgagaccgacagcgcccaggaccagcccgtgaagatgaacagcctgcccgccgagagaatccaggagatccagaaggccatcgagctgttcagcgtgggccagggccccgccaagaccatggaggaggccagcaagagaagctaccagttctgggacacccagcccgtgcccaagctggccaagagaaccgtgcacccccccgagtag

SEQ ID NO: 91257 - DNA, 1491 bp, Artificial Sequence; identical to SEQ ID NO: 91255
  Description of Artificial Sequence: Synthetic coding sequence

SEQ ID NO: 91258 - DNA, 1590 bp, Artificial Sequence
  Description of Artificial Sequence: Synthetic coding sequence
atggccgaggacagcgagagcgccgccagccagcagagcctggagctggacgaccaggacacctgcggcatcgacggcgacaacgaggaggagaccgagcacgccaagggcagccccggcggctacctgggcgccaagaagaagaagaagaagcagaagagaaagaaggagaagcccaacagcggcggcaccaagagcgacagcgccagcgacagccaggagatcaagatccagcagcccagcaagcacaacaccatctggcagcagatcagcgccggcgccgccatgggcagcgccaccatggagggcgagtggaccggcatgagaaacgaccacaagaaccccagcgtgcccatgcagaagctgcaggacatccagagagccatggagctgctgagcgcctgccagggccccgccagaaacatcgacgaggccgccaagcacagataccagttctgggacacccagcccgtgcccaagctggacgaggtgatcaccagccacggcgccatcgagcccgacaaggacaacgtgagacaggagccctacagcctgccccagggcttcatgtgggacaccctggacctgagcgacgccgaggtgctgaaggagctgtacaccctgctgaacgagaactacgtggaggacgacgacaacatgttcagattcgactacagccccgagttcctgctgtgggccctgagaccccccggctggctgctgcagtggcactgcggcgtgagagtgagcagcaacaagaagctggtgggcttcatcagcgccatccccgccaacatcagaatctacgacagcgtgaagaagatggtggagatcaacttcctgtgcgtgcacaagaagctgagaagcaagagagtggcccccgtgctgatcagagagatcaccagaagagtgaacctggagggcatcttccaggccgtgtacaccgccggcgtggtgctgcccaagcccatcgccacctgcagatactggcacagaagcctgaaccccagaaagctggtggaggtgaagttcagccacctgagcagaaacatgaccctgcagagaaccatgaagctgtacagactgcccgacgtgaccaagaccagcggcctgagacccatggagcccaaggacatcaagagcgtgagagagctgatcaacacctacctgaagcagttccacctggcccccgtgatggacgaggaggaggtggcccactggttcctgcccagagagcacatcatcgacaccttcgtggtggagagccccaacggcaagctgaccgacttcctgagcttctacaccctgcccagcaccgtgatgcaccaccccgcccacaagagcctgaaggccgcctacagcttctacaacatccacaccgagacccccctgctggacctgatgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaaggtgggcctggtgctgcagtag

SEQ ID NO: 91259 - DNA, 1458 bp, Artificial Sequence
  Description of Artificial Sequence: Synthetic coding sequence
atgagaagaagaagaagcacccccaaggaggtgctggagggcatctgggagcccaagagaaagagaagaaacagaagagagaagagaagaaaccagatccccgaggcccccagccagaccagacacctgatccccagaagactgaagttcagcagcctgagaaacaccacccccagcggcagcagattccagagagagcagccctggaaccccagcgtgcccatgcagaagctgcaggacatccagagagccatggagctgctgagcgcctgccagggccccgccagaaacatcgacgaggccgccaagcacagataccagttctgggacacccagcccgtgcccaagctggacgaggtgatcaccagccacggcgccatcgagcccgacaaggacaacgtgagacaggagccctacagcctgccccagggcttcatgtgggacaccctggacctgagcgacgccgaggtgctgaaggagctgtacaccctgctgaacgagaactacgtggaggacgacgacaacatgttcagattcgactacagccccgagttcctgctgtgggccctgagaccccccggctggctgctgcagtggcactgcggcgtgagagtgagcagcaacaagaagctggtgggcttcatcagcgccatccccgccaacatcagaatctacgacagcgtgaagaagatggtggagatcaacttcctgtgcgtgcacaagaagctgagaagcaagagagtggcccccgtgctgatcagagagatcaccagaagagtgaacctggagggcatcttccaggccgtgtacaccgccggcgtggtgctgcccaagcccatcgccacctgcagatactggcacagaagcctgaaccccagaaagctggtggaggtgaagttcagccacctgagcagaaacatgaccctgcagagaaccatgaagctgtacagactgcccgacgtgaccaagaccagcggcctgagacccatggagcccaaggacatcaagagcgtgagagagctgatcaacacctacctgaagcagttccacctggcccccgtgatggacgaggaggaggtggcccactggttcctgcccagagagcacatcatcgacaccttcgtggtggagagccccaacggcaagctgaccgacttcctgagcttctacaccctgcccagcaccgtgatgcaccaccccgcccacaagagcctgaaggccgcctacagcttctacaacatccacaccgagacccccctgctggacctgatgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaaggtgggcctggtgctgcagtag

SEQ ID NO: 91260 - DNA, 1497 bp, Artificial Sequence
  Description of Artificial Sequence: Synthetic coding sequence
atggccgaggacagcgagagcgccgccagccagcagagcctggagctggacgaccaggacacctgcggcatcgacggcgacaacgaggaggagaccgagcacgccaagggcagccccggcggctacctgggcgccaagaagaagaagaagaagcagaagagaaagaaggagaagcccaacagcggcggcaccaagagcgacagcgccagcgacagccaggagatcaagatccagcagcccagcaagaaccccagcgtgcccatgcagaagctgcaggacatccagagagccatggagctgctgagcgcctgccagggccccgccagaaacatcgacgaggccgccaagcacagataccagttctgggacacccagcccgtgcccaagctggacgaggtgatcaccagccacggcgccatcgagcccgacaaggacaacgtgagacaggagccctacagcctgccccagggcttcatgtgggacaccctggacctgagcgacgccgaggtgctgaaggagctgtacaccctgctgaacgagaactacgtggaggacgacgacaacatgttcagattcgactacagccccgagttcctgctgtgggccctgagaccccccggctggctgctgcagtggcactgcggcgtgagagtgagcagcaacaagaagctggtgggcttcatcagcgccatccccgccaacatcagaatctacgacagcgtgaagaagatggtggagatcaacttcctgtgcgtgcacaagaagctgagaagcaagagagtggcccccgtgctgatcagagagatcaccagaagagtgaacctggagggcatcttccaggccgtgtacaccgccggcgtggtgctgcccaagcccatcgccacctgcagatactggcacagaagcctgaaccccagaaagctggtggaggtgaagttcagccacctgagcagaaacatgaccctgcagagaaccatgaagctgtacagactgcccgacgtgaccaagaccagcggcctgagacccatggagcccaaggacatcaagagcgtgagagagctgatcaacacctacctgaagcagttccacctggcccccgtgatggacgaggaggaggtggcccactggttcctgcccagagagcacatcatcgacaccttcgtggtggagagccccaacggcaagctgaccgacttcctgagcttctacaccctgcccagcaccgtgatgcaccaccccgcccacaagagcctgaaggccgcctacagcttctacaacatccacaccgagacccccctgctggacctgatgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaaggtgggcctggtgctgcagtag

SEQ ID NO: 91261 - DNA, 234 bp, Artificial Sequence
  Description of Artificial Sequence: Synthetic coding sequence
atgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaagggcagcggcaacttcgtgaacgccaacggcaagctgctgcccgacgtgtgcagaagacccccctag

SEQ ID NO: 91262 - DNA, 1458 bp, Artificial Sequence
  Description of Artificial Sequence: Synthetic coding sequence
atggccagcccctggagaggcgcccacgaggtgctggagggcatctgggagcccaagagaaagagaagaaacagaagagagaagagaagaaaccagatccccgaggcccccagccagaccagacacctgatccccagaagactgaagttcagcagcctgagaaacaccacccccagcggcagcagattccagagagagcagccctggaaccccagcgtgcccatgcagaagctgcaggacatccagagagccatggagctgctgagcgcctgccagggccccgccagaaacatcgacgaggccgccaagcacagataccagttctgggacacccagcccgtgcccaagctggacgaggtgatcaccagccacggcgccatcgagcccgacaaggacaacgtgagacaggagccctacagcctgccccagggcttcatgtgggacaccctggacctgagcgacgccgaggtgctgaaggagctgtacaccctgctgaacgagaactacgtggaggacgacgacaacatgttcagattcgactacagccccgagttcctgctgtgggccctgagaccccccggctggctgctgcagtggcactgcggcgtgagagtgagcagcaacaagaagctggtgggcttcatcagcgccatccccgccaacatcagaatctacgacagcgtgaagaagatggtggagatcaacttcctgtgcgtgcacaagaagctgagaagcaagagagtggcccccgtgctgatcagagagatcaccagaagagtgaacctggagggcatcttccaggccgtgtacaccgccggcgtggtgctgcccaagcccatcgccacctgcagatactggcacagaagcctgaaccccagaaagctggtggaggtgaagttcagccacctgagcagaaacatgaccctgcagagaaccatgaagctgtacagactgcccgacgtgaccaagaccagcggcctgagacccatggagcccaaggacatcaagagcgtgagagagctgatcaacacctacctgaagcagttccacctggcccccgtgatggacgaggaggaggtggcccactggttcctgcccagagagcacatcatcgacaccttcgtggtggagagccccaacggcaagctgaccgacttcctgagcttctacaccctgcccagcaccgtgatgcaccaccccgcccacaagagcctgaaggccgcctacagcttctacaacatccacaccgagacccccctgctggacctgatgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaaggtgggcctggtgctgcagtag

SEQ ID NO: 91263 - DNA, 933 bp, Artificial Sequence
  Description of Artificial Sequence: Synthetic coding sequence
atgttcagattcgactacagccccgagttcctgctgtgggccctgagaccccccggctggctgctgcagtggcactgcggcgtgagagtgagcagcaacaagaagctggtgggcttcatcagcgccatccccgccaacatcagaatctacgacagcgtgaagaagatggtggagatcaacttcctgtgcgtgcacaagaagctgagaagcaagagagtggcccccgtgctgatcagagagatcaccagaagagtgaacctggagggcatcttccaggccgtgtacaccgccggcgtggtgctgcccaagcccatcgccacctgcagatactggcacagaagcctgaaccccagaaagctggtggaggtgaagttcagccacctgagcagaaacatgaccctgcagagaaccatgaagctgtacagactgcccgacgtgaccaagaccagcggcctgagacccatggagcccaaggacatcaagagcgtgagagagctgatcaacacctacctgaagcagttccacctggcccccgtgatggacgaggaggaggtggcccactggttcctgcccagagagcacatcatcgacaccttcgtggtggagagccccaacggcaagctgaccgacttcctgagcttctacaccctgcccagcaccgtgatgcaccaccccgcccacaagagcctgaaggccgcctacagcttctacaacatccacaccgagacccccctgctggacctgatgagcgacgccctgatcctggccaagagcaagggcttcgacgtgttcaacgccctggacctgatggagaacaagaccttcctggagaagctgaagttcggcatcggcgacggcaacctgcagtactacctgtacaactggagatgccccggcaccgacagcgagaaggtgggcctggtgctgcagtag

SEQ ID NO: 91264 - DNA, 459 bp, Artificial Sequence
  Description of Artificial Sequence: Synthetic coding sequence
atggaggccgtgctgaacgagctggtgagcgtggaggacctgctgaagttcgagaagaagttccagagcgagaaggccgccggcagcgtgagcaagagcacccagttcgagtacgcctggtgcctggtgagaagcaagtacaacgacgacatcagaaagggcatcgtgctgctggaggagctgctgcccaagggcagcaaggaggagcagagagactacgtgttctacctggccgtgggcaactacagactgaaggagtacgagaaggccctgaagtacgtgagaggcctgctgcagaccgagccccagaacaaccaggccaaggagctggagagactgatcgacaaggccatgaagaaggacggcctggtgggcatggccatcgtgggcggcatggccctgggcgtggccggcctggccggcctgatcggcctggccgtgagcaagagcaagagctag

SEQ ID NO: 91265 - DNA, 2076 bp, Artificial Sequence
  Description of Artificial Sequence: Synthetic coding sequence
atggccctgctgctgaccctgaccagccccgacctggagggcacctgggacaccagagacaaggacggcttcaaggcccaggagggcccccccctggccgtgcccgagttccccgtgtgcggcctgtacagaatctacggcgtgtgcggcagcttcagcagcttcttcatcatcagatgcagcctgtgcgccctggagaccctgaagagcccccagcacgaccccctggagatccccgagcagagcctgaagctgatccccctggtgagcggcaagagagagctgaccagaggccagaaggccggcgagaagcccctggccgccggccccggcgaggaggagctgctgagaggcagcgccccccacgcccaggacacccagagcgaggagctgccccccagctgcaccatcagcggcgagaagaagccccccgccgtgagcggcgaggccaccggcgccgacgccggcagactgtgccccccccccagaagcagagccccccacaaggacagaaccctggccagaagcagaccccagacccagggcgaggactgcagcctgcccgtgggcgaggtgaagatcggcaagagaagctacagccccgcccccggcaagcagaagaagcccaacgccatgggcctggcccccaccagcagccccggcgcccccaacagcgccagagccacccacaaccccgtgccctgcggcagcggcagaggcccctgccacctggccaacctgctgagcaccctggcccagagcaaccagaacagagaccacaagcagggcccccccgaggtgacctgccagatcagaaagaagaccagaaccctgtacagaagcgaccagctggaggagctggagaagatcttccaggaggaccactaccccgacagcgacaagagaagagagatcgcccagaccgtgggcgtgaccccccagagaatcatggtgaagggcgccggcagcctggtggccggctggagcggcggcggccccaccatcgagaccctggagctgcagagcgagagaagcgccgtggcctgggtgtggttccagaacagaagagccaagtggagaaagatggagaagctgaacggcaaggagagcaaggacaaccccgccgcccccggccccgccagcagccagtgcagcagcgccgccgagatcctgcccgccgtgcccatggagcccaagcccgaccccttcccccaggagagccccctggacaccttccccgagccccccatgctgctgaccagcgaccagaccctggcccccacccagcccagcgagggcgcccagagagtggtgaccccccccctgttcagccccccccccgtgagaagagccgacctgcccttccccctgggccccgtgcacaccccccagctgatgcccctgctgatggacgtggccggcagcgacagcagccacaaggacggcccctgcggcagctggggcaccagcatcaccctgccccccccctgcagctacctggaggagctggagccccaggactaccagcagagcaaccagcccggccccttccagttcagccaggccccccagccccccctgttccagagcccccagcccaagctgccctacctgcccaccttccccttcagcatgcccagcagcctgaccctgcccccccccgaggacagcctgttcatgttcccctgcggccccagcggcggcaccagccagggctactgccccggcgccagcagcggccagatcctgatgcagccccccgccggcaacatcggcaccgccagctggagcgacccctgcctgcccgagctgcccttccccggccccttctgcccccaggccctgggccacccccccggcggcgacggctacttccccgacctgttccccaccccctgcccccaggccctgggcagacagcccagcagcgccctgagctggatgcccgagggcgccagacccggcaccggccccctgctgagcaaggccaaggaggagccccccgccgccagcctggaccagcccagcgccctggaggaggccagaggcgacgacaagaacagccacgtgccctag

SEQ ID NO: 91266 - DNA, 699 bp, Artificial Sequence
  Description of Artificial Sequence: Synthetic coding sequence
atggagagatgccccagcctgggcgtgaccctgtacgccctggtggtggtgctgggcctgagagccacccccgccggcggccagcactacctgcacatcagacccgcccccagcgacaacctgcccctggtggacctgatcgagcaccccgaccccatcttcgaccccaaggagaaggacctgaacgagaccctgctgagaagcctgctgggcggccactacgaccccggcttcatggccaccagcccccccgaggacagacccggcggcggcggcggcgccgccggcggcgccgaggacctggccgagctggaccagctgctgagacagagacccagcggcgccatgcccagcgagatcaagggcctggagttcagcgagggcctggcccagggcaagaagcagagactgagcaagaagctgagaagaaagctgcagatgtggctgtggagccagaccttctgccccgtgctgtacgcctggaacgacctgggcagcagattctggcccagatacgtgaaggtgggcagctgcttcagcaagagaagctgcagcgtgcccgagggcatggtgtgcaagcccagcaagagcgtgcacctgaccgtgctgagatggagatgccagagaagaggcggccagagatgcggctggatccccatccagtaccccatcatcagcgagtgcaagtgcagctgctag

SEQ ID NO: 91267 - DNA, 990 bp, Artificial Sequence
  Description of Artificial Sequence: Synthetic coding sequence
atgggcaccgccgccgccgccgccgccgccgccgccgccgccgccgccggcgagggcgccagaagccccagccccgccgccgtgagcctgggcctgggcgtggccgtggtgagcagcctggtgaacggcagcaccttcgtgctgcagaagaagggcatcgtgagagccaagagaagaggcaccagctacctgaccgacatcgtgtggtgggccggcaccatcgccatggccgtgggccagatcggcaacttcctggcctacaccgccgtgcccaccgtgctggtgacccccctgggcgccctgggcgtgcccttcggcagcatcctggccagctacctgctgaaggagaagctgaacatcctgggcaagctgggctgcctgctgagctgcgccggcagcgtggtgctgatcatccacagccccaagagcgagagcgtgaccacccaggccgagctggaggagaagctgaccaaccccgtgttcgtgggctacctgtgcatcgtgctgctgatgctgctgctgctgatcttctggatcgcccccgcccacggccccaccaacatcatggtgtacatcagcatctgcagcctgctgggcagcttcaccgtgcccagcaccaagggcatcggcctggccgcccaggacatcctgcacaacaaccccagcagccagagagccctgtgcctgtgcctggtgctgctggccgtgctgggctgcagcatcatcgtgcagttcagatacatcaacaaggccctggagtgcttcgacagcagcgtgttcggcgccatctactacgtggtgttcaccaccctggtgctgctggccagcgccatcctgttcagagagtggagcaacgtgggcctggtggacttcctgggcatggcctgcggcttcaccaccgtgagcgtgggcatcgtgctgatccaggtgttcaaggagttcaacttcaacctgggcgagatgaacaagagcaacatgaagaccgactag

SEQ ID NO: 91268 - DNA, 765 bp, Artificial Sequence
  Description of Artificial Sequence: Synthetic coding sequence
atggccgtgggccagatcggcaacttcctggcctacaccgccgtgcccaccgtgctggtgacccccctgggcgccctgggcgtgcccttcggcagcatcctggccagctacctgctgaaggagaagctgaacatcctgggcaagctgggctgcctgctgagctgcgccggcagcgtggtgctgatcatccacagccccaagagcgagagcgtgaccacccaggccgagctggaggagaagctgaccaaccccgtgttcgtgggctacctgtgcatcgtgctgctgatgctgctgctgctgatcttctggatcgcccccgcccacggccccaccaacatcatggtgtacatcagcatctgcagcctgctgggcagcttcaccgtgcccagcaccaagggcatcggcctggccgcccaggacatcctgcacaacaaccccagcagccagagagccctgtgcctgtgcctggtgctgctggccgtgctgggctgcagcatcatcgtgcagttcagatacatcaacaaggccctggagtgcttcgacagcagcgtgttcggcgccatctactacgtggtgttcaccaccctggtgctgctggccagcgccatcctgttcagagagtggagcaacgtgggcctggtggacttcctgggcatggcctgcggcttcaccaccgtgagcgtgggcatcgtgctgatccaggtgttcaaggagttcaacttcaacctgggcgagatgaacaagagcaacatgaagaccgactag

SEQ ID NO: 91269 - DNA, 480 bp, Artificial Sequence
  Description of Artificial Sequence: Synthetic coding sequence
atgctgctgctgctgatcttctggatcgcccccgcccacggccccaccaacatcatggtgtacatcagcatctgcagcctgctgggcagcttcaccgtgcccagcaccaagggcatcggcctggccgcccaggacatcctgcacaacaaccccagcagccagagagccctgtgcctgtgcctggtgctgctggccgtgctgggctgcagcatcatcgtgcagttcagatacatcaacaaggccctggagtgcttcgacagcagcgtgttcggcgccatctactacgtggtgttcaccaccctggtgctgctggccagcgccatcctgttcagagagtggagcaacgtgggcctggtggacttcctgggcatggcctgcggcttcaccaccgtgagcgtgggcatcgtgctgatccaggtgttcaaggagttcaacttcaacctgggcgagatgaacaagagcaacatgaagaccgactag

SEQ ID NO: 91270 - DNA, 765 bp, Artificial Sequence; identical to SEQ ID NO: 91268
  Description of Artificial Sequence: Synthetic coding sequence

SEQ ID NO: 91271 - DNA, 1083 bp, Artificial Sequence
  Description of Artificial Sequence: Synthetic coding sequence
atgagccagggcagaggcaagtacgacttctacatcggcctgggcctggccatgagcagcagcatcttcatcggcggcagcttcatcctgaagaagaagggcctgctgagactggccagaaagggcagcatgagagccggccagggcggccacgcctacctgaaggagtggctgtggtgggccggcctgctgagcatgggcgccggcgaggtggccaacttcgccgcctacgccttcgcccccgccaccctggtgacccccctgggcgccctgagcgtgctggtgagcgccatcctgagcagctacttcctgaacgagagactgaacctgcacggcaagatcggctgcctgctgagcatcctgggcagcaccgtgatggtgatccacgcccccaaggaggaggagatcgagaccctgaacgagatgagccacaagctgggcgaccccggcttcgtggtgttcgccaccctggtggtgatcgtggccctgatcctgatcttcgtggtgggccccagacacggccagaccaacatcctggtgtacatcaccatctgcagcgtgatcggcgccttcagcgtgagctgcgtgaagggcctgggcatcgccatcaaggagctgttcgccggcaagcccgtgctgagacaccccctggcctggatcctgctgctgagcctgatcgtgtgcgtgagcacccagatcaactacctgaacagagccctggacatcttcaacaccagcatcgtgacccccatctactacgtgttcttcaccaccagcgtgctgacctgcagcgccatcctgttcaaggagtggcaggacatgcccgtggacgacgtgatcggcaccctgagcggcttcttcaccatcatcgtgggcatcttcctgctgcacgccttcaaggacgtgagcttcagcctggccagcctgcccgtgagcttcagaaaggacgagaaggccatgaacggcaacctgagcaacatgtacgaggtgctgaacaacaacgaggagagcctgacctgcggcatcgagcagcacaccggcgagaacgtgagcagaagaaacggcaacctgaccgccttctag

SEQ ID NO: 91272 - DNA, 1026 bp, Artificial Sequence
  Description of Artificial Sequence: Synthetic coding sequence
atgagccagggcagaggcaagtacgacttctacatcggcctgggcctggccatgagcagcagcatcttcatcggcggcagcttcatcctgaagaagaagggcctgctgagactggccagaaagggcagcatgagagccgtgggcgccggcgaggtggccaacttcgccgcctacgccttcgcccccgccaccctggtgacccccctgggcgccctgagcgtgctggtgagcgccatcctgagcagctacttcctgaacgagagactgaacctgcacggcaagatcggctgcctgctgagcatcctgggcagcaccgtgatggtgatccacgcccccaaggaggaggagatcgagaccctgaacgagatgagccacaagctgggcgaccccggcttcgtggtgttcgccaccctggtggtgatcgtggccctgatcctgatcttcgtggtgggccccagacacggccagaccaacatcctggtgtacatcaccatctgcagcgtgatcggcgccttcagcgtgagctgcgtgaagggcctgggcatcgccatcaaggagctgttcgccggcaagcccgtgctgagacaccccctggcctggatcctgctgctgagcctgatcgtgtgcgtgagcacccagatcaactacctgaacagagccctggacatcttcaacaccagcatcgtgacccccatctactacgtgttcttcaccaccagcgtgctgacctgcagcgccatcctgttcaaggagtggcaggacatgcccgtggacgacgtgatcggcaccctgagcggcttcttcaccatcatcgtgggcatcttcctgctgcacgccttcaaggacgtgagcttcagcctggccagcctgcccgtgagcttcagaaaggacgagaaggccatgaacggcaacctgagcaacatgtacgaggtgctgaacaacaacgaggagagcctgacctgcggcatcgagcagcacaccggcgagaacgtgagcagaagaaacggcaacctgaccgccttctag

SEQ ID NO: 91273 - DNA, 1083 bp, Artificial Sequence; identical to SEQ ID NO: 91271
  Description of Artificial Sequence: Synthetic coding sequence

SEQ ID NO: 91274 - DNA, 1083 bp, Artificial Sequence; identical to SEQ ID NO: 91271
  Description of Artificial Sequence: Synthetic coding sequence

SEQ ID NO: 91275 - DNA, 1026 bp, Artificial Sequence; identical to SEQ ID NO: 91272
  Description of Artificial Sequence: Synthetic coding sequence

SEQ ID NO: 91276 - DNA, 180 bp, Artificial Sequence
  Description of Artificial Sequence: Synthetic coding sequence
atgagccagggcagaggcaagtacgacttctacatcggcctgggcctggccatgagcagcagcatcttcatcggcggcagcttcatcctgaagaagaagggcctgctgagactggccagaaagggcagcatgagagccggccagggcggccacgcctacctgaaggagtggctgtggtag

SEQ ID NO: 91277 - DNA, 900 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgagcgacctgcagcaggtgtggcacgagcaggtggacaccagcgtggtgagccagagagccaaggagctgaacaagagactgaccgccccccccgccgccttcctgtgccacctggacaacctgctgagacccctgctgaaggacgccgcccaccccagcgaggccaccttcagctgcgactgcgtggccgacgccctgatcctgagagtgagaagcgagctgagcggcctgcccttctactggaacttccactgcatgctggccagccccagcctggtgagccagcacctgatcagacccctgatgggcatgagcctggccctgcagtgccaggtgagagagctggccaccctgctgcacatgaaggacctggagatccaggactaccaggagagcggcgccaccctgatcagagacagactgaagaccgagcccttcgaggagaacagcttcctggagcagttcatgatcgagaagctgcccgaggcctgcagcatcggcgacggcaagcccttcgtgatgaacctgcaggacctgtacatggccgtgaccacccaggaggtgcaggtgggccagaagcaccagggcgccggcgacccccacaccagcaacagcgccagcctgcagggcatcgacagccagtgcgtgaaccagcccgagcagctggtgagcagcgcccccaccctgagcgcccccgagaaggagagcaccggcaccagcggccccctgcagagaccccagctgagcaaggtgaagagaaagaagcccagaggcctgttcagctag

SEQ ID NO: 91278 - DNA, 951 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgagcgacctgcagcaggtgtggcacgagcaggtggacaccagcgtggtgagccagagagccaaggagctgaacaagagactgaccgccccccccgccgccttcctgtgccacctggacaacctgctgagacccctgctgaaggacgccgcccaccccagcgaggccaccttcagctgcgactgcgtggccgacgccctgatcctgagagtgagaagcgagctgagcggcctgcccttctactggaacttccactgcatgctggccagccccagcctggtgagccagcacctgatcagacccctgatgggcatgagcctggccctgcagtgccaggtgagagagctggccaccctgctgcacatgaaggacctggagatccaggactaccaggagagcggcgccaccctgatcagagacagactgaagaccgagcccttcgaggagaacagcttcctggagcagttcatgatcgagaagctgcccgaggcctgcagcatcggcgacggcaagcccttcgtgatgaacctgcaggacctgtacatggccgtgaccacccaggaggtgcaggtgggccagaagcaccagggcgccggcgacccccacaccagcaacagcgccagcctgcagggcatcgacagccagtgcgtgaaccagcccgagcagctggtgagcagcgcccccaccctgagcgcccccgagaaggagagcaccgccctgtgcagagacctgagctgccagagaagcagaggcagaagccagggcgtgagcagcgtgaacctgctgtggccccagctgctgagaatggacctggagaacagcttccaggccagcccctag

SEQ ID NO: 91279 - DNA, 690 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgagcgacctgcagcaggtgtggcacgagcaggtggacaccagcgtggtgagccagagagccaaggagctgaacaagagactgaccgccccccccgccgccttcctgtgccacctggacaacctgctgagacccctgctgaaggacgccgcccaccccagcgaggccaccttcagctgcgactgcgtggccgacgccctgatcctgagagtgagaagcgagctgagcggcctgcccttctactggaacttccactgcatgctggccagccccagcctggtgagccagcacctgatcagacccctgatgggcatgagcctggccctgcagtgccaggtgagagagctggccaccctgctgcacatgaaggacctggagatccaggactaccaggagagcggcgccaccctgatcagagacagactgaagaccgagcccttcgaggagaacagcttcctggagcagttcatgatcgagaagctgcccgaggcctgcagcatcggcgacggcaagcccttcgtgatgaacctgcaggacctgtacatggccgtgaccacccaggaggtgcaggtgggctag

SEQ ID NO: 91280 - DNA, 804 bp, Artificial Sequence
  Description of Artificial Sequence: Synthetic coding sequence
atggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaccatggccaacctggagagaaccttcatcgccatcaagcccgacggcgtgcagagaggcctggtgggcgagatcatcaagagattcgagcagaagggcttcagactggtggccatgaagttcctgagagccagcgaggagcacctgaagcagcactacatcgacctgaaggacagacccttcttccccggcctggtgaagtacatgaacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 91281 - DNA, 234 bp, Artificial Sequence
  Description of Artificial Sequence: Synthetic coding sequence
atggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 91282 - DNA, 234 bp, Artificial Sequence; identical to SEQ ID NO: 91281
  Description of Artificial Sequence: Synthetic coding sequence

SEQ ID NO: 91283 - DNA, 459 bp, Artificial Sequence
  Description of Artificial Sequence: Synthetic coding sequence
atggccaacctggagagaaccttcatcgccatcaagcccgacggcgtgcagagaggcctggtgggcgagatcatcaagagattcgagcagaagggcttcagactggtggccatgaagttcctgagagccagcgaggagcacctgaagcagcactacatcgacctgaaggacagacccttcttccccggcctggtgaagtacatgaacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 91284 - DNA, 459 bp, Artificial Sequence; identical to SEQ ID NO: 91283
  Description of Artificial Sequence: Synthetic coding sequence

SEQ ID NO: 91285 - DNA, 459 bp, Artificial Sequence; identical to SEQ ID NO: 91283
  Description of Artificial Sequence: Synthetic coding sequence

SEQ ID NO: 91286 - DNA, 459 bp, Artificial Sequence; identical to SEQ ID NO: 91283
  Description of Artificial Sequence: Synthetic coding sequence

SEQ ID NO: 91287 - DNA, 459 bp, Artificial Sequence; identical to SEQ ID NO: 91283
  Description of Artificial Sequence: Synthetic coding sequence

SEQ ID NO: 91288 - DNA, 879 bp, Artificial Sequence
  Description of Artificial Sequence: Synthetic coding sequence
atggtgctgctgagcaccctgggcatcgtgttccagggcgagggcccccccatcagcagctgcgacaccggcaccatggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaccatggccaacctggagagaaccttcatcgccatcaagcccgacggcgtgcagagaggcctggtgggcgagatcatcaagagattcgagcagaagggcttcagactggtggccatgaagttcctgagagccagcgaggagcacctgaagcagcactacatcgacctgaaggacagacccttcttccccggcctggtgaagtacatgaacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 91289 - DNA, 1188 bp, Artificial Sequence
  Description of Artificial Sequence: Synthetic coding sequence
atggtgagcgccgccggcctgagcggcgacggcaagatgagaggcgtgctgctggtgctgctgggcctgctgtacagcagcaccagctgcggcgtgcagaaggccagcgtgttctacggccccgaccccaaggagggcctggtgagcagcatggagttcccctgggtggtgagcctgcaggacagccagtacacccacctggccttcggctgcatcctgagcgagttctgggtgctgagcatcgccagcgccatccagaacagaaaggacatcgtggtgatcgtgggcatcagcaacatggaccccagcaagatcgcccacaccgagtaccccgtgaacaccatcatcatccacgaggacttcgacaacaacagcatgagcaacaacatcgccctgctgaagaccgacaccgccatgcacttcggcaacctggtgcagagcatctgcttcctgggcagaatgctgcacaccccccccgtgctgcagaactgctgggtgagcggctggaaccccaccagcgccaccggcaaccacatgaccatgagcgtgctgagaaagatcttcgtgaaggacctggacatgtgccccctgtacaagctgcagaagaccgagtgcggcagccacaccaaggaggagaccaagaccgcctgcctgggcgaccccggcagccccatgatgtgccagctgcagcagttcgacctgtgggtgctgagaggcgtgctgaacttcggcggcgagacctgccccggcctgttcctgtacaccaaggtggaggactacagcaagtggatcaccagcaaggccgagagagccggcccccccctgagcagcctgcaccactgggagaagctgatcagcttcagccaccacggccccaacgccaccatgacccagaagacctacagcgacagcgagctgggccacgtgggcagctacctgcagggccagagaagaaccatcacccacagcagactgggcaacagcagcagagacagcctggacgtgagagagaaggacgtgaaggagagcggcagaagccccgaggccagcgtgcagcccctgtactacgactactacggcggcgaggtgggcgagggcagaatcttcgccggccagaacagactgtaccagcccgaggagatcatcctggtgagcttcgtgctggtgttcttctgcagcagcatctag

SEQ ID NO: 91290 - DNA, 639 bp, Artificial Sequence
  Description of Artificial Sequence: Synthetic coding sequence
atggagatcagcatgccccccccccagatctacgtggagaagaccctggccatcatcaagcccgacatcgtggacaaggaggaggagatccaggacatcatcctgagaagcggcttcaccatcgtgcagagaagaaagctgagactgagccccgagcagtgcagcaacttctacgtggagaagtacggcaagatgttcttccccaacctgaccgcctacatgagcagcggccccctggtggccatgatcctggccagacacaaggccatcagctactggctggagctgctgggccccaacaacagcctggtggccaaggagacccaccccgacagcctgagagccatctacggcaccgacgacctgagaaacgccctgcacggcagcaacgacttcgccgccgccgagagagagatcagattcatgttccccgaggtgatcgtggagcccatccccatcggccaggccgccaaggactacctgaacctgcacatcatgcccaccctgctggagggcctgaccgagctgtgcaagcagaagcccgccgaccccctgatctggctggccgactggctgctgaagaacaaccccaacaagcccaagctgtgccaccaccccatcgtggaggagccctactag

SEQ ID NO: 91291 - DNA, 561 bp, Artificial Sequence
  Description of Artificial Sequence: Synthetic coding sequence
atggccagcatcctgagaagcccccaggccctgcagctgaccctggccctgatcaagcccgacgccgtggcccaccccctgatcctggaggccgtgcaccagcagatcctgagcaacaagttcctgatcgtgagaatgagagagctgctgtggagaaaggaggactgccagagattctacagagagcacgagggcagattcttctaccagagactggtggagttcatggccagcggccccatcagagcctacatcctggcccacaaggacgccatccagctgtggagaaccctgatgggccccaccagagtgttcagagccagacacgtggcccccgacagcatcagaggcagcttcggcctgaccgacaccagaaacaccacccacggcagcgacagcgtggtgagcgccagcagagagatcgccgccttcttccccgacttcagcgagcagagatggtacgaggaggaggagccccagctgagatgcggccccgtgtgctacagccccgagggcggcgtgcactacgtggccggcaccggcggcctgggccccgcctag

SEQ ID NO: 91292 - DNA, 585 bp, Artificial Sequence
  Description of Artificial Sequence: Synthetic coding sequence
atgacccagaacctgggcagcgagatggccagcatcctgagaagcccccaggccctgcagctgaccctggccctgatcaagcccgacgccgtggcccaccccctgatcctggaggccgtgcaccagcagatcctgagcaacaagttcctgatcgtgagaatgagagagctgctgtggagaaaggaggactgccagagattctacagagagcacgagggcagattcttctaccagagactggtggagttcatggccagcggccccatcagagcctacatcctggcccacaaggacgccatccagctgtggagaaccctgatgggccccaccagagtgttcagagccagacacgtggcccccgacagcatcagaggcagcttcggcctgaccgacaccagaaacaccacccacggcagcgacagcgtggtgagcgccagcagagagatcgccgccttcttccccgacttcagcgagcagagatggtacgaggaggaggagccccagctgagatgcggccccgtgtgctacagccccgagggcggcgtgcactacgtggccggcaccggcggcctgggccccgcctag

SEQ ID NO: 91293 - DNA, 561 bp, Artificial Sequence; identical to SEQ ID NO: 91291
  Description of Artificial Sequence: Synthetic coding sequence

SEQ ID NO: 91294 - DNA, 360 bp, Artificial Sequence
  Description of Artificial Sequence: Synthetic coding sequence
atggccagcatcctgagaagcccccaggccctgcagctgaccctggccctgatcaagcccgacgccgtggcccaccccctgatcctggaggccgtgcaccagcagatcctgagcaacaagttcctgatcgtgagaatgagagagctgctgtggagaaaggaggactgccagagattctacagagagcacgaggacagcgtggtgagcgccagcagagagatcgccgccttcttccccgacttcagcgagcagagatggtacgaggaggaggagccccagctgagatgcggccccgtgtgctacagccccgagggcggcgtgcactacgtggccggcaccggcggcctgggccccgcctag

SEQ ID NO: 91295 - DNA, 561 bp, Artificial Sequence; identical to SEQ ID NO: 91291
  Description of Artificial Sequence: Synthetic coding sequence

SEQ ID NO: 91296 - DNA, 492 bp, Artificial Sequence
  Description of Artificial Sequence: Synthetic coding sequence
atggccagcatcctgagaagcccccaggccctgcagctgaccctggccctgatcaagcccgacgccgtggcccaccccctgatcctggaggccgtgcaccagcagatcctgagcaacaagttcctgatcgtgagaatgagagagctgctgtggagaaaggaggactgccagagattctacagagagcacgaggccggccagagcgagcccaccagcctgcccaccagaatgcccagcagcagcggcggcagaagctgggacccccccgagtgcagcgagcacgccatgtggccccagatcctgagcgtgggcgtgagcgccagcctgacccccgccaccccccccatggtgagaaccctgtggttccagcccgccgagagactgcagcccagcagcctgaccagcgtgaacagcgccggcatgagaagaaagagccccagctgcgccgtggccctgtgcgccatcgcccagagagaggtgagcaccatgtag

SEQ ID NO: 91297 - DNA, 561 bp, Artificial Sequence; identical to SEQ ID NO: 91291
  Description of Artificial Sequence: Synthetic coding sequence

SEQ ID NO: 91298 - DNA, 1131 bp, Artificial Sequence
  Description of Artificial Sequence: Synthetic coding sequence
atgaaccacagcgagagattcgtgttcatcgccgagtggtacgaccccaacgccagcctgctgagaagatacgagctgctgttctaccccggcgacggcagcgtggagatgcacgacgtgaagaaccacagaaccttcctgaagagaaccaagtacgacaacctgcacctggaggacctgttcatcggcaacaaggtgaacgtgttcagcagacagctggtgctgatcgactacggcgaccagtacaccgccagacagctgggcagcagaaaggagaagaccctggccctgatcaagcccgacgccatcagcaaggccggcgagatcatcgagatcatcaacaaggccggcttcaccatcaccaagctgaagatgatgatgctgagcagaaaggaggccctggacttccacgtggaccaccagagcagacccttcttcaacgagctgatccagttcatcaccaccggccccatcatcgccatggagatcctgagagacgacgccatctgcgagtggaagagactgctgggccccgccaacagcggcgtggccagaaccgacgccagcgagagcatcagagccctgttcggcaccgacggcatcagaaacgccgcccacggccccgacagcttcgccagcgccgccagagagatggagctgttcttccccagcagcggcggctgcggccccgccaacaccgccaagttcaccaactgcacctgctgcatcgtgaagccccacgccgtgagcgagggcctgctgggcaagatcctgatggccatcagagacgccggcttcgagatcagcgccatgcagatgttcaacatggacagagtgaacgtggaggagttctacgaggtgtacaagggcgtggtgaccgagtaccacgacatggtgaccgagatgtacagcggcccctgcgtggccatggagatccagcagaacaacgccaccaagaccttcagagagttctgcggccccgccgaccccgagatcgccagacacctgagacccggcaccctgagagccatcttcggcaagaccaagatccagaacgccgtgcactgcaccgacctgcccgaggacggcctgctggaggtgcagtacttcttcaagatcctggacaactag

SEQ ID NO: 91299 - DNA, 1023 bp, Artificial Sequence
  Description of Artificial Sequence: Synthetic coding sequence
atgcacgacgtgaagaaccacagaaccttcctgaagagaaccaagtacgacaacctgcacctggaggacctgttcatcggcaacaaggtgaacgtgttcagcagacagctggtgctgatcgactacggcgaccagtacaccgccagacagctgggcagcagaaaggagaagaccctggccctgatcaagcccgacgccatcagcaaggccggcgagatcatcgagatcatcaacaaggccggcttcaccatcaccaagctgaagatgatgatgctgagcagaaaggaggccctggacttccacgtggaccaccagagcagacccttcttcaacgagctgatccagttcatcaccaccggccccatcatcgccatggagatcctgagagacgacgccatctgcgagtggaagagactgctgggccccgccaacagcggcgtggccagaaccgacgccagcgagagcatcagagccctgttcggcaccgacggcatcagaaacgccgcccacggccccgacagcttcgccagcgccgccagagagatggagctgttcttccccagcagcggcggctgcggccccgccaacaccgccaagttcaccaactgcacctgctgcatcgtgaagccccacgccgtgagcgagggcctgctgggcaagatcctgatggccatcagagacgccggcttcgagatcagcgccatgcagatgttcaacatggacagagtgaacgtggaggagttctacgaggtgtacaagggcgtggtgaccgagtaccacgacatggtgaccgagatgtacagcggcccctgcgtggccatggagatccagcagaacaacgccaccaagaccttcagagagttctgcggccccgccgaccccgagatcgccagacacctgagacccggcaccctgagagccatcttcggcaagaccaagatccagaacgccgtgcactgcaccgacctgcccgaggacggcctgctggaggtgcagtacttcttcaagatcctggacaactag

SEQ ID NO: 91300 - DNA, 1416 bp, Artificial Sequence
  Description of Artificial Sequence: Synthetic coding sequence
atgcagagcaacaagaccttcaacctggagaagcagaaccacacccccagaaagcaccaccagcaccaccaccagcagcagcaccaccagcagcagcagcagcagcccccccccccccccatccccgccaacggccagcaggccagcagccagaacgagggcctgaccatcgacctgaagaacttcagaaagcccggcgagaagaccttcacccagagaagcagactgttcgtgggcaacctgccccccgacatcaccgaggaggagatgagaaagctgttcgagaagtacggcaaggccggcgaggtgttcatccacaaggacaagggcttcggcttcatcagactggagaccagaaccctggccgagatcgccaaggtggagctggacaacatgcccctgagaggcaagcagctgagagtgagattcgcctgccacagcgccagcctgaccgtgagaaacctgccccagtacgtgagcaacgagctgctggaggaggccttcagcgtgttcggccaggtggagagagccgtggtgatcgtggacgacagaggcagacccagcggcaagggcatcgtggagttcagcggcaagcccgccgccagaaaggccctggacagatgcagcgagggcagcttcctgctgaccaccttccccagacccgtgaccgtggagcccatggaccagctggacgacgaggagggcctgcccgagaagctggtgatcaagaaccagcagttccacaaggagagagagcagccccccagattcgcccagcccggcagcttcgagtacgagtacgccatgagatggaaggccctgatcgagatggagaagcagcagcaggaccaggtggacagaaacatcaaggaggccagagagaagctggagatggagatggaggccgccagacacgagcaccaggtgatgctgatgagacaggacctgatgagaagacaggaggagctgagaagaatggaggagctgcacaaccaggaggtgcagaagagaaagcagctggagctgagacaggaggaggagagaagaagaagagaggaggagatgagaagacagcaggaggagatgatgagaagacagcaggagggcttcaagggcaccttccccgacgccagagagcaggagatcagaatgggccagatggccatgggcggcgccatgggcatcaacaacagaggcgccatgccccccgcccccgtgcccgccggcacccccgccccccccggccccgccaccatgatgcccgacggcaccctgggcctgaccccccccaccaccgagagattcggccaggccgccaccatggagggcatcggcgccatcggcggcaccccccccgccttcaacagagccgcccccggcgccgagttcgcccccaacaagagaagaagatactag

SEQ ID NO: 91301 - DNA, 1416 bp, Artificial Sequence; identical to SEQ ID NO: 91300
  Description of Artificial Sequence: Synthetic coding sequence

SEQ ID NO: 91302 - DNA, 1416 bp, Artificial Sequence; identical to SEQ ID NO: 91300
  Description of Artificial Sequence: Synthetic coding sequence

SEQ ID NO: 91303 - DNA, 747 bp, Artificial Sequence
  Description of Artificial Sequence: Synthetic coding sequence
atgcagagcaacaagaccttcaacctggagaagcagaaccacacccccagaaagcaccaccagcaccaccaccagcagcagcaccaccagcagcagcagcagcagcccccccccccccccatccccgccaacggccagcaggccagcagccagaacgagggcctgaccatcgacctgaagaacttcagaaagcccggcgagaagaccttcacccagagaagcagactgttcgtgggcaacctgccccccgacatcaccgaggaggagatgagaaagctgttcgagaagtacggcaaggccggcgaggtgttcatccacaaggacaagggcttcggcttcatcagactggagaccagaaccctggccgagatcgccaaggtggagctggacaacatgcccctgagaggcaagcagctgagagtgagattcgcctgccacagcgccagcctgaccgtgagaaacctgccccaggagagagagcagccccccagattcgcccagcccggcagcttcgagtacgagtacgccatgagatggaaggccctgatcgagatggagaagcagcagcaggaccaggtggacagaaacatcaaggaggccagagagaagctggagatggagatggaggccgccagacacgagcaccaggtgatgctgatgagacaggacctgatgagaagacaggaggagctgagaagaatggaggagctgcacaaccaggaggtgcagaagagaaagcagctgtag

SEQ ID NO: 91304 - DNA, 708 bp, Artificial Sequence
  Description of Artificial Sequence: Synthetic coding sequence
tgacccgacatcaccgaggaggagatgagaaagctgttcgagaagtacggcaaggccggcgaggtgttcatccacaaggacaagggcttcggcttcatcagactggtggagagagccgtggtgatcgtggacgacagaggcagacccagcggcaagggcatcgtggagttcagcggcaagcccgccgccagaaaggccctggacagatgcagcgagggcagcttcctgctgaccaccttccccagacccgtgaccgtggagcccatggaccagctggacgacgaggagggcctgcccgagaagctggtgatcaagaaccagcagttccacaaggagagagagcagccccccagattcgcccagcccggcagcttcgagtacgagtacgccatgagatggaaggccctgatcgagatggagaagcagcagcaggaccaggtggacagaaacatcaaggaggccagagagaagctggagatggagatggaggccgccagacacgagcaccaggtgatgctgatgagacaggacctgatgagaagacaggaggagctgagaagaatggaggagctgcacaaccaggaggtgcagaagagaaagcagctggagctgagacaggaggaggagagaagaagaagagaggaggagatgagaagacagcaggaggagatgatgagaagacagcaggagggcttcaagggcacctag

SEQ ID NO: 91305 - DNA, 375 bp, Artificial Sequence
  Description of Artificial Sequence: Synthetic coding sequence
atgcagagcaacaagaccttcaacctggagaagcagaaccacacccccagaaagcaccaccagcaccaccaccagcagcagcaccaccagcagcagcagcagcagcccccccccccccccatccccgccaacggccagcaggccagcagccagaacgagggcctgaccatcgacctgaagaacttcagaaagcccggcgagaagaccttcacccagagaagcagactgttcgtgggcaacctgccccccgacatcaccgaggaggagatgagaaagctgttcgagaagtacggcaaggagaccagaaccctggccgagatcgccaaggtggagctggacaacatgcccctgagaggcaagcagctgagagtgtag

SEQ ID NO: 91306 - DNA, 201 bp, Artificial Sequence
  Description of Artificial Sequence: Synthetic coding sequence
atgcagagcaacaagaccttcaacctggagaagcagaaccacacccccagaaagcaccaccagcaccaccaccagcagcagcaccaccagcagcagcagcagcagcccccccccccccccatccccgccaacggccagcaggccagcagccagaacgagggcctgaccatcgacctgaagaacttcagaaagcccggctag

SEQ ID NO: 91307 - DNA, 624 bp, Artificial Sequence
  Description of Artificial Sequence: Synthetic coding sequence
atgcagagcaacaagaccttcaacctggagaagcagaaccacacccccagaaagcaccaccagcaccaccaccagcagcagcaccaccagcagcagcagcagcagcccccccccccccccatccccgccaacggccagcaggccagcagccagaacgagggcctgaccatcgacctgaagaacttcagaaagcccggcgagaagaccttcacccagagaagcagactgttcgtgggcaacctgccccccgacatcaccgaggaggagatgagaaagctgttcgagaagtacggcaaggccggcgaggtgttcatccacaaggacaagggcttcggcttcatcagactggagaccagaaccctggccgagatcgccaaggtggagctggacaacatgcccctgagaggcaagcagctgagagtgagattcgcctgccacagcgccagcctgaccgtgagaaacctgccccagtacgtgagcaacgagctgctggaggaggccttcagcgtgttcggccaggtggagagagccgtggtgatcgtggacgacagaggcagacccagcggcaagggcatcgtggagttcagcggcaagcccgccgccagaaaggccctggacagatag

SEQ ID NO: 91308 - DNA, 1149 bp, Artificial Sequence
  Description of Artificial Sequence: Synthetic coding sequence
atgagaaagctgttcgagaagtacggcaaggccggcgaggtgttcatccacaaggacaagggcttcggcttcatcagactggagaccagaaccctggccgagatcgccaaggtggagctggacaacatgcccctgagaggcaagcagctgagagtgagattcgcctgccacagcgccagcctgaccgtgagaaacctgccccagtacgtgagcaacgagctgctggaggaggccttcagcgtgttcggccaggtggagagagccgtggtgatcgtggacgacagaggcagacccagcggcaagggcatcgtggagttcagcggcaagcccgccgccagaaaggccctggacagatgcagcgagggcagcttcctgctgaccaccttccccagacccgtgaccgtggagcccatggaccagctggacgacgaggagggcctgcccgagaagctggtgatcaagaaccagcagttccacaaggagagagagcagccccccagattcgcccagcccggcagcttcgagtacgagtacgccatgagatggaaggccctgatcgagatggagaagcagcagcaggaccaggtggacagaaacatcaaggaggccagagagaagctggagatggagatggaggccgccagacacgagcaccaggtgatgctgatgagacaggacctgatgagaagacaggaggagctgagaagaatggaggagctgcacaaccaggaggtgcagaagagaaagcagctggagctgagacaggaggaggagagaagaagaagagaggaggagatgagaagacagcaggaggagatgatgagaagacagcaggagggcttcaagggcaccttccccgacgccagagagcaggagatcagaatgggccagatggccatgggcggcgccatgggcatcaacaacagaggcgccatgccccccgcccccgtgcccgccggcacccccgccccccccggccccgccaccatgatgcccgacggcaccctgggcctgaccccccccaccaccgagagattcggccaggccgccaccatggagggcatcggcgccatcggcggcaccccccccgccttcaacagagccgcccccggcgccgagttcgcccccaacaagagaagaagatactag

SEQ ID NO: 91309 - DNA, 3048 bp, Artificial Sequence
  Description of Artificial Sequence: Synthetic coding sequence
atgggcgccgagagaagactgctgagcatcaaggaggccttcagactggcccagcagccccaccagaaccaggccaagctggtggtggccctgagcagaacctacagaaccatggacgacaagaccgtgttccacgaggagttcatccactacctgaagtacgtgatggtggtgtacaagagagagcccgccgtggagagagtgatcgagttcgccgccaagttcgtgaccagcttccaccagagcgacatggaggacgacgaggaggaggaggacggcggcctgctgaactacctgttcaccttcctgctgaagagccacgaggccaacagcaacgccgtgagattcagagtgtgcctgctgatcaacaagctgctgggcagcatgcccgagaacgcccagatcgacgacgacgtgttcgacaagatcaacaaggccatgctgatcagactgaaggacaagatccccaacgtgagaatccaggccgtgctggccctgagcagactgcaggaccccaaggacgacgagtgccccgtggtgaacgcctacgccaccctgatcgagaacgacagcaaccccgaggtgagaagagccgtgctgagctgcatcgcccccagcgccaagaccctgcccaagatcgtgggcagaaccaaggacgtgaaggaggccgtgagaaagctggcctaccaggtgctggccgagaaggtgcacatgagagccatgagcatcgcccagagagtgatgctgctgcagcagggcctgaacgacagaagcgacgccgtgaagcaggccatgcagaagcacctgctgcagggctggctgagattcagcgagggcaacatcctggagctgctgcacagactggacgtggagaacagcagcgaggtggccgtgagcgtgctgaacgccctgttcagcatcacccccctgagcgagctggtgggcctgtgcaagaacaacgacggcagaaagctgatccccgtggagaccctgacccccgagatcgccctgtactggtgcgccctgtgcgagtacctgaagagcaagggcgacgagggcgaggagttcctggagcagatcctgcccgagcccgtggtgtacgccgactacctgctgagctacatccagagcatccccgtggtgaacgaggagcacagaggcgacttcagctacatcggcaacctgatgaccaaggagttcatcggccagcagctgatcctgatcatcaagagcctggacaccagcgaggagggcggcagaaagaagctgctggccgtgctgcaggagatcctgatcctgcccaccatccccatcagcctggtgagcttcctggtggagagactgctgcacatcatcatcgacgacaacaagagaacccagatcgtgaccgagatcatcagcgagatcagagcccccatcgtgaccgtgggcgtgaacaacgaccccgccgacgtgagaaagaaggagctgaagatggccgagatcaaggtgaagctgatcgaggccaaggaggccctggagaactgcatcaccctgcaggacttcaacagagccagcgagctgaaggaggagatcaaggccctggaggacgccagaatcaacctgctgaaggagaccgagcagctggagatcaaggaggtgcacatcgagaagaacgacgccgagaccctgcagaagtgcctgatcctgtgctacgagctgctgaagcagatgagcatcagcaccggcctgagcgccaccatgaacggcatcatcgagagcctgatcctgcccggcatcatcagcatccaccccgtggtgagaaacctggccgtgctgtgcctgggctgctgcggcctgcagaaccaggacttcgccagaaagcacttcgtgctgctgctgcaggtgctgcagatcgacgacgtgaccatcaagatcagcgccctgaaggccatcttcgaccagctgatgaccttcggcatcgagcccttcaagaccaagaagatcaagaccctgcactgcgagggcaccgagatcaacagcgacgacgagcaggagagcaaggaggtggaggagaccgccaccgccaagaacgtgctgaagctgctgagcgacttcctggacagcgaggtgagcgagctgagaaccggcgccgccgagggcctggccaagctgatgttcagcggcctgctggtgagcagcagaatcctgagcagactgatcctgctgtggtacaaccccgtgaccgaggaggacgtgcagctgagacactgcctgggcgtgttcttccccgtgttcgcctacgccagcagaaccaaccaggagtgcttcgaggaggccttcctgcccaccctgcagaccctggccaacgcccccgccagcagccccctggccgagatcgacatcaccaacgtggccgagctgctggtggacctgaccagacccagcggcctgaacccccaggccaagaccagccaggactaccaggccctgaccgtgcacgacaacctggccatgaagatctgcaacgagatcctgaccagcccctgcagccccgagatcagagtgtacaccaaggccctgagcagcctggagctgagcagccacctggccaaggacctgctggtgctgctgaacgagatcctggagcaggtgaaggacagaacctgcctgagagccctggagaagatcaagatccagctggagaagggcaacaaggagttcggcgaccaggccgaggccgcccaggacgccaccctgaccaccaccaccttccagaacgaggacgagaagaacaaggaggtgtacatgacccccctgagaggcgtgaaggccacccaggccagcaagagcacccagctgaagaccaacagaggccagagaaaggtgaccgtgagcgccagaaccaacagaagatgccagaccgccgaggccgacagcgagagcgaccacgaggtgcccgagcccgagagcgagatgaagatgagactgcccagaagagccaagaccgccgccctggagaagagcaagctgaacctggcccagttcctgaacgaggacctgagctag

SEQ ID NO: 91310 - DNA, 951 bp, Artificial Sequence
  Description of Artificial Sequence: Synthetic coding sequence
atgagcggcgacagcagcggcagaggccccgagggcagaggcagaggcagagacccccacagagacagaaccagaagcagaagcagaagcagaagccccctgagccccagaagcagaagaggcagcgccagagagagaagagaggcccccgagagacccagcctggaggacaccgagcccagcgacagcggcgacgagatgatggaccccgccagcctggaggccgaggccgaccagggcctgtgcagacagatcagacaccagtacagagccctgatcaacagcgtgcagcagaacagagaggacatcctgaacgccggcgacaagctgaccgaggtgctggaggaggccaacaccctgttcaacgaggtgagcagagccagagaggccgtgctggacgcccacttcctggtgctggccagcgacctgggcaaggagaaggccaagcagctgagaagcgacctgagcagcttcgacatgctgagatacgtggagaccctgctgacccacatgggcgtgaaccccctggaggccgaggagctgatcagagacgaggacagccccgacttcgagttcatcgtgtacgacagctggaagatcaccggcagaaccgccgagaacaccttcaacaagacccacaccttccacttcctgctgggcagcatctacggcgagtgccccgtgcccaagcccagagtggacagacccagaaaggtgcccgtgatccaggaggagagagccatgcccgcccagctgagaagaatggaggagagccaccaggaggccaccgagaaggaggtggagagaatcctgggcctgctgcagacctacttcagagaggacagagacagcctgaccctgagccccagactggagtgcagcggcaccatcagcacccactgcaacctgcacctgctggacagcagcaacagccccgccagcgccagctag

SEQ ID NO: 91311 - DNA, 1158 bp, Artificial Sequence
  Description of Artificial Sequence: Synthetic coding sequence
atgagcggcgacagcagcggcagaggccccgagggcagaggcagaggcagagacccccacagagacagaaccagaagcagaagcagaagcagaagccccctgagccccagaagcagaagaggcagcgccagagagagaagagaggcccccgagagacccagcctggaggacaccgagcccagcgacagcggcgacgagatgatggaccccgccagcctggaggccgaggccgaccagggcctgtgcagacagatcagacaccagtacagagccctgatcaacagcgtgcagcagaacagagaggacatcctgaacgccggcgacaagctgaccgaggtgctggaggaggccaacaccctgttcaacgaggtgagcagagccagagaggccgtgctggacgcccacttcctggtgctggccagcgacctgggcaaggagaaggccaagcagctgagaagcgacctgagcagcttcgacatgctgagatacgtggagaccctgctgacccacatgggcgtgaaccccctggaggccgaggagctgatcagagacgaggacagccccgacttcgagttcatcgtgtacgacagctggaagatcaccggcagaaccgccgagaacaccttcaacaagacccacaccttccacttcctgctgggcagcatctacggcgagtgccccgtgcccaagcccagagtggacagacccagaaaggtgcccgtgatccaggaggagagagccatgcccgcccagctgagaagaatggaggagagccaccaggaggccaccgagaaggaggtggagagaatcctgggcctgctgcagacctacttcagagaggaccccgacacccccatgagcttcttcgacttcgtggtggacccccacagcttccccagaaccgtggagaacatcttccacgtgagcttcatcatcagagacggcttcgccagaatcagactggaccaggacagactgcccgtgatcgagcccgtgagcatcaacgaggagaacgagggcttcgagcacaacacccaggtgagaaaccagggcatcatcgccctgagctacagagactgggaggagatcgtgaagaccttcgagatcagcgagcccgtgatcacccccagccagagacagcagaagcccagcgcctag

SEQ ID NO: 91312 - DNA, 519 bp, Artificial Sequence
  Description of Artificial Sequence: Synthetic coding sequence
atgctgagatacgtggagaccctgctgacccacatgggcgtgaaccccctggaggccgaggagctgatcagagacgaggacagccccgacttcgagttcatcgtgtacgacagctggaagatcaccggcagaaccgccgagaacaccttcaacaagacccacaccttccacttcctgctgggcagcatctacggcgagtgccccgtgcccaagcccagagtggacagacccagaaaggtgcccgtgatccaggaggagagagccatgcccgcccagctgagaagaatggaggagagccaccaggaggccaccgagaaggaggtggagagaatcctgggcctgctgcagacctacttcagagaggaccccgacacccccatgagcttcttcgacttcgtggtggacccccacagcttccccagaaccgtggagaacatcttccacgtgagcttcatcatcagagacggcttcgccagaatcagactggaccaggacagactgcccgtgatcggcaagtag

SEQ ID NO: 91313 - DNA, 2574 bp, Artificial Sequence
  Description of Artificial Sequence: Synthetic coding sequence
atggccaaggccaagaaggtgggcgccagaagaaaggccagcggcgcccccgccggcgccagaggcggccccgccaaggccaacagcaaccccttcgaggtgaaggtgaacagacagaagttccagatcctgggcagaaagaccagacacgacgtgggcctgcccggcgtgagcagagccagagccctgagaaagagaacccagaccctgctgaaggagtacaaggagagagacaagagcaacgtgttcagagacaagagattcggcgagtacaacagcaacatgagccccgaggagaagatgatgaagagattcgccctggagcagcagagacaccacgagaagaagagcatctacaacctgaacgaggacgaggagctgacccactacggccagagcctggccgacatcgagaagcacaacgacatcgtggacagcgacagcgacgccgaggacagaggcaccctgagcgccgagctgaccgccgcccacttcggcggcggcggcggcctgctgcacaagaagacccagcaggagggcgaggagagagagaagcccaagagcagaaaggagctgatcgaggagctgatcgccaagagcaagcaggagaagagagagagacaggcccagagagaggacgccctggagctgaccgagaagctggaccaggactggaaggagatccagaccctgctgagccacaagacccccaagagcgagaacagagacaagaaggagaagcccaagcccgacgcctacgacatgatggtgagagagctgggcttcgagatgaaggcccagcccagcaacagaatgaagaccgaggccgagctggccaaggaggagcaggagcacctgagaaagctggaggccgagagactgagaagaatgctgggcaaggacgaggacgagaacgtgaagaagcccaagcacatgagcgccgacgacctgaacgacggcttcgtgctggacaaggacgacagaagactgctgagctacaaggacggcaagatgaacgtggaggaggacgtgcaggaggagcagagcaaggaggccagcgaccccgagagcaacgaggaggagggcgacagcagcggcggcgaggacaccgaggagagcgacagccccgacagccacctggacctggagagcaacgtggagagcgaggaggagaacgagaagcccgccaaggagcagagacagacccccggcaagggcctgatcagcggcaaggagagagccggcaaggccaccagagacgagctgccctacaccttcgccgcccccgagagctacgaggagctgagaagcctgctgctgggcagaagcatggaggagcagctgctggtggtggagagaatccagaagtgcaaccaccccagcctggccgagggcaacaaggccaagctggagaagctgttcggcttcctgctggagtacgtgggcgacctggccaccgacgacccccccgacctgaccgtgatcgacaagctggtggtgcacctgtaccacctgtgccagatgttccccgagagcgccagcgacgccatcaagttcgtgctgagagacgccatgcacgagatggaggagatgatcgagaccaagggcagagccgccctgcccggcctggacgtgctgatctacctgaagatcaccggcctgctgttccccaccagcgacttctggcaccccgtggtgacccccgccctggtgtgcctgagccagctgctgaccaagtgccccatcctgagcctgcaggacgtggtgaagggcctgttcgtgtgctgcctgttcctggagtacgtggccctgagccagagattcatccccgagctgatcaacttcctgctgggcatcctgtacatcgccacccccaacaaggccagccagggcagcaccctggtgcaccccttcagagccctgggcaagaacagcgagctgctggtggtgagcgccagagaggacgtggccacctggcagcagagcagcctgagcctgagatgggccagcagactgagagcccccaccagcaccgaggccaaccacatcagactgagctgcctggccgtgggcctggccctgctgaagagatgcgtgctgatgtacggcagcctgcccagcttccacgccatcatgggccccctgcaggccctgctgaccgaccacctggccgactgcagccacccccaggagctgcaggagctgtgccagagcaccctgaccgagatggagagccagaagcagctgtgcagacccctgacctgcgagaagagcaagcccgtgcccctgaagctgttcacccccagactggtgaaggtgctggagttcggcagaaagcagggcagcagcaaggaggagcaggagagaaagagactgatccacaagcacaagagagagttcaagggcgccgtgagagagatcagaaaggacaaccagttcctggccagaatgcagctgagcgagatcatggagagagacgccgagagaaagagaaaggtgaagcagctgttcaacagcctggccacccaggagggcgagtggaaggccctgaagagaaagaagttcaagaagtag

SEQ ID NO: 91314 - DNA, 2421 bp, Artificial Sequence
  Description of Artificial Sequence: Synthetic coding sequence
atggccaaggccaagaaggtgggcgccagaagaaaggccagcggcgcccccgccggcgccagaggcggccccgccaaggccaacagcaaccccttcgaggtgaaggtgaacagacagaagttccagatcctgggcagaaagaccagacacgacgtgggcctgcccggcgtgagcagagccagagccctgagaaagagaacccagaccctgctgaaggagtacaaggagagagacaagagcaacgtgttcagagacaagagattcggcgagtacaacagcaacatgagccccgaggagaagatgatgaagagattcgccctggagcagcagagacaccacgagaagaagagcatctacaacctgaacgaggacgaggagctgacccactacggccagagcctggccgacatcgagaagcacaacgacatcgtggacagcgacagcgacgccgaggacagaggcaccctgagcgccgagctgaccgccgcccacttcggcggcggcggcggcctgctgcacaagaagacccagcaggagggcgaggagagagagaagcccaagagcagaaaggagctgatcgaggagctgatcgccaagagcaagcaggagaagagagagagacaggcccagagagaggacgccctggagctgaccgagaagctggaccaggactggaaggagatccagaccctgctgagccacaagacccccaagagcgagaacagagacaagaaggagaagcccaagcccgacgcctacgacatgatggtgagagagctgggcttcgagatgaaggcccagcccagcaacagaatgaagaccgaggccgagctggccaaggaggagcaggagcacctgagaaagctggaggccgagagactgagaagaatgctgggcaaggacgaggacgagaacgtgaagaagcccaagcacatgagcgccgacgacctgaacgacggcttcgtgctggacaaggacgacagaagactgctgagctacaaggacggcaagatgaacgtggaggaggacgtgcaggaggagcagagcaaggaggccagcgaccccgagagcaacgaggaggagggcgacagcagcggcggcgaggacaccgaggagagcgacagccccgacagccacctggacctggagagcaacgtggagagcgaggaggagaacgagaagcccgccaaggagcagagacagacccccggcaagggcctgatcagcggcaaggagagagccggcaaggccaccagagacgagctgccctacaccttcgccgcccccgagagctacgaggagctgagaagcctgctgctgggcagaagcatggaggagcagctgctggtggtggagagaatccagaagtgcaaccaccccagcctggccgagggcaacaaggccaagctggagaagctgttcggcttcctgctggagtacgtgggcgacctggccaccgacgacccccccgacctgaccgtgatcgacaagctggtggtgcacctgtaccacctgtgccagatgttccccgagagcgccagcgacgccatcaagttcgtgctgagagacgccatgcacgagatggaggagatgatcgagaccaagggcagagccgccctgcccggcctggacgtgctgatctacctgaagatcaccggcctgctgttccccaccagcgacttctggcaccccgtggtgacccccgccctggtgtgcctgagccagctgctgaccaagtgccccatcctgagcctgcaggacgtggtgaagggcctgttcgtgtgctgcctgttcctggagtacgtggccctgagccagagattcatccccgagctgatcaacttcctgctgggcatcctgtacatcgccacccccaacaaggccagccagggcagcaccctggtgcaccccttcagagccctgggcaagaacagcgagctgctggtggtgagcgccagagaggacgtggccacctggcagcagagcagcctgagcctgagatgggccagcagactgagagcccccaccagcaccgaggccaaccacatcagactgagctgcctggccgtgggcctggccctgctgaagagatgcgtgctgatgtacggcagcctgcccagcttccacgccatcatgggccccctgcaggccctgctgaccgaccacctggccgactgcagccacccccaggagctgcaggagctgtgccagagcaccctgaccgagatggagagccagaagcagctgtgcagacccctgacctgcgagaagagcaagcccgtgcccctgaagctgttcacccccagactggtgagcaacagcagaccccaggtgatccacctgccctggccccccaactacagatgcgagccccagcaccccgccaagaaggtgatcttcttcagagtgatcatgctgtag

SEQ ID NO: 91315 - DNA, 2574 bp, Artificial Sequence; identical to SEQ ID NO: 91313
  Description of Artificial Sequence: Synthetic coding sequence

SEQ ID NO: 91316 - DNA, 1728 bp, Artificial Sequence
  Description of Artificial Sequence: Synthetic coding sequence
atgaagagattcgccctggagcagcagagacaccacgagaagaagagcatctacaacctgaacgaggacgaggagctgacccactacggccagagcctggccgacatcgagaagcacaacgacatcgtggacagcgacagcgacgccgaggacagaggcaccctgagcgccgagctgaccgccgcccacttcggcggcggcggcggcctgctgcacaagaagacccagcaggagggcgaggagagagagaagcccaagagcagaaaggagctgatcgaggagctgatcgccaagagcaagcaggagaagagagagagacaggcccagagagaggacgccctggagctgaccgagaagctggaccaggactggaaggagatccagaccctgctgagccacaagacccccaagagcgagaacagagacaagaaggagaagcccaagcccgacgcctacgacatgatggtgagagagctgggcttcgagatgaaggcccagcccagcaacagaatgaagaccgaggccgagctggccaaggaggagcaggagcacctgagaaagctggaggccgagagactgagaagaatgctgggcaaggacgaggacgagaacgtgaagaagcccaagcacatgagcgccgacgacctgaacgacggcttcgtgctggacaaggacgacagaagactgctgagctacaaggacggcaagatgaacgtggaggaggacgtgcaggaggagcagagcaaggaggccagcgaccccgagagcaacgaggaggagggcgacagcagcggcggcgaggacaccgaggagagcgacagccccgacagccacctggacctggagagcaacgtggagagcgaggaggagaacgagaagcccgccaaggagcagagacagacccccggcaagggcctgatcagcggcaaggagagagccggcaaggccaccagagacgagctgccctacaccttcgccgcccccgagagctacgaggagctgagaagcctgctgctgggcagaagcatggaggagcagctgctggtggtggagagaatccagaagtgcaaccaccccagcctggccgagggcaacaaggccaagctggagaagctgttcggcttcctgctggagtacgtgggcgacctggccaccgacgacccccccgacctgaccgtgatcgacaagctggtggtgcacctgtaccacctgtgccagatgttccccgagagcgccagcgacgccatcaagttcgtgctgagagacgccatgcacgagatggaggagatgatcgagaccaagggcagagccgccctgcccggcctggacgtgctgatctacctgaagatcaccggcctgctgttccccaccagcgacttctggcaccccgtggtgacccccgccctggtgtgcctgagccagctgctgaccaagtgccccatcctgagcctgcaggacgtggtgaagggcctgttcgtgtgctgcctgttcctggagtacgtggccctgagccagagattcatccccgagctgatcaacttcctgctgggcatcctgtacatcgccacccccaacaaggccagccagggcagcaccctggtgcaccccttcagagccctgggcaagaacagcgagctgctggtggtgagcgccagagaggacgtggccacctggcagcagagcagcctgagcctgagatggtggagcagaatccccgacctgagatag

SEQ ID NO: 91317 - DNA, 2304 bp, Artificial Sequence
  Description of Artificial Sequence: Synthetic coding sequence
atgggcagaagaagcagaggcagaagactgcagcagcagcagagacccgaggacgccgaggacggcgccgagggcggcggcaagagaggcgaggccggctgggagggcggctaccccgagatcgtgaaggagaacaagctgttcgagcactactaccaggagctgaagatcgtgcccgagggcgagtggggccagttcatggacgccctgagagagcccctgcccgccaccctgagaatcaccggctacaagagccacgccaaggagatcctgcactgcctgaagaacaagtacttcaaggagctggaggacctggaggtggacggccagaaggtggaggtgccccagcccctgagctggtaccccgaggagctggcctggcacaccaacctgagcagaaagatcctgagaaagagcccccacctggagaagttccaccagttcctggtgagcgagaccgagagcggcaacatcagcagacaggaggccgtgagcatgatcccccccctgctgctgaacgtgagaccccaccacaagatcctggacatgtgcgccgcccccggcagcaagaccacccagctgatcgagatgctgcacgccgacatgaacgtgcccttccccgagggcttcgtgatcgccaacgacgtggacaacaagagatgctacctgctggtgcaccaggccaagagactgagcagcccctgcatcatggtggtgaaccacgacgccagcagcatccccagactgcagatcgacgtggacggcagaaaggagatcctgttctacgacagaatcctgtgcgacgtgccctgcagcggcgacggcaccatgagaaagaacatcgacgtgtggaagaagtggaccaccctgaacagcctgcagctgcacggcctgcagctgagaatcgccaccagaggcgccgagcagctggccgagggcggcagaatggtgtacagcacctgcagcctgaaccccatcgaggacgaggccgtgatcgccagcctgctggagaagagcgagggcgccctggagctggccgacgtgagcaacgagctgcccggcctgaagtggatgcccggcatcacccagtggaaggtgatgaccaaggacggccagtggttcaccgactgggacgccgtgccccacagcagacacacccagatcagacccaccatgttcccccccaaggaccccgagaagctgcaggccatgcacctggagagatgcctgagaatcctgccccaccaccagaacaccggcggcttcttcgtggccgtgctggtgaagaagagcagcatgccctggaacaagagacagcccaagctgcagggcaagagcgccgagaccagagagagcacccagctgagccccgccgacctgaccgagggcaagcccaccgaccccagcaagctggagagccccagcttcaccggcaccggcgacaccgagatcgcccacgccaccgaggacctggagaacaacggcagcaagaaggacggcgtgtgcggccccccccccagcaagaagatgaagctgttcggcttcaaggaggaccccttcgtgttcatccccgaggacgaccccctgttcccccccatcgagaagttctacgccctggaccccagcttccccagaatgaacctgctgaccagaaccaccgagggcaagaagagacagctgtacatggtgagcaaggagctgagaaacgtgctgctgaacaacagcgagaagatgaaggtgatcaacaccggcatcaaggtgtggtgcagaaacaacagcggcgaggagttcgactgcgccttcagactggcccaggagggcatctacaccctgtaccccttcatcaacagcagaatcatcaccgtgagcatggaggacgtgaagatcctgctgacccaggagaaccccttcttcagaaagctgagcagcgagacctacagccaggccaaggacctggccaagggcagcatcgtgctgaagtacgagcccgacagcgccaaccccgacgccctgcagtgccccatcgtgctgtgcggctggagaggcaaggccagcatcagaaccttcgtgcccaagaacgagagactgcactacctgagaatgatgggcctggaggtgctgggcgagaagaagaaggagggcgtgatcctgaccaacgagagcgccgccagcaccggccagcccgacaacgacgtgaccgagggccagagagccggcgagcccaacagccccgacgccgaggaggccaacagccccgacgtgaccgccggctgcgaccccgccggcgtgcacccccccagatag

SEQ ID NO: 91318 - DNA, 1596 bp, Artificial Sequence
  Description of Artificial Sequence: Synthetic coding sequence
atggtggtgaaccacgacgccagcagcatccccagactgcagatcgacgtggacggcagaaaggagatcctgttctacgacagaatcctgtgcgacgtgccctgcagcggcgacggcaccatgagaaagaacatcgacgtgtggaagaagtggaccaccctgaacagcctgcagctgcacggcctgcagctgagaatcgccaccagaggcgccgagcagctggccgagggcggcagaatggtgtacagcacctgcagcctgaaccccatcgaggacgaggccgtgatcgccagcctgctggagaagagcgagggcgccctggagctggccgacgtgagcaacgagctgcccggcctgaagtggatgcccggcatcacccagtggaaggtgatgaccaaggacggccagtggttcaccgactgggacgccgtgccccacagcagacacacccagatcagacccaccatgttcccccccaaggaccccgagaagctgcaggccatgcacctggagagatgcctgagaatcctgccccaccaccagaacaccggcggcttcttcgtggccgtgctggtgaagaagagcagcatgccctggaacaagagacagcccaagctgcagggcaagagcgccgagaccagagagagcacccagctgagccccgccgacctgaccgagggcaagcccaccgaccccagcaagctggagagccccagcttcaccggcaccggcgacaccgagatcgcccacgccaccgaggacctggagaacaacggcagcaagaaggacggcgtgtgcggccccccccccagcaagaagatgaagctgttcggcttcaaggaggaccccttcgtgttcatccccgaggacgaccccctgttcccccccatcgagaagttctacgccctggaccccagcttccccagaatgaacctgctgaccagaaccaccgagggcaagaagagacagctgtacatggtgagcaaggagctgagaaacgtgctgctgaacaacagcgagaagatgaaggtgatcaacaccggcatcaaggtgtggtgcagaaacaacagcggcgaggagttcgactgcgccttcagactggcccaggagggcatctacaccctgtaccccttcatcaacagcagaatcatcaccgtgagcatggaggacgtgaagatcctgctgacccaggagaaccccttcttcagaaagctgagcagcgagacctacagccaggccaaggacctggccaagggcagcatcgtgctgaagtacgagcccgacagcgccaaccccgacgccctgcagtgccccatcgtgctgtgcggctggagaggcaaggccagcatcagaaccttcgtgcccaagaacgagagactgcactacctgagaatgatgggcctggaggtgctgggcgagaagaagaaggagggcgtgatcctgaccaacgagagcgccgccagcaccggccagcccgacaacgacgtgaccgagggccagagagccggcgagcccaacagccccgacgccgaggaggccaacagccccgacgtgaccgccggctgcgaccccgccggcgtgcacccccccagatag

SEQ ID NO: 91319 - DNA, 2199 bp, Artificial Sequence
  Description of Artificial Sequence: Synthetic coding sequence
atgggcagaagaagcagaggcagaagactgcagcagcagcagagacccgaggacgccgaggacggcgccgagggcggcggcaagagaggcgaggccggctgggagggcggctaccccgagatcgtgaaggagaacaagctgttcgagcactactaccaggagctgaagatcgtgcccgagggcgagtggggccagttcatggacgccctgagagagcccctgcccgccaccctgagaatcaccggctacaagagataccccgaggagctggcctggcacaccaacctgagcagaaagatcctgagaaagagcccccacctggagaagttccaccagttcctggtgagcgagaccgagagcggcaacatcagcagacaggaggccgtgagcatgatcccccccctgctgctgaacgtgagaccccaccacaagatcctggacatgtgcgccgcccccggcagcaagaccacccagctgatcgagatgctgcacgccgacatgaacgtgcccttccccgagggcttcgtgatcgccaacgacgtggacaacaagagatgctacctgctggtgcaccaggccaagagactgagcagcccctgcatcatggtggtgaaccacgacgccagcagcatccccagactgcagatcgacgtggacggcagaaaggagatcctgttctacgacagaatcctgtgcgacgtgccctgcagcggcgacggcaccatgagaaagaacatcgacgtgtggaagaagtggaccaccctgaacagcctgcagctgcacggcctgcagctgagaatcgccaccagaggcgccgagcagctggccgagggcggcagaatggtgtacagcacctgcagcctgaaccccatcgaggacgaggccgtgatcgccagcctgctggagaagagcgagggcgccctggagctggccgacgtgagcaacgagctgcccggcctgaagtggatgcccggcatcacccagtggaaggtgatgaccaaggacggccagtggttcaccgactgggacgccgtgccccacagcagacacacccagatcagacccaccatgttcccccccaaggaccccgagaagctgcaggccatgcacctggagagatgcctgagaatcctgccccaccaccagaacaccggcggcttcttcgtggccgtgctggtgaagaagagcagcatgccctggaacaagagacagcccaagctgcagggcaagagcgccgagaccagagagagcacccagctgagccccgccgacctgaccgagggcaagcccaccgaccccagcaagctggagagccccagcttcaccggcaccggcgacaccgagatcgcccacgccaccgaggacctggagaacaacggcagcaagaaggacggcgtgtgcggccccccccccagcaagaagatgaagctgttcggcttcaaggaggaccccttcgtgttcatccccgaggacgaccccctgttcccccccatcgagaagttctacgccctggaccccagcttccccagaatgaacctgctgaccagaaccaccgagggcaagaagagacagctgtacatggtgagcaaggagctgagaaacgtgctgctgaacaacagcgagaagatgaaggtgatcaacaccggcatcaaggtgtggtgcagaaacaacagcggcgaggagttcgactgcgccttcagactggcccaggagggcatctacaccctgtaccccttcatcaacagcagaatcatcaccgtgagcatggaggacgtgaagatcctgctgacccaggagaaccccttcttcagaaagctgagcagcgagacctacagccaggccaaggacctggccaagggcagcatcgtgctgaagtacgagcccgacagcgccaaccccgacgccctgcagtgccccatcgtgctgtgcggctggagaggcaaggccagcatcagaaccttcgtgcccaagaacgagagactgcactacctgagaatgatgggcctggaggtgctgggcgagaagaagaaggagggcgtgatcctgaccaacgagagcgccgccagcaccggccagcccgacaacgacgtgaccgagggccagagagccggcgagcccaacagccccgacgccgaggaggccaacagccccgacgtgaccgccggctgcgaccccgccggcgtgcacccccccagatag

SEQ ID NO: 91320 - DNA, 1785 bp, Artificial Sequence
  Description of Artificial Sequence: Synthetic coding sequence
atggtgctgctgcacgtgctgttcgagcacgccgtgggctacgccctgctggccctgaaggaggtggaggagatcagcctgctgcagccccaggtggaggagagcgtgctgaacctgggcaagttccacagcatcgtgagactggtggccttctgccccttcgccagcagccaggtggccctggagaacgccaacgccgtgagcgagggcgtggtgcacgaggacctgagactgctgctggagacccacctgcccagcaagaagaagaaggtgctgctgggcgtgggcgaccccaagatcggcgccgccatccaggaggagctgggctacaactgccagaccggcggcgtgatcgccgagatcctgagaggcgtgagactgcacttccacaacctggtgaagggcctgaccgacctgagcgcctgcaaggcccagctgggcctgggccacagctacagcagagccaaggtgaagttcaacgtgaacagagtggacaacatgatcatccagagcatcagcctgctggaccagctggacaaggacatcaacaccttcagcatgagagtgagagagtggtacggctaccacttccccgagctggtgaagatcatcaacgacaacgccacctactgcagactggcccagttcatcggcaacagaagagagctgaacgaggacaagctggagaagctggaggagctgaccatggacggcgccaaggccaaggccatcctggacgccagcagaagcagcatgggcatggacatcagcgccatcgacctgatcaacatcgagagcttcagcagcagagtggtgagcctgagcgagtacagacagagcctgcacacctacctgagaagcaagatgagccaggtggcccccagcctgagcgccctgatcggcgaggccgtgggcgccagactgatcgcccacgccggcagcctgaccaacctggccaagtaccccgccagcaccgtgcagatcctgggcgccgagaaggccctgttcagagccctgaagaccagaggcaacacccccaagtacggcctgatcttccacagcaccttcatcggcagagccgccgccaagaacaagggcagaatcagcagatacctggccaacaagtgcagcatcgccagcagaatcgactgcttcagcgaggtgcccaccagcgtgttcggcgagaagctgagagagcaggtggaggagagactgagcttctacgagaccggcgagatccccagaaagaacctggacgtgatgaaggaggccatggtgcaggccgaggaggccgccgccgagatcaccagaaagctggagaagcaggagaagaagagactgaagaaggagaagaagagactggccgccctggccctggccagcagcgagaacagcagcagcacccccgaggagtgcgaggagatgagcgagaagcccaagaagaagaagaagcagaagccccaggaggtgccccaggagaacggcatggaggaccccagcatcagcttcagcaagcccaagaagaagaagagcttcagcaaggaggagctgatgagcagcgacctggaggagaccgccggcagcaccagcatccccaagagaaagaagagcacccccaaggaggagaccgtgaacgaccccgaggaggccggccacagaagcggcagcaagaagaagagaaagttcagcaaggaggagcccgtgagcagcggccccgaggaggccgtgggcaagagcagcagcaagaagaagaagaagttccacaaggccagccaggaggactag

SEQ ID NO: 91321 - DNA, 678 bp, Artificial Sequence
  Description of Artificial Sequence: Synthetic coding sequence
atggacatcagcgccatcgacctgatcaacatcgagagcttcagcagcagagtggtgagcctgagcgagtacagacagagcctgcacacctacctgagaagcaagatgagccaggtggcccccagcctgagcgccctgatcggcgaggccgtgggcgccagactgatcgcccacgccggcagcctgaccaacctggccaagtaccccgccagcaccgtgcagatcctgggcgccgagaaggccctgttcagagccctgaagaccagaggcaacacccccaagtacggcctgatcttccacagcaccttcatcggcagagccgccgccaagaacaagggcagaatcagcagatacctggccaacaagtgcagcatcgccagcagaatcgactgcttcagcgaggtgcccaccagcgtgttcggcgagaagctgagagagcaggtggaggagagactgagcttctacgagaccggcgagatccccagaaagaacctggacgtgatgaaggaggccatggtgcaggccgaggaggccgccgccgagatcaccagaaagctggagaagcaggagaagaagagactgaagaaggagaagaagagactggccgccctggccctggccagcagcgagaacagcagcagcacccccgaggagtgcgaggagggcgacagatgctag

SEQ ID NO: 91322 - DNA, 660 bp, Artificial Sequence
  Description of Artificial Sequence: Synthetic coding sequence
tgactgatcaacatcgagagcttcagcagcagagtggtgagcctgagcgagtacagacagagcctgcacacctacctgagaagcaagatgagccaggtggcccccagcctgagcgccctgatcggcgaggccgtgggcgccagactgatcgcccacgccggcagcctgaccaacctggccaagtaccccgccagcaccgtgcagatcctgggcgccgagaaggccctgttcagagccctgaagaccagaggcaacacccccaagtacggcctgatcttccacagcaccttcatcggcagagccgccgccaagaacaagggcagaatcagcagatacctggccaacaagtgcagcatcgccagcagaatcgactgcttcagcgaggtgcccaccagcgtgttcggcgagaagctgagagagcaggtggaggagagactgagcttctacgagaccggcgagatccccagaaagaacctggacgtgatgaaggaggccatggtgcaggccgaggaggccgccgccgagatcaccagaaagctggagaagcaggagaagaagagactgaagaaggagaagaagagactggccgccctggccctggccagcagcgagaacagcagcagcacccccgaggagtgcgaggagggcgacagatgctag

SEQ ID NO: 91323 - DNA, 846 bp, Artificial Sequence
  Description of Artificial Sequence: Synthetic coding sequence
atggtgctgctgcacgtgctgttcgagcacgccgtgggctacgccctgctggccctgaaggaggtggaggagatcagcctgctgcagccccaggtggaggagagcgtgctgaacctgggcaagttccacagcatcgtgagactggtggccttctgccccttcgccagcagccaggtggccctggagaacgccaacgccgtgagcgagggcgtggtgcacgaggacctgagactgctgctggagacccacctgcccagcaagaagaagaaggtgctgctgggcgtgggcgaccccaagatcggcgccgccatccaggaggagctgggctacaactgccagaccggcggcgtgatcgccgagatcctgagaggcgtgagactgcacttccacaacctggtgaagggcctgaccgacctgagcgcctgcaaggcccagctgggcctgggccacagctacagcagagccaaggtgaagttcaacgtgaacagagtggacaacatgatcatccagagcatcagcctgctggaccagctggacaaggacatcaacaccttcagcatgagagtgagacagagcagatgcggcgagggcaaggccgtggccctgtggttcctgatgaagcagctgggccagggcgtgaccgtggccctgtgcagagagtggtacggctaccacttccccgagctggtgaagatcatcaacgacaacgccacctactgcagactggcccagttcatcggcaacagaagagagctgaacgaggacaagctggagaagctggaggagctgaccatggacggcgccaaggccaaggccatcctggacgccagcagaagcagcatgtag

SEQ ID NO: 91324 - DNA, 402 bp, Artificial Sequence
  Description of Artificial Sequence: Synthetic coding sequence
atgagaaagcacgtgctggccgccagcttcagcatgctgagcctgctggtgatcatgggcgacaccgacagcaagaccgacagcagcttcatcatggacagcgaccccagaagatgcatgagacaccactacgtggacagcatcagccaccccctgtacaagtgcagcagcaagatggtgctgctggccagatgcgagggccactgcagccaggccagcagaagcgagcccctggtgagcttcagcaccgtgctgaagcagcccttcagaagcagctgccactgctgcagaccccagaccagcaagctgaaggccctgagactgagatgcagcggcggcatgagactgaccgccacctacagatacatcctgagctgccactgcgaggagtgcaacagctag

SEQ ID NO: 91325 - DNA, 7416 bp, Artificial Sequence
  Description of Artificial Sequence: Synthetic coding sequence
atgcccgccctgagacccgccctgctgtgggccctgctggccctgtggctgtgctgcgccgcccccgcccacgccctgcagtgcagagacggctacgagccctgcgtgaacgagggcatgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcccccagggcttcaccggccagtactgcgacagcctgtacgtgccctgcgcccccagcccctgcgtgaacggcggcacctgcagacagaccggcgacttcaccttcgagtgcaactgcctgcccggcttcgagggcagcacctgcgagagaaacatcgacgactgccccaaccacagatgccagaacggcggcgtgtgcgtggacggcgtgaacacctacaactgcagatgccccccccagtggaccggccagttctgcaccgaggacgtggacgagtgcctgctgcagcccaacgcctgccagaacggcggcacctgcgccaacagaaacggcggctacggctgcgtgtgcgtgaacggctggagcggcgacgactgcagcgagaacatcgacgactgcgccttcgccagctgcacccccggcagcacctgcatcgacagagtggccagcttcagctgcatgtgccccgagggcaaggccggcctgctgtgccacctggacgacgcctgcatcagcaacccctgccacaagggcgccctgtgcgacaccaaccccctgaacggccagtacatctgcacctgcccccagggctacaagggcgccgactgcaccgaggacgtggacgagtgcgccatggccaacagcaacccctgcgagcacgccggcaagtgcgtgaacaccgacggcgccttccactgcgagtgcctgaagggctacgccggccccagatgcgagatggacatcaacgagtgccacagcgacccctgccagaacgacgccacctgcctggacaagatcggcggcttcacctgcctgtgcatgcccggcttcaagggcgtgcactgcgagctggagatcaacgagtgccagagcaacccctgcgtgaacaacggccagtgcgtggacaaggtgaacagattccagtgcctgtgcccccccggcttcaccggccccgtgtgccagatcgacatcgacgactgcagcagcaccccctgcctgaacggcgccaagtgcatcgaccaccccaacggctacgagtgccagtgcgccaccggcttcaccggcgtgctgtgcgaggagaacatcgacaactgcgaccccgacccctgccaccacggccagtgccaggacggcatcgacagctacacctgcatctgcaaccccggctacatgggcgccatctgcagcgaccagatcgacgagtgctacagcagcccctgcctgaacgacggcagatgcatcgacctggtgaacggctaccagtgcaactgccagcccggcaccagcggcgtgaactgcgagatcaacttcgacgactgcgccagcaacccctgcatccacggcatctgcatggacggcatcaacagatacagctgcgtgtgcagccccggcttcaccggccagagatgcaacatcgacatcgacgagtgcgccagcaacccctgcagaaagggcgccacctgcatcaacggcgtgaacggcttcagatgcatctgccccgagggcccccaccaccccagctgctacagccaggtgaacgagtgcctgagcaacccctgcatccacggcaactgcaccggcggcctgagcggctacaagtgcctgtgcgacgccggctgggtgggcatcaactgcgaggtggacaagaacgagtgcctgagcaacccctgccagaacggcggcacctgcgacaacctggtgaacggctacagatgcacctgcaagaagggcttcaagggctacaactgccaggtgaacatcgacgagtgcgccagcaacccctgcctgaaccagggcacctgcttcgacgacatcagcggctacacctgccactgcgtgctgccctacaccggcaagaactgccagaccgtgctggccccctgcagccccaacccctgcgagaacgccgccgtgtgcaaggagagccccaacttcgagagctacacctgcctgtgcgcccccggctggcagggccagagatgcaccatcgacatcgacgagtgcatcagcaagccctgcatgaaccacggcctgtgccacaacacccagggcagctacatgtgcgagtgcccccccggcttcagcggcatggactgcgaggaggacatcgacgactgcctggccaacccctgccagaacggcggcagctgcatggacggcgtgaacaccttcagctgcctgtgcctgcccggcttcaccggcgacaagtgccagaccgacatgaacgagtgcctgagcgagccctgcaagaacggcggcacctgcagcgactacgtgaacagctacacctgcaagtgccaggccggcttcgacggcgtgcactgcgagaacaacatcaacgagtgcaccgagagcagctgcttcaacggcggcacctgcgtggacggcatcaacagcttcagctgcctgtgccccgtgggcttcaccggcagcttctgcctgcacgagatcaacgagtgcagcagccacccctgcctgaacgagggcacctgcgtggacggcctgggcacctacagatgcagctgccccctgggctacaccggcaagaactgccagaccctggtgaacctgtgcagcagaagcccctgcaagaacaagggcacctgcgtgcagaagaaggccgagagccagtgcctgtgccccagcggctgggccggcgcctactgcgacgtgcccaacgtgagctgcgacatcgccgccagcagaagaggcgtgctggtggagcacctgtgccagcacagcggcgtgtgcatcaacgccggcaacacccactactgccagtgccccctgggctacaccggcagctactgcgaggagcagctggacgagtgcgccagcaacccctgccagcacggcgccacctgcagcgacttcatcggcggctacagatgcgagtgcgtgcccggctaccagggcgtgaactgcgagtacgaggtggacgagtgccagaaccagccctgccagaacggcggcacctgcatcgacctggtgaaccacttcaagtgcagctgcccccccggcaccagaggcctgctgtgcgaggagaacatcgacgactgcgccagaggcccccactgcctgaacggcggccagtgcatggacagaatcggcggctacagctgcagatgcctgcccggcttcgccggcgagagatgcgagggcgacatcaacgagtgcctgagcaacccctgcagcagcgagggcagcctggactgcatccagctgaccaacgactacctgtgcgtgtgcagaagcgccttcaccggcagacactgcgagaccttcgtggacgtgtgcccccagatgccctgcctgaacggcggcacctgcgccgtggccagcaacatgcccgacggcttcatctgcagatgcccccccggcttcagcggcgccagatgccagagcagctgcggccaggtgaagtgcagaaagggcgagcagtgcgtgcacaccgccagcggccccagatgcttctgccccagccccagagactgcgagagcggctgcgccagcagcccctgccagcacggcggcagctgccacccccagagacagcccccctactacagctgccagtgcgccccccccttcagcggcagcagatgcgagctgtacaccgccccccccagcaccccccccgccacctgcctgagccagtactgcgccgacaaggccagagacggcgtgtgcgacgaggcctgcaacagccacgcctgccagtgggacggcggcgactgcagcctgaccatggagaacccctgggccaactgcagcagccccctgccctgctgggactacatcaacaaccagtgcgacgagctgtgcaacaccgtggagtgcctgttcgacaacttcgagtgccagggcaacagcaagacctgcaagtacgacaagtactgcgccgaccacttcaaggacaaccactgcgaccagggctgcaacagcgaggagtgcggctgggacggcctggactgcgccgccgaccagcccgagaacctggccgagggcaccctggtgatcgtggtgctgatgccccccgagcagctgctgcaggacgccagaagcttcctgagagccctgggcaccctgctgcacaccaacctgagaatcaagagagacagccagggcgagctgatggtgtacccctactacggcgagaagagcgccgccatgaagaagcagagaatgaccagaagaagcctgcccggcgagcaggagcaggaggtggccggcagcaaggtgttcctggagatcgacaacagacagtgcgtgcaggacagcgaccactgcttcaagaacaccgacgccgccgccgccctgctggccagccacgccatccagggcaccctgagctaccccctggtgagcgtggtgagcgagagcctgacccccgagagaacccagctgctgtacctgctggccgtggccgtggtgatcatcctgttcatcatcctgctgggcgtgatcatggccaagagaaagagaaagcacggcagcctgtggctgcccgagggcttcaccctgagaagagacgccagcaaccacaagagaagagagcccgtgggccaggacgccgtgggcctgaagaacctgagcgtgcaggtgagcgaggccaacctgatcggcaccggcaccagcgagcactgggtggacgacgagggcccccagcccaagaaggtgaaggccgaggacgaggccctgctgagcgaggaggacgaccccatcgacagaagaccctggacccagcagcacctggaggccgccgacatcagaagaacccccagcctggccctgacccccccccaggccgagcaggaggtggacgtgctggacgtgaacgtgagaggccccgacggctgcacccccctgatgctggccagcctgagaggcggcagcagcgacctgagcgacgaggacgaggacgccgaggacagcagcgccaacatcatcaccgacctggtgtaccagggcgccagcctgcaggcccagaccgacagaaccggcgagatggccctgcacctggccgccagatacagcagagccgacgccgccaagagactgctggacgccggcgccgacgccaacgcccaggacaacatgggcagatgccccctgcacgccgccgtggccgccgacgcccagggcgtgttccagatcctgatcagaaacagagtgaccgacctggacgccagaatgaacgacggcaccacccccctgatcctggccgccagactggccgtggagggcatggtggccgagctgatcaactgccaggccgacgtgaacgccgtggacgaccacggcaagagcgccctgcactgggccgccgccgtgaacaacgtggaggccaccctgctgctgctgaagaacggcgccaacagagacatgcaggacaacaaggaggagacccccctgttcctggccgccagagagggcagctacgaggccgccaagatcctgctggaccacttcgccaacagagacatcaccgaccacatggacagactgcccagagacgtggccagagacagaatgcaccacgacatcgtgagactgctggacgagtacaacgtgacccccagcccccccggcaccgtgctgaccagcgccctgagccccgtgatctgcggccccaacagaagcttcctgagcctgaagcacacccccatgggcaagaagagcagaagacccagcgccaagagcaccatgcccaccagcctgcccaacctggccaaggaggccaaggacgccaagggcagcagaagaaagaagagcctgagcgagaaggtgcagctgagcgagagcagcgtgaccctgagccccgtggacagcctggagagcccccacacctacgtgagcgacaccaccagcagccccatgatcaccagccccggcatcctgcaggccagccccaaccccatgctggccaccgccgccccccccgcccccgtgcacgcccagcacgccctgagcttcagcaacctgcacgagatgcagcccctggcccacggcgccagcaccgtgctgcccagcgtgagccagctgctgagccaccaccacatcgtgagccccggcagcggcagcgccggcagcctgagcagactgcaccccgtgcccgtgcccgccgactggatgaacagaatggaggtgaacgagacccagtacaacgagatgttcggcatggtgctggcccccgccgagggcacccaccccggcatcgccccccagagcagaccccccgagggcaagcacatcaccacccccagagagcccctgccccccatcgtgaccttccagctgatccccaagggcagcatcgcccagcccgccggcgccccccagccccagagcacctgcccccccgccgtggccggccccctgcccaccatgtaccagatccccgagatggccagactgcccagcgtggccttccccaccgccatgatgccccagcaggacggccaggtggcccagaccatcctgcccgcctaccaccccttccccgccagcgtgggcaagtaccccaccccccccagccagcacagctacgccagcagcaacgccgccgagagaacccccagccacagcggccacctgcagggcgagcacccctacctgacccccagccccgagagccccgaccagtggagcagcagcagcccccacagcgccagcgactggagcgacgtgaccaccagccccacccccggcggcgccggcggcggccagagaggccccggcacccacatgagcgagcccccccacaacaacatgcaggtgtacgcctag

SEQ ID NO: 91326 - DNA, 711 bp, Artificial Sequence
  Description of Artificial Sequence: Synthetic coding sequence
atgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcccccagggcttcaccggccagtactgcgacagcctgtacgtgccctgcgcccccagcccctgcgtgaacggcggcacctgcagacagaccggcgacttcaccttcgagtgcaactgcctgcccgagaccgtgagaagaggcaccgagctgtgggagagagacagacaggtgtggaacggcaaggagcacgacgagaactag

SEQ ID NO: 91327 - DNA, 720 bp, Artificial Sequence
  Description of Artificial Sequence: Synthetic coding sequence
tgcagagacggctacgagccctgcgtgaacgagggcatgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcccccagggcttcaccggccagtactgcgacagcctgtacgtgccctgcgcccccagcccctgcgtgaacggcggcacctgcagacagaccggcgacttcaccttcgagtgcaactgcctgcccgcctgctggcccagaacccccgacctgagactgctgctgggcgagaagtag

SEQ ID NO: 91328 - DNA, 672 bp, Artificial Sequence
  Description of Artificial Sequence: Synthetic coding sequence
atgtggatctgccccggcggcggcggcggcggcggcggcggcggcgacagagaggacgccagaccccccctgtgctgcggcagatgctggagaagcggctgcgccgccagaccccccagaatggtgagcatcggcctgagaggcgccgtgagaggcgccagaggctgccacctgggcagacccttcagccccagcgtgctgctgtgcgtgggcagacccggcagcgccgccggcgccgagagaggccacagcctgggcagccaggagttcggccacagaagaggccccctgccctggtgccccgccaacagaagaggcagcccccccagcgcccccagaggccccggccccctgaccagactgctgggcagaagagaggccggcagcaagagccagaagctgctgttcagaagcgccagagtgcagggcggcggccagttctgccccagcggcagcgccttcctgggcgtggagagagagcccaccgccggcctgggcggcgccgagagaagaaacgccagattctggagaggcgagagaggccagggcagacaggccaagagacccgcccccagccagcccgccagccccctgcccggcggcggcacctgggccggctgcgtgggcctggtgtggatgggcaccggcttctgcggcgcccccgagttctag

SEQ ID NO: 91329 - DNA, 2592 bp, Artificial Sequence
  Description of Artificial Sequence: Synthetic coding sequence
atgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcccccagggcttcaccggccagtactgcgacagcctgtacgtgccctgcgcccccagcccctgcgtgaacggcggcacctgcagacagaccggcgacttcaccttcgagtgcaactgcctgcccggcttcgagggcagcacctgcgagagaaacatcgacgactgccccaaccacagatgccagaacggcggcgtgtgcgtggacggcgtgaacacctacaactgcagatgccccccccagtggaccggccagttctgcaccgaggacgtggacgagtgcctgctgcagcccaacgcctgccagaacggcggcacctgcgccaacagaaacggcggctacggctgcgtgtgcgtgaacggctggagcggcgacgactgcagcgagaacatcgacgactgcgccttcgccagctgcacccccggcagcacctgcatcgacagagtggccagcttcagctgcatgtgccccgagggcaaggccggcctgctgtgccacctggacgacgcctgcatcagcaacccctgccacaagggcgccctgtgcgacaccaaccccctgaacggccagtacatctgcacctgcccccagggctacaagggcgccgactgcaccgaggacgtggacgagtgcgccatggccaacagcaacccctgcgagcacgccggcaagtgcgtgaacaccgacggcgccttccactgcgagtgcctgaagggctacgccggccccagatgcgagatggacatcaacgagtgccacagcgacccctgccagaacgacgccacctgcctggacaagatcggcggcttcacctgcctgtgcatgcccggcttcaagggcgtgcactgcgagctggagatcaacgagtgccagagcaacccctgcgtgaacaacggccagtgcgtggacaaggtgaacagattccagtgcctgtgcccccccggcttcaccggccccgtgtgccagatcgacatcgacgactgcagcagcaccccctgcctgaacggcgccaagtgcatcgaccaccccaacggctacgagtgccagtgcgccaccggcttcaccggcgtgctgtgcgaggagaacatcgacaactgcgaccccgacccctgccaccacggccagtgccaggacggcatcgacagctacacctgcatctgcaaccccggctacatgggcgccatctgcagcgaccagatcgacgagtgctacagcagcccctgcctgaacgacggcagatgcatcgacctggtgaacggctaccagtgcaactgccagcccggcaccagcggcgtgaactgcgagatcaacttcgacgactgcgccagcaacccctgcatccacggcatctgcatggacggcatcaacagatacagctgcgtgtgcagccccggcttcaccggccagagatgcaacatcgacatcgacgagtgcgccagcaacccctgcagaaagggcgccacctgcatcaacggcgtgaacggcttcagatgcatctgccccgagggcccccaccaccccagctgctacagccaggtgaacgagtgcctgagcaacccctgcatccacggcaactgcaccggcggcctgagcggctacaagtgcctgtgcgacgccggctgggtgggcatcaactgcgaggtggacaagaacgagtgcctgagcaacccctgccagaacggcggcacctgcgacaacctggtgaacggctacagatgcacctgcaagaagggcttcaagggctacaactgccaggtgaacatcgacgagtgcgccagcaacccctgcctgaaccagggcacctgcttcgacgacatcagcggctacacctgccactgcgtgctgccctacaccggcggcagctggagataccagcagggccccgagggcatcctggacctggccctgagcgtgcccgagagccagtgccccggcctgtggggctgcaacgccccccccagagcccacagcagcgtggtgctgcccgccttcaccgactggatcctgagcttcgaggagaccctgtggccccccaagatgcaggtggtggacagccacctgcccaccctgtacttcagcatctag

SEQ ID NO: 91330 - DNA, 6966 bp, Artificial Sequence
  Description of Artificial Sequence: Synthetic coding sequence
atgggccccggcgccagaggcagaagaagaagaagaagacccatgagccccccccccccccccccccccgtgagagccctgcccctgctgctgctgctggccggccccggcgccgccgcccccccctgcctggacggcagcccctgcgccaacggcggcagatgcacccagctgcccagcagagaggccgcctgcctgtgcccccccggctgggtgggcgagagatgccagctggaggacccctgccacagcggcccctgcgccggcagaggcgtgtgccagagcagcgtggtggccggcaccgccagattcagctgcagatgccccagaggcttcagaggccccgactgcagcctgcccgacccctgcctgagcagcccctgcgcccacggcgccagatgcagcgtgggccccgacggcagattcctgtgcagctgcccccccggctaccagggcagaagctgcagaagcgacgtggacgagtgcagagtgggcgagccctgcagacacggcggcacctgcctgaacacccccggcagcttcagatgccagtgccccgccggctacaccggccccctgtgcgagaaccccgccgtgccctgcgcccccagcccctgcagaaacggcggcacctgcagacagagcggcgacctgacctacgactgcgcctgcctgcccggcttcgagggccagaactgcgaggtgaacgtggacgactgccccggccacagatgcctgaacggcggcacctgcgtggacggcgtgaacacctacaactgccagtgcccccccgagtggaccggccagttctgcaccgaggacgtggacgagtgccagctgcagcccaacgcctgccacaacggcggcacctgcttcaacaccctgggcggccacagctgcgtgtgcgtgaacggctggaccggcgagagctgcagccagaacatcgacgactgcgccaccgccgtgtgcttccacggcgccacctgccacgacagagtggccagcttctactgcgcctgccccatgggcaagaccggcctgctgtgccacctggacgacgcctgcgtgagcaacccctgccacgaggacgccatctgcgacaccaaccccgtgaacggcagagccatctgcacctgcccccccggcttcaccggcggcgcctgcgaccaggacgtggacgagtgcagcatcggcgccaacccctgcgagcacctgggcagatgcgtgaacacccagggcagcttcctgtgccagtgcggcagaggctacaccggccccagatgcgagaccgacgtgaacgagtgcctgagcggcccctgcagaaaccaggccacctgcctggacagaatcggccagttcacctgcatctgcatggccggcttcaccggcacctactgcgaggtggacatcgacgagtgccagagcagcccctgcgtgaacggcggcgtgtgcaaggacagagtgaacggcttcagctgcacctgccccagcggcttcagcggcagcacctgccagctggacgtggacgagtgcgccagcaccccctgcagaaacggcgccaagtgcgtggaccagcccgacggctacgagtgcagatgcgccgagggcttcgagggcaccctgtgcgacagaaacgtggacgactgcagccccgacccctgccaccacggcagatgcgtggacggcatcgccagcttcagctgcgcctgcgcccccggctacaccggcaccagatgcgagagccaggtggacgagtgcagaagccagccctgcagacacggcggcaagtgcctggacctggtggacaagtacctgtgcagatgccccagcggcaccaccggcgtgaactgcgaggtgaacatcgacgactgcgccagcaacccctgcaccttcggcgtgtgcagagacggcatcaacagatacgactgcgtgtgccagcccggcttcaccggccccctgtgcaacgtggagatcaacgagtgcgccagcagcccctgcggcgagggcggcagctgcgtggacggcgagaacggcttcagatgcctgtgcccccccggcagcctgccccccctgtgcctgccccccagccacccctgcgcccacgagccctgcagccacggcatctgctacgacgcccccggcggcttcagatgcgtgtgcgagcccggctggagcggccccagatgcagccagagcctggccagagacgcctgcgagagccagccctgcagagccggcggcacctgcagcagcgacggcatgggcttccactgcacctgcccccccggcgtgcagggcagacagtgcgagctgctgagcccctgcacccccaacccctgcgagcacggcggcagatgcgagagcgcccccggccagctgcccgtgtgcagctgcccccagggctggcagggccccagatgccagcaggacgtggacgagtgcgccggccccgccccctgcggcccccacggcatctgcaccaacctggccggcagcttcagctgcacctgccacggcggctacaccggccccagctgcgaccaggacatcaacgactgcgaccccaacccctgcctgaacggcggcagctgccaggacggcgtgggcagcttcagctgcagctgcctgcccggcttcgccggccccagatgcgccagagacgtggacgagtgcctgagcaacccctgcggccccggcacctgcaccgaccacgtggccagcttcacctgcacctgcccccccggctacggcggcttccactgcgagcaggacctgcccgactgcagccccagcagctgcttcaacggcggcacctgcgtggacggcgtgaacagcttcagctgcctgtgcagacccggctacaccggcgcccactgccagcacgaggccgacccctgcctgagcagaccctgcctgcacggcggcgtgtgcagcgccgcccaccccggcttcagatgcacctgcctggagagcttcaccggcccccagtgccagaccctggtggactggtgcagcagacagccctgccagaacggcggcagatgcgtgcagaccggcgcctactgcctgtgcccccccggctggagcggcagactgtgcgacatcagaagcctgccctgcagagaggccgccgcccagatcggcgtgagactggagcagctgtgccaggccggcggccagtgcgtggacgaggacagcagccactactgcgtgtgccccgagggcagaaccggcagccactgcgagcaggaggtggacccctgcctggcccagccctgccagcacggcggcacctgcagaggctacatgggcggctacatgtgcgagtgcctgcccggctacaacggcgacaactgcgaggacgacgtggacgagtgcgccagccagccctgccagcacggcggcagctgcatcgacctggtggccagatacctgtgcagctgcccccccggcaccctgggcgtgctgtgcgagatcaacgaggacgactgcggccccggcccccccctggacagcggccccagatgcctgcacaacggcacctgcgtggacctggtgggcggcttcagatgcacctgcccccccggctacaccggcctgagatgcgaggccgacatcaacgagtgcagaagcggcgcctgccacgccgcccacaccagagactgcctgcaggaccccggcggcggcttcagatgcctgtgccacgccggcttcagcggccccagatgccagaccgtgctgagcccctgcgagagccagccctgccagcacggcggccagtgcagacccagccccggccccggcggcggcctgaccttcacctgccactgcgcccagcccttctggggccccagatgcgagagagtggccagaagctgcagagagctgcagtgccccgtgggcgtgccctgccagcagacccccagaggccccagatgcgcctgcccccccggcctgagcggccccagctgcagaagcttccccggcagcccccccggcgccagcaacgccagctgcgccgccgccccctgcctgcacggcggcagctgcagacccgcccccctggcccccttcttcagatgcgcctgcgcccagggctggaccggccccagatgcgaggcccccgccgccgcccccgaggtgagcgaggagcccagatgccccagagccgcctgccaggccaagagaggcgaccagagatgcgacagagagtgcaacagccccggctgcggctgggacggcggcgactgcagcctgagcgtgggcgacccctggagacagtgcgaggccctgcagtgctggagactgttcaacaacagcagatgcgaccccgcctgcagcagccccgcctgcctgtacgacaacttcgactgccacgccggcggcagagagagaacctgcaaccccgtgtacgagaagtactgcgccgaccacttcgccgacggcagatgcgaccagggctgcaacaccgaggagtgcggctgggacggcctggactgcgccagcgaggtgcccgccctgctggccagaggcgtgctggtgctgaccgtgctgctgccccccgaggagctgctgagaagcagcgccgacttcctgcagagactgagcgccatcctgagaaccagcctgagattcagactggacgcccacggccaggccatggtgttcccctaccacagacccagccccggcagcgagcccagagccagaagagagctggcccccgaggtgatcggcagcgtggtgatgctggagatcgacaacagactgtgcctgcagagccccgagaacgaccactgcttccccgacgcccagagcgccgccgactacctgggcgccctgagcgccgtggagagactggacttcccctaccccctgagagacgtgagaggcgagcccctggagccccccgagcccagcgtgcccctgctgcccctgctggtggccggcgccgtgctgctgctggtgatcctggtgctgggcgtgatggtggccagaagaaagagagagcacagcaccctgtggttccccgagggcttcagcctgcacaaggacgtggccagcggccacaagggcagaagagagcccgtgggccaggacgccctgggcatgaagaacatggccaagggcgagagcctgatgggcgaggtggccaccgactggatggacaccgagtgccccgaggccaagagactgaaggtggaggagcccggcatgggcgccgaggaggccgtggactgcagacagtggacccagcaccacctggtggccgccgacatcagagtggcccccgccatggccctgacccccccccagggcgacgccgacgccgacggcatggacgtgaacgtgagaggccccgacggcttcacccccctgatgctggccagcttctgcggcggcgccctggagcccatgcccaccgaggaggacgaggccgacgacaccagcgccagcatcatcagcgacctgatctgccagggcgcccagctgggcgccagaaccgacagaaccggcgagaccgccctgcacctggccgccagatacgccagagccgacgccgccaagagactgctggacgccggcgccgacaccaacgcccaggaccacagcggcagaacccccctgcacaccgccgtgaccgccgacgcccagggcgtgttccagatcctgatcagaaacagaagcaccgacctggacgccagaatggccgacggcagcaccgccctgatcctggccgccagactggccgtggagggcatggtggaggagctgatcgccagccacgccgacgtgaacgccgtggacgagctgggcaagagcgccctgcactgggccgccgccgtgaacaacgtggaggccaccctggccctgctgaagaacggcgccaacaaggacatgcaggacagcaaggaggagacccccctgttcctggccgccagagagggcagctacgaggccgccaagctgctgctggaccacttcgccaacagagagatcaccgaccacctggacagactgcccagagacgtggcccaggagagactgcaccaggacatcgtgagactgctggaccagcccagcggccccagaagcccccccggcccccacggcctgggccccctgctgtgcccccccggcgccttcctgcccggcctgaaggccgcccagagcggcagcaagaagagcagaagaccccccggcaaggccggcctgggcccccagggccccagaggcagaggcaagaagctgaccctggcctgccccggccccctggccgacagcagcgtgaccctgagccccgtggacagcctggacagccccagacccttcggcggcccccccgccagccccggcggcttccccctggagggcccctacgccgccgccaccgccaccgccgtgagcctggcccagctgggcggccccggcagagccggcctgggcagacagccccccggcggctgcgtgctgagcctgggcctgctgaaccccgtggccgtgcccctggactgggccagactgcccccccccgccccccccggccccagcttcctgctgcccctggcccccggcccccagctgctgaaccccggcacccccgtgagcccccaggagagaccccccccctacctggccgtgcccggccacggcgaggagtaccccgccgccggcgcccacagcagcccccccaaggccagattcctgagagtgcccagcgagcacccctacctgacccccagccccgagagccccgagcactgggccagccccagcccccccagcctgagcgactggagcgagagcacccccagccccgccaccgccaccggcgccatggccaccaccaccggcgccctgcccgcccagcccctgcccctgagcgtgcccagcagcctggcccaggcccagacccagctgggcccccagcccgaggtgacccccaagagacaggtgctggcctag

SEQ ID NO: 91331 - DNA, 3867 bp, Artificial Sequence
  Description of Artificial Sequence: Synthetic coding sequence
gccgccatgggccccggcgccagaggcagaagaagaagaagaagacccatgagccccccccccccccccccccccgtgagagccctgcccctgctgctgctgctggccggccccggcgccgccgcccccccctgcctggacggcagcccctgcgccaacggcggcagatgcacccagctgcccagcagagaggccgcctgcctgtgcccccccggctgggtgggcgagagatgccagctggaggacccctgccacagcggcccctgcgccggcagaggcgtgtgccagagcagcgtggtggccggcaccgccagattcagctgcagatgccccagaggcttcagaggccccgactgcagcctgcccgacccctgcctgagcagcccctgcgcccacggcgccagatgcagcgtgggccccgacggcagattcctgtgcagctgcccccccggctaccagggcagaagctgcagaagcgacgtggacgagtgcagagtgggcgagccctgcagacacggcggcacctgcctgaacacccccggcagcttcagatgccagtgccccgccggctacaccggccccctgtgcgagaaccccgccgtgccctgcgcccccagcccctgcagaaacggcggcacctgcagacagagcggcgacctgacctacgactgcgcctgcctgcccggcttcgagggccagaactgcgaggtgaacgtggacgactgccccggccacagatgcctgaacggcggcacctgcgtggacggcgtgaacacctacaactgccagtgcccccccgagtggaccggccagttctgcaccgaggacgtggacgagtgccagctgcagcccaacgcctgccacaacggcggcacctgcttcaacaccctgggcggccacagctgcgtgtgcgtgaacggctggaccggcgagagctgcagccagaacatcgacgactgcgccaccgccgtgtgcttccacggcgccacctgccacgacagagtggccagcttctactgcgcctgccccatgggcaagaccggcctgctgtgccacctggacgacgcctgcgtgagcaacccctgccacgaggacgccatctgcgacaccaaccccgtgaacggcagagccatctgcacctgcccccccggcttcaccggcggcgcctgcgaccaggacgtggacgagtgcagcatcggcgccaacccctgcgagcacctgggcagatgcgtgaacacccagggcagcttcctgtgccagtgcggcagaggctacaccggccccagatgcgagaccgacgtgaacgagtgcctgagcggcccctgcagaaaccaggccacctgcctggacagaatcggccagttcacctgcatctgcatggccggcttcaccggcacctactgcgaggtggacatcgacgagtgccagagcagcccctgcgtgaacggcggcgtgtgcaaggacagagtgaacggcttcagctgcacctgccccagcggcttcagcggcagcacctgccagctggacgtggacgagtgcgccagcaccccctgcagaaacggcgccaagtgcgtggaccagcccgacggctacgagtgcagatgcgccgagggcttcgagggcaccctgtgcgacagaaacgtggacgactgcagccccgacccctgccaccacggcagatgcgtggacggcatcgccagcttcagctgcgcctgcgcccccggctacaccggcaccagatgcgagagccaggtggacgagtgcagaagccagccctgcagacacggcggcaagtgcctggacctggtggacaagtacctgtgcagatgccccagcggcaccaccggcgtgaactgcgaggtgaacatcgacgactgcgccagcaacccctgcaccttcggcgtgtgcagagacggcatcaacagatacgactgcgtgtgccagcccggcttcaccggccccctgtgcaacgtggagatcaacgagtgcgccagcagcccctgcggcgagggcggcagctgcgtggacggcgagaacggcttcagatgcctgtgcccccccggcagcctgccccccctgtgcctgccccccagccacccctgcgcccacgagccctgcagccacggcatctgctacgacgcccccggcggcttcagatgcgtgtgcgagcccggctggagcggccccagatgcagccagagcctggccagagacgcctgcgagagccagccctgcagagccggcggcacctgcagcagcgacggcatgggcttccactgcacctgcccccccggcgtgcagggcagacagtgcgagctgctgagcccctgcacccccaacccctgcgagcacggcggcagatgcgagagcgcccccggccagctgcccgtgtgcagctgcccccagggctggcaggacccctgcctgaacggcggcagctgccaggacggcgtgggcagcttcagctgcagctgcctgcccggcttcgccggccccagatgcgccagagacgtggacgagtgcctgagcaacccctgcggccccggcacctgcaccgaccacgtggccagcttcacctgcacctgcccccccggctacggcggcttccactgcgagcaggacctgcccgactgcagccccagcagctgcttcaacggcggcacctgcgtggacggcgtgaacagcttcagctgcctgtgcagacccggctacaccggcgcccactgccagcacgaggccgacccctgcctgagcagaccctgcctgcacggcggcgtgtgcagcgccgcccaccccggcttcagatgcacctgcctggagagcttcaccggcccccagtgccagaccctggtggactggtgcagcagacagccctgccagaacggcggcagatgcgtgcagaccggcgcctactgcctgtgcccccccggctggagcggcagactgtgcgacatcagaagcctgccctgcagagaggccgccgcccagatcggcgtgagactggagcagctgtgccaggccggcggccagtgcgtggacgaggacagcagccactactgcgtgtgccccgagggcagaaccggcagccactgcgagcaggaggtggacccctgcctggcccagccctgccagcacggcggcacctgcagaggctacatgggcggctacatgtgcgagtgcctgcccggctacaacggcgacaactgcgaggacgacgtggacgagtgcgccagccagccctgccagcacggcggcagctgcatcgacctggtggccagatacctgtgcagctgcccccccggcaccctgggcgtgctgtgcgagatcaacgaggacgactgcggccccggcccccccctggacagcggccccagatgcctgcacaacggcacctgcgtggacctggtgggcggcttcagatgcacctgcccccccggctacaccggcctgagatgcgaggccgacatcaacgagtgcagaagcggcgcctgccacgccgcccacaccagagactgcctgcaggaccccggcggcggcttcagatgcctgtgccacgccggcttcagcggccccagatgccagaccgtgctgagcccctgcgagagccagccctgccagcacggcggccagtgcagacccagccccggccccggcggcggcctgaccttcacctgccactgcgcccagcccttctggggccccagatgcgagagagtggccagaagctgcagagagctgcagtgccccgtgggcgtgccctgccagcagacccccagaggccccagatgcgcctgcccccccggcctgagcggccccagctgcagaagcttccccggcagcccccccggcgccagcaacgccagctag

SEQ ID NO: 91332 - DNA, 6012 bp, Artificial Sequence
  Description of Artificial Sequence: Synthetic coding sequence
atgcagccccccagcctgctgctgctgctgctgctgctgctgctgctgtgcgtgagcgtggtgagacccagaggcctgctgtgcggcagcttccccgagccctgcgccaacggcggcacctgcctgagcctgagcctgggccagggcacctgccagtgcgcccccggcttcctgggcgagacctgccagttccccgacccctgccagaacgcccagctgtgccagaacggcggcagctgccaggccctgctgcccgcccccctgggcctgcccagcagccccagccccctgacccccagcttcctgtgcacctgcctgcccggcttcaccggcgagagatgccaggccaagctggaggacccctgcccccccagcttctgcagcaagagaggcagatgccacatccaggccagcggcagaccccagtgcagctgcatgcccggctggaccggcgagcagtgccagctgagagacttctgcagcgccaacccctgcgtgaacggcggcgtgtgcctggccacctacccccagatccagtgccactgcccccccggcttcgagggccacgcctgcgagagagacgtgaacgagtgcttccaggaccccggcccctgccccaagggcaccagctgccacaacaccctgggcagcttccagtgcctgtgccccgtgggccaggagggccccagatgcgagctgagagccggcccctgcccccccagaggctgcagcaacggcggcacctgccagctgatgcccgagaaggacagcaccttccacctgtgcctgtgcccccccggcttcatcggccccgactgcgaggtgaaccccgacaactgcgtgagccaccagtgccagaacggcggcacctgccaggacggcctggacacctacacctgcctgtgccccgagacctggaccggctgggactgcagcgaggacgtggacgagtgcgagacccagggccccccccactgcagaaacggcggcacctgccagaacagcgccggcagcttccactgcgtgtgcgtgagcggctggggcggcaccagctgcgaggagaacctggacgactgcatcgccgccacctgcgcccccggcagcacctgcatcgacagagtgggcagcttcagctgcctgtgcccccccggcagaaccggcctgctgtgccacctggaggacatgtgcctgagccagccctgccacggcgacgcccagtgcagcaccaaccccctgaccggcagcaccctgtgcctgtgccagcccggctacagcggccccacctgccaccaggacctggacgagtgcctgatggcccagcagggccccagcccctgcgagcacggcggcagctgcctgaacacccccggcagcttcaactgcctgtgcccccccggctacaccggcagcagatgcgaggccgaccacaacgagtgcctgagccagccctgccaccccggcagcacctgcctggacctgctggccaccttccactgcctgtgcccccccggcctggagggccagctgtgcgaggtggagaccaacgagtgcgccagcgccccctgcctgaaccacgccgactgccacgacctgctgaacggcttccagtgcatctgcctgcccggcttcagcggcaccagatgcgaggaggacatcgacgagtgcagaagcagcccctgcgccaacggcggccagtgccaggaccagcccggcgccttccactgcaagtgcctgcccggcttcgagggccccagatgccagaccgaggtggacgagtgcctgagcgacccctgccccgtgggcgccagctgcctggacctgcccggcgccttcttctgcctgtgccccagcggcttcaccggccagctgtgcgaggtgcccctgtgcgcccccaacctgtgccagcccaagcagatctgcaaggaccagaaggacaaggccaactgcctgtgccccgacggcagccccggctgcgccccccccgaggacaactgcacctgccaccacggccactgccagagaagcagctgcgtgtgcgacgtgggctggaccggccccgagtgcgaggccgagctgggcggctgcatcagcgccccctgcgcccacggcggcacctgctacccccagcccagcggctacaactgcacctgccccaccggctacaccggccccacctgcagcgaggagatgaccgcctgccacagcggcccctgcctgaacggcggcagctgcaaccccagccccggcggctactactgcacctgcccccccagccacaccggcccccagtgccagaccagcaccgactactgcgtgagcgccccctgcttcaacggcggcacctgcgtgaacagacccggcaccttcagctgcctgtgcgccatgggcttccagggccccagatgcgagggcaagctgagacccagctgcgccgacagcccctgcagaaacagagccacctgccaggacagcccccagggccccagatgcctgtgccccaccggctacaccggcggcagctgccagaccctgatggacctgtgcgcccagaagccctgccccagaaacagccactgcctgcagaccggccccagcttccactgcctgtgcctgcagggctggaccggccccctgtgcaacctgcccctgagcagctgccagaaggccgccctgagccagggcatcgacgtgagcagcctgtgccacaacggcggcctgtgcgtggacagcggccccagctacttctgccactgcccccccggcttccagggcagcctgtgccaggaccacgtgaacccctgcgagagcagaccctgccagaacggcgccacctgcatggcccagcccagcggctacctgtgccagtgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 91333 - DNA, 3147 bp, Artificial Sequence
  Description of Artificial Sequence: Synthetic coding sequence
tgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 91334 - DNA, 6018 bp, Artificial Sequence
  Description of Artificial Sequence: Synthetic coding sequence
atgcagccccccagcctgctgctgctgctgctgctgctgctgctgctgctgctgtgcgtgagcgtggtgagacccagaggcctgctgtgcggcagcttccccgagccctgcgccaacggcggcacctgcctgagcctgagcctgggccagggcacctgccagtgcgcccccggcttcctgggcgagacctgccagttccccgacccctgccagaacgcccagctgtgccagaacggcggcagctgccaggccctgctgcccgcccccctgggcctgcccagcagccccagccccctgacccccagcttcctgtgcacctgcctgcccggcttcaccggcgagagatgccaggcccagctggaggacccctgcccccccagcttctgcagcaagagaggcagatgccacatccaggccagcggcagaccccagtgcagctgcatgcccggctggaccggcgagcagtgccagctgagagacttctgcagcgccaacccctgcgtgaacggcggcgtgtgcctggccacctacccccagatccagtgccactgcccccccggcttcgagggccacgcctgcgagagagacgtgaacgagtgcttccaggaccccggcccctgccccaagggcaccagctgccacaacaccctgggcagcttccagtgcctgtgccccgtgggccaggagggccccagatgcgagctgagagccggcccctgcccccccagaggctgcagcaacggcggcacctgccagctgatgcccgagaaggacagcaccttccacctgtgcctgtgcccccccggcttcatcggccccgactgcgaggtgaaccccgacaactgcgtgagccaccagtgccagaacggcggcacctgccaggacggcctggacacctacacctgcctgtgccccgagacctggaccggctgggactgcagcgaggacgtggacgagtgcgaggcccagggccccccccactgcagaaacggcggcacctgccagaacagcgccggcagcttccactgcgtgtgcgtgagcggctggggcggcaccagctgcgaggagaacctggacgactgcatcgccgccacctgcgcccccggcagcacctgcatcgacagagtgggcagcttcagctgcctgtgcccccccggcagaaccggcctgctgtgccacctggaggacatgtgcctgagccagccctgccacggcgacgcccagtgcagcaccaaccccctgaccggcagcaccctgtgcctgtgccagcccggctacagcggccccacctgccaccaggacctggacgagtgcctgatggcccagcagggccccagcccctgcgagcacggcggcagctgcctgaacacccccggcagcttcaactgcctgtgcccccccggctacaccggcagcagatgcgaggccgaccacaacgagtgcctgagccagccctgccaccccggcagcacctgcctggacctgctggccaccttccactgcctgtgcccccccggcctggagggccagctgtgcgaggtggagaccaacgagtgcgccagcgccccctgcctgaaccacgccgactgccacgacctgctgaacggcttccagtgcatctgcctgcccggcttcagcggcaccagatgcgaggaggacatcgacgagtgcagaagcagcccctgcgccaacggcggccagtgccaggaccagcccggcgccttccactgcaagtgcctgcccggcttcgagggccccagatgccagaccgaggtggacgagtgcctgagcgacccctgccccgtgggcgccagctgcctggacctgcccggcgccttcttctgcctgtgccccagcggcttcaccggccagctgtgcgaggtgcccctgtgcgcccccaacctgtgccagcccaagcagatctgcaaggaccagaaggacaaggccaactgcctgtgccccgacggcagccccggctgcgccccccccgaggacaactgcacctgccaccacggccactgccagagaagcagctgcgtgtgcgacgtgggctggaccggccccgagtgcgaggccgagctgggcggctgcatcagcgccccctgcgcccacggcggcacctgctacccccagcccagcggctacaactgcacctgccccaccggctacaccggccccacctgcagcgaggagatgaccgcctgccacagcggcccctgcctgaacggcggcagctgcaaccccagccccggcggctactactgcacctgcccccccagccacaccggcccccagtgccagaccagcaccgactactgcgtgagcgccccctgcttcaacggcggcacctgcgtgaacagacccggcaccttcagctgcctgtgcgccatgggcttccagggccccagatgcgagggcaagctgagacccagctgcgccgacagcccctgcagaaacagagccacctgccaggacagcccccagggccccagatgcctgtgccccaccggctacaccggcggcagctgccagaccctgatggacctgtgcgcccagaagccctgccccagaaacagccactgcctgcagaccggccccagcttccactgcctgtgcctgcagggctggaccggccccctgtgcaacctgcccctgagcagctgccagaaggccgccctgagccagggcatcgacgtgagcagcctgtgccacaacggcggcctgtgcgtggacagcggccccagctacttctgccactgcccccccggcttccagggcagcctgtgccaggaccacgtgaacccctgcgagagcagaccctgccagaacggcgccacctgcatggcccagcccagcggctacctgtgccagtgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 91335 - DNA, 6012 bp, Artificial Sequence
  Description of Artificial Sequence: Synthetic coding sequence
atgcagccccccagcctgctgctgctgctgctgctgctgctgctgctgtgcgtgagcgtggtgagacccagaggcctgctgtgcggcagcttccccgagccctgcgccaacggcggcacctgcctgagcctgagcctgggccagggcacctgccagtgcgcccccggcttcctgggcgagacctgccagttccccgacccctgccagaacgcccagctgtgccagaacggcggcagctgccaggccctgctgcccgcccccctgggcctgcccagcagccccagccccctgacccccagcttcctgtgcacctgcctgcccggcttcaccggcgagagatgccaggcccagctggaggacccctgcccccccagcttctgcagcaagagaggcagatgccacatccaggccagcggcagaccccagtgcagctgcatgcccggctggaccggcgagcagtgccagctgagagacttctgcagcgccaacccctgcgtgaacggcggcgtgtgcctggccacctacccccagatccagtgccactgcccccccggcttcgagggccacgcctgcgagagagacgtgaacgagtgcttccaggaccccggcccctgccccaagggcaccagctgccacaacaccctgggcagcttccagtgcctgtgccccgtgggccaggagggccccagatgcgagctgagagccggcccctgcccccccagaggctgcagcaacggcggcacctgccagctgatgcccgagaaggacagcaccttccacctgtgcctgtgcccccccggcttcatcggccccgactgcgaggtgaaccccgacaactgcgtgagccaccagtgccagaacggcggcacctgccaggacggcctggacacctacacctgcctgtgccccgagacctggaccggctgggactgcagcgaggacgtggacgagtgcgagacccagggccccccccactgcagaaacggcggcacctgccagaacagcgccggcagcttccactgcgtgtgcgtgagcggctggggcggcaccagctgcgaggagaacctggacgactgcatcgccgccacctgcgcccccggcagcacctgcatcgacagagtgggcagcttcagctgcctgtgcccccccggcagaaccggcctgctgtgccacctggaggacatgtgcctgagccagccctgccacggcgacgcccagtgcagcaccaaccccctgaccggcagcaccctgtgcctgtgccagcccggctacagcggccccacctgccaccaggacctggacgagtgcctgatggcccagcagggccccagcccctgcgagcacggcggcagctgcctgaacacccccggcagcttcaactgcctgtgcccccccggctacaccggcagcagatgcgaggccgaccacaacgagtgcctgagccagccctgccaccccggcagcacctgcctggacctgctggccaccttccactgcctgtgcccccccggcctggagggccagctgtgcgaggtggagaccaacgagtgcgccagcgccccctgcctgaaccacgccgactgccacgacctgctgaacggcttccagtgcatctgcctgcccggcttcagcggcaccagatgcgaggaggacatcgacgagtgcagaagcagcccctgcgccaacggcggccagtgccaggaccagcccggcgccttccactgcaagtgcctgcccggcttcgagggccccagatgccagaccgaggtggacgagtgcctgagcgacccctgccccgtgggcgccagctgcctggacctgcccggcgccttcttctgcctgtgccccagcggcttcaccggccagctgtgcgaggtgcccctgtgcgcccccaacctgtgccagcccaagcagatctgcaaggaccagaaggacaaggccaactgcctgtgccccgacggcagccccggctgcgccccccccgaggacaactgcacctgccaccacggccactgccagagaagcagctgcgtgtgcgacgtgggctggaccggccccgagtgcgaggccgagctgggcggctgcatcagcgccccctgcgcccacggcggcacctgctacccccagcccagcggctacaactgcacctgccccaccggctacaccggccccacctgcagcgaggagatgaccgcctgccacagcggcccctgcctgaacggcggcagctgcaaccccagccccggcggctactactgcacctgcccccccagccacaccggcccccagtgccagaccagcaccgactactgcgtgagcgccccctgcttcaacggcggcacctgcgtgaacagacccggcaccttcagctgcctgtgcgccatgggcttccagggccccagatgcgagggcaagctgagacccagctgcgccgacagcccctgcagaaacagagccacctgccaggacagcccccagggccccagatgcctgtgccccaccggctacaccggcggcagctgccagaccctgatggacctgtgcgcccagaagccctgccccagaaacagccactgcctgcagaccggccccagcttccactgcctgtgcctgcagggctggaccggccccctgtgcaacctgcccctgagcagctgccagaaggccgccctgagccagggcatcgacgtgagcagcctgtgccacaacggcggcctgtgcgtggacagcggccccagctacttctgccactgcccccccggcttccagggcagcctgtgccaggaccacgtgaacccctgcgagagcagaccctgccagaacggcgccacctgcatggcccagcccagcggctacctgtgccagtgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 91336 - DNA, 561 bp, Artificial Sequence
  Description of Artificial Sequence: Synthetic coding sequence
atgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcgccgacgccgccatccccggcggcgccggcagaagcggcggcagcagccccgccaccgccggcgccggcggcagccccagagccgccggccccggctgggccagcgccggcggcagaagaagccccacctag

SEQ ID NO: 91337 - DNA, 6009 bp, Artificial Sequence
  Description of Artificial Sequence: Synthetic coding sequence
atgcagccccccagcctgctgctgctgctgctgctgctgctgctgtgcgtgagcgtggtgagacccagaggcctgctgtgcggcagcttccccgagccctgcgccaacggcggcacctgcctgagcctgagcctgggccagggcacctgccagtgcgcccccggcttcctgggcgagacctgccagttccccgacccctgccagaacgcccagctgtgccagaacggcggcagctgccaggccctgctgcccgcccccctgggcctgcccagcagccccagccccctgacccccagcttcctgtgcacctgcctgcccggcttcaccggcgagagatgccaggcccagctggaggacccctgcccccccagcttctgcagcaagagaggcagatgccacatccaggccagcggcagaccccagtgcagctgcatgcccggctggaccggcgagcagtgccagctgagagacttctgcagcgccaacccctgcgtgaacggcggcgtgtgcctggccacctacccccagatccagtgccactgcccccccggcttcgagggccacgcctgcgagagagacgtgaacgagtgcttccaggaccccggcccctgccccaagggcaccagctgccacaacaccctgggcagcttccagtgcctgtgccccgtgggccaggagggccccagatgcgagctgagagccggcccctgcccccccagaggctgcagcaacggcggcacctgccagctgatgcccgagaaggacagcaccttccacctgtgcctgtgcccccccggcttcatcggccccgactgcgaggtgaaccccgacaactgcgtgagccaccagtgccagaacggcggcacctgccaggacggcctggacacctacacctgcctgtgccccgagacctggaccggctgggactgcagcgaggacgtggacgagtgcgagacccagggccccccccactgcagaaacggcggcacctgccagaacagcgccggcagcttccactgcgtgtgcgtgagcggctggggcggcaccagctgcgaggagaacctggacgactgcatcgccgccacctgcgcccccggcagcacctgcatcgacagagtgggcagcttcagctgcctgtgcccccccggcagaaccggcctgctgtgccacctggaggacatgtgcctgagccagccctgccacggcgacgcccagtgcagcaccaaccccctgaccggcagcaccctgtgcctgtgccagcccggctacagcggccccacctgccaccaggacctggacgagtgcctgatggcccagcagggccccagcccctgcgagcacggcggcagctgcctgaacacccccggcagcttcaactgcctgtgcccccccggctacaccggcagcagatgcgaggccgaccacaacgagtgcctgagccagccctgccaccccggcagcacctgcctggacctgctggccaccttccactgcctgtgcccccccggcctggagggccagctgtgcgaggtggagaccaacgagtgcgccagcgccccctgcctgaaccacgccgactgccacgacctgctgaacggcttccagtgcatctgcctgcccggcttcagcggcaccagatgcgaggaggacatcgacgagtgcagaagcagcccctgcgccaacggcggccagtgccaggaccagcccggcgccttccactgcaagtgcctgcccggcttcgagggccccagatgccagaccgaggtggacgagtgcctgagcgacccctgccccgtgggcgccagctgcctggacctgcccggcgccttcttctgcctgtgccccagcggcttcaccggccagctgtgcgaggtgcccctgtgcgcccccaacctgtgccagcccaagcagatctgcaaggaccagaaggacaaggccaactgcctgtgccccgacggcagccccggctgcgccccccccgaggacaactgcacctgccaccacggccactgccagagaagcagctgcgtgtgcgacgtgggctggaccggccccgagtgcgaggccgagctgggcggctgcatcagcgccccctgcgcccacggcggcacctgctacccccagcccagcggctacaactgcacctgccccaccggctacaccggccccacctgcagcgaggagatgaccgcctgccacagcggcccctgcctgaacggcggcagctgcaaccccagccccggcggctactactgcacctgcccccccagccacaccggcccccagtgccagaccagcaccgactactgcgtgagcgccccctgcttcaacggcggcacctgcgtgaacagacccggcaccttcagctgcctgtgcgccatgggcttccagggccccagatgcgagggcaagctgagacccagctgcgccgacagcccctgcagaaacagagccacctgccaggacagcccccagggccccagatgcctgtgccccaccggctacaccggcggcagctgccagaccctgatggacctgtgcgcccagaagccctgccccagaaacagccactgcctgcagaccggccccagcttccactgcctgtgcctgcagggctggaccggccccctgtgcaacctgcccctgagcagctgccagaaggccgccctgagccagggcatcgacgtgagcagcctgtgccacaacggcggcctgtgcgtggacagcggccccagctacttctgccactgcccccccggcttccagggcagcctgtgccaggaccacgtgaacccctgcgagagcagaccctgccagaacggcgccacctgcatggcccagcccagcggctacctgtgccagtgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 91338 - DNA, 6012 bp, Artificial Sequence; identical to SEQ ID NO: 91332
  Description of Artificial Sequence: Synthetic coding sequence

SEQ ID NO: 91339 - DNA, 561 bp, Artificial Sequence; identical to SEQ ID NO: 91336
  Description of Artificial Sequence: Synthetic coding sequence

SEQ ID NO: 91340 - DNA, 561 bp, Artificial Sequence; identical to SEQ ID NO: 91336
  Description of Artificial Sequence: Synthetic coding sequence

SEQ ID NO: 91341 - DNA, 561 bp, Artificial Sequence; identical to SEQ ID NO: 91336
  Description of Artificial Sequence: Synthetic coding sequence

SEQ ID NO: 91342 - DNA, 561 bp, Artificial Sequence; identical to SEQ ID NO: 91336
  Description of Artificial Sequence: Synthetic coding sequence

SEQ ID NO: 91343 - DNA, 561 bp, Artificial Sequence; identical to SEQ ID NO: 91336
  Description of Artificial Sequence: Synthetic coding sequence

SEQ ID NO: 91344 - DNA, 1491 bp, Artificial Sequence
  Description of Artificial Sequence: Synthetic coding sequence
atgggcagaggcgtgagagtgctgctgctgctgagcctgctgcactgcgccggcggcagcgagggcagaaagacctggagaagaagaggccagcagcccccccccccccccagaaccgaggccgcccccgccgccggccagcccgtggagagcttccccctggacttcaccgccgtggagggcaacatggacagcttcatggcccaggtgaagagcctggcccagagcctgtacccctgcagcgcccagcagctgaacgaggacctgagactgcacctgctgctgaacaccagcgtgacctgcaacgacggcagccccgccggctactacctgaaggagagcagaggcagcagaagatggctgctgttcctggagggcggctggtactgcttcaacagagagaactgcgacagcagatacgacaccatgagaagactgatgagcagcagagactggcccagaaccagaaccggcaccggcatcctgagcagccagcccgaggagaacccctactggtggaacgccaacatggtgttcatcccctactgcagcagcgacgtgtggagcggcgccagcagcaagagcgagaagaacgagtacgccttcatgggcgccctgatcatccaggaggtggtgagagagctgctgggcagaggcctgagcggcgccaaggtgctgctgctggccggcagcagcgccggcggcaccggcgtgctgctgaacgtggacagagtggccgagcagctggagaagctgggctaccccgccatccaggtgagaggcctggccgacagcggctggttcctggacaacaagcagtacagacacaccgactgcgtggacaccatcacctgcgcccccaccgaggccatcagaagaggcatcagatactggaacggcgtggtgcccgagagatgcagaagacagttccaggagggcgaggagtggaactgcttcttcggctacaaggtgtaccccaccctgagatgccccgtgttcgtggtgcagtggctgttcgacgaggcccagctgaccgtggacaacgtgcacctgaccggccagcccgtgcaggagggcctgagactgtacatccagaacctgggcagagagctgagacacaccctgaaggacgtgcccgccagcttcgcccccgcctgcctgagccacgagatcatcatcagaagccactggaccgacgtgcaggtgaagggcaccagcctgcccagagccctgcactgctgggacagaagcctgcacgacagccacaaggccagcaagacccccctgaagggctgccccgtgcacctggtggacagctgcccctggccccactgcaaccccagctgccccaccgtgagagaccagttcaccggccaggagatgaacgtggcccagttcctgatgcacatgggcttcgacatgcagaccgtggcccagccccagggcctggagcccagcgagctgctgggcatgctgagcaacggcagctag

SEQ ID NO: 91345 - DNA, 888 bp, Artificial Sequence
  Description of Artificial Sequence: Synthetic coding sequence
atgggcagaggcgtgagagtgctgctgctgctgagcctgctgcactgcgccggcggcagcgagggcagaaagacctggagaagaagaggccagcagcccccccccccccccagaaccgaggccgcccccgccgccggccagcccgtggagagcttccccctggacttcaccgccgtggagggcaacatggacagcttcatggcccaggtgaagagcctggcccagagcctgtacccctgcagcgcccagcagctgaacgaggacctgagactgcacctgctgctgaacaccagcgtgacctgcaacgacggcagccccgccggctactacctgaaggagagcagaggcagcagaagatggctgctgttcctggagggcggctggtactgcttcaacagagagaactgcgacagcagatacgacaccatgagaagactgatgagcagcagagactggcccagaaccagaaccggcaccggcatcctgagcagccagcccgaggagaacccctactggtggaacgccaacatggtgttcatcccctactgcagcagcgacgtgtggagcggcgccagcagcaagagcgagaagaacgagtacgccttcatgggcgccctgatcatccaggaggtggtgagagagctgctgggcagaggcctgagcggcgccaaggtgctgctgctggccggcagcagcgccggcggcaccggcgtgctgctgaacgtggacagagtggccgagcagctggagaagctgggctaccccgccatccaggtgagaggcctggccgacagcggctggttcctggacaacaagcagtacagacacaccgactgcgtggacaccatcacctgcgcccccaccgaggccatcagaagaggcatctag

SEQ ID NO: 91346 - DNA, 4080 bp, Artificial Sequence
  Description of Artificial Sequence: Synthetic coding sequence
atggccgaggccggcctgagaggctggctgctgtgggccctgctgctgagactggcccagagcgagccctacaccaccatccaccagcccggctactgcgccttctacgacgagtgcggcaagaaccccgagctgagcggcagcctgatgaccctgagcaacgtgagctgcctgagcaacacccccgccagaaagatcaccggcgaccacctgatcctgctgcagaagatctgccccagactgtacaccggccccaacacccaggcctgctgcagcgccaagcagctggtgagcctggaggccagcctgagcatcaccaaggccctgctgaccagatgccccgcctgcagcgacaacttcgtgaacctgcactgccacaacacctgcagccccaaccagagcctgttcatcaacgtgaccagagtggcccagctgggcgccggccagctgcccgccgtggtggcctacgaggccttctaccagcacagcttcgccgagcagagctacgacagctgcagcagagtgagagtgcccgccgccgccaccctggccgtgggcaccatgtgcggcgtgtacggcagcgccctgtgcaacgcccagagatggctgaacttccagggcgacaccggcaacggcctggcccccctggacatcaccttccacctgctggagcccggccaggccgtgggcagcggcatccagcccctgaacgagggcgtggccagatgcaacgagagccagggcgacgacgtggccacctgcagctgccaggactgcgccgccagctgccccgccatcgccagaccccaggccctggacagcaccttctacctgggccagatgcccggcagcctggtgctgatcatcatcctgtgcagcgtgttcgccgtggtgaccatcctgctggtgggcttcagagtggcccccgccagagacaagagcaagatggtggaccccaagaagggcaccagcctgagcgacaagctgagcttcagcacccacaccctgctgggccagttcttccagggctggggcacctgggtggccagctggcccctgaccatcctggtgctgagcgtgatccccgtggtggccctggccgccggcctggtgttcaccgagctgaccaccgaccccgtggagctgtggagcgcccccaacagccaggccagaagcgagaaggccttccacgaccagcacttcggccccttcttcagaaccaaccaggtgatcctgaccgcccccaacagaagcagctacagatacgacagcctgctgctgggccccaagaacttcagcggcatcctggacctggacctgctgctggagctgctggagctgcaggagagactgagacacctgcaggtgtggagccccgaggcccagagaaacatcagcctgcaggacatctgctacgcccccctgaaccccgacaacaccagcctgtacgactgctgcatcaacagcctgctgcagtacttccagaacaacagaaccctgctgctgctgaccgccaaccagaccctgatgggccagaccagccaggtggactggaaggaccacttcctgtactgcgccaacgcccccctgaccttcaaggacggcaccgccctggccctgagctgcatggccgactacggcgcccccgtgttccccttcctggccatcggcggctacaagggcaaggactacagcgaggccgaggccctgatcatgaccttcagcctgaacaactaccccgccggcgaccccagactggcccaggccaagctgtgggaggaggccttcctggaggagatgagagccttccagagaagaatggccggcatgttccaggtgaccttcatggccgagagaagcctggaggacgagatcaacagaaccaccgccgaggacctgcccatcttcgccaccagctacatcgtgatcttcctgtacatcagcctggccctgggcagctacagcagctggagcagagtgatggtggacagcaaggccaccctgggcctgggcggcgtggccgtggtgctgggcgccgtgatggccgccatgggcttcttcagctacctgggcatcagaagcagcctggtgatcctgcaggtggtgcccttcctggtgctgagcgtgggcgccgacaacatcttcatcttcgtgctggagtaccagagactgcccagaagacccggcgagcccagagaggtgcacatcggcagagccctgggcagagtggcccccagcatgctgctgtgcagcctgagcgaggccatctgcttcttcctgggcgccctgacccccatgcccgccgtgagaaccttcgccctgaccagcggcctggccgtgatcctggacttcctgctgcagatgagcgccttcgtggccctgctgagcctggacagcaagagacaggaggccagcagactggacgtgtgctgctgcgtgaagccccaggagctgcccccccccggccagggcgagggcctgctgctgggcttcttccagaaggcctacgcccccttcctgctgcactggatcaccagaggcgtggtgctgctgctgttcctggccctgttcggcgtgagcctgtacagcatgtgccacatcagcgtgggcctggaccaggagctggccctgcccaaggacagctacctgctggactacttcctgttcctgaacagatacttcgaggtgggcgcccccgtgtacttcgtgaccaccctgggctacaacttcagcagcgaggccggcatgaacgccatctgcagcagcgccggctgcaacaacttcagcttcacccagaagatccagtacgccaccgagttccccgagcagagctacctggccatccccgccagcagctgggtggacgacttcatcgactggctgacccccagcagctgctgcagactgtacatcagcggccccaacaaggacaagttctgccccagcaccgtgaacagcctgaactgcctgaagaactgcatgagcatcaccatgggcagcgtgagacccagcgtggagcagttccacaagtacctgccctggttcctgaacgacagacccaacatcaagtgccccaagggcggcctggccgcctacagcaccagcgtgaacctgaccagcgacggccaggtgctggacaccgtggccatcctgagccccagactggagtacagcggcaccatcagcgcccactgcaacctgtacctgctggacagcaccagcagattcatggcctaccacaagcccctgaagaacagccaggactacaccgaggccctgagagccgccagagagctggccgccaacatcaccgccgacctgagaaaggtgcccggcaccgaccccgccttcgaggtgttcccctacaccatcaccaacgtgttctacgagcagtacctgaccatcctgcccgagggcctgttcatgctgagcctgtgcctggtgcccaccttcgccgtgagctgcctgctgctgggcctggacctgagaagcggcctgctgaacctgctgagcatcgtgatgatcctggtggacaccgtgggcttcatggccctgtggggcatcagctacaacgccgtgagcctgatcaacctggtgagcgccgtgggcatgagcgtggagttcgtgagccacatcaccagaagcttcgccatcagcaccaagcccacctggctggagagagccaaggaggccaccatcagcatgggcagcgccgtgttcgccggcgtggccatgaccaacctgcccggcatcctggtgctgggcctggccaaggcccagctgatccagatcttcttcttcagactgaacctgctgatcaccctgctgggcctgctgcacggcctggtgttcctgcccgtgatcctgagctacgtgggccccgacgtgaaccccgccctggccctggagcagaagagagccgaggaggccgtggccgccgtgatggtggccagctgccccaaccaccccagcagagtgagcaccgccgacaacatctacgtgaaccacagcttcgagggcagcatcaagggcgccggcgccatcagcaacttcctgcccaacaacggcagacagttctag

SEQ ID NO: 91347 - DNA, 3999 bp, Artificial Sequence
  Description of Artificial Sequence: Synthetic coding sequence
atggccgaggccggcctgagaggctggctgctgtgggccctgctgctgagactggcccagagcgagccctacaccaccatccaccagcccggctactgcgccttctacgacgagtgcggcaagaaccccgagctgagcggcagcctgatgaccctgagcaacgtgagctgcctgagcaacacccccgccagaaagatcaccggcgaccacctgatcctgctgcagaagatctgccccagactgtacaccggccccaacacccaggcctgctgcagcgccaagcagctggtgagcctggaggccagcctgagcatcaccaaggccctgctgaccagatgccccgcctgcagcgacaacttcgtgaacctgcactgccacaacacctgcagccccaaccagagcctgttcatcaacgtgaccagagtggcccagctgggcgccggccagctgcccgccgtggtggcctacgaggccttctaccagcacagcttcgccgagcagagctacgacagctgcagcagagtgagagtgcccgccgccgccaccctggccgtgggcaccatgtgcggcgtgtacggcagcgccctgtgcaacgcccagagatggctgaacttccagggcgacaccggcaacggcctggcccccctggacatcaccttccacctgctggagcccggccaggccgtgggcagcggcatccagcccctgaacgagggcgtggccagatgcaacgagagccagggcgacgacgtggccacctgcagctgccaggactgcgccgccagctgccccgccatcgccagaccccaggccctggacagcaccttctacctgggccagatgcccggcagcctggtgctgatcatcatcctgtgcagcgtgttcgccgtggtgaccatcctgctggtgggcttcagagtggcccccgccagagacaagagcaagatggtggaccccaagaagggcaccagcctgagcgacaagctgagcttcagcacccacaccctgctgggccagttcttccagggctggggcacctgggtggccagctggcccctgaccatcctggtgctgagcgtgatccccgtggtggccctggccgccggcctggtgttcaccgagctgaccaccgaccccgtggagctgtggagcgcccccaacagccaggccagaagcgagaaggccttccacgaccagcacttcggccccttcttcagaaccaaccaggtgatcctgaccgcccccaacagaagcagctacagatacgacagcctgctgctgggccccaagaacttcagcggcatcctggacctggacctgctgctggagctgctggagctgcaggagagactgagacacctgcaggtgtggagccccgaggcccagagaaacatcagcctgcaggacatctgctacgcccccctgaaccccgacaacaccagcctgtacgactgctgcatcaacagcctgctgcagtacttccagaacaacagaaccctgctgctgctgaccgccaaccagaccctgatgggccagaccagccaggtggactggaaggaccacttcctgtactgcgccaacgcccccctgaccttcaaggacggcaccgccctggccctgagctgcatggccgactacggcgcccccgtgttccccttcctggccatcggcggctacaagggcaaggactacagcgaggccgaggccctgatcatgaccttcagcctgaacaactaccccgccggcgaccccagactggcccaggccaagctgtgggaggaggccttcctggaggagatgagagccttccagagaagaatggccggcatgttccaggtgaccttcatggccgagagaagcctggaggacgagatcaacagaaccaccgccgaggacctgcccatcttcgccaccagctacatcgtgatcttcctgtacatcagcctggccctgggcagctacagcagctggagcagagtgatggtggacagcaaggccaccctgggcctgggcggcgtggccgtggtgctgggcgccgtgatggccgccatgggcttcttcagctacctgggcatcagaagcagcctggtgatcctgcaggtggtgcccttcctggtgctgagcgtgggcgccgacaacatcttcatcttcgtgctggagtaccagagactgcccagaagacccggcgagcccagagaggtgcacatcggcagagccctgggcagagtggcccccagcatgctgctgtgcagcctgagcgaggccatctgcttcttcctgggcgccctgacccccatgcccgccgtgagaaccttcgccctgaccagcggcctggccgtgatcctggacttcctgctgcagatgagcgccttcgtggccctgctgagcctggacagcaagagacaggaggccagcagactggacgtgtgctgctgcgtgaagccccaggagctgcccccccccggccagggcgagggcctgctgctgggcttcttccagaaggcctacgcccccttcctgctgcactggatcaccagaggcgtggtgctgctgctgttcctggccctgttcggcgtgagcctgtacagcatgtgccacatcagcgtgggcctggaccaggagctggccctgcccaaggacagctacctgctggactacttcctgttcctgaacagatacttcgaggtgggcgcccccgtgtacttcgtgaccaccctgggctacaacttcagcagcgaggccggcatgaacgccatctgcagcagcgccggctgcaacaacttcagcttcacccagaagatccagtacgccaccgagttccccgagcagagctacctggccatccccgccagcagctgggtggacgacttcatcgactggctgacccccagcagctgctgcagactgtacatcagcggccccaacaaggacaagttctgccccagcaccgtgaacagcctgaactgcctgaagaactgcatgagcatcaccatgggcagcgtgagacccagcgtggagcagttccacaagtacctgccctggttcctgaacgacagacccaacatcaagtgccccaagggcggcctggccgcctacagcaccagcgtgaacctgaccagcgacggccaggtgctggccagcagattcatggcctaccacaagcccctgaagaacagccaggactacaccgaggccctgagagccgccagagagctggccgccaacatcaccgccgacctgagaaaggtgcccggcaccgaccccgccttcgaggtgttcccctacaccatcaccaacgtgttctacgagcagtacctgaccatcctgcccgagggcctgttcatgctgagcctgtgcctggtgcccaccttcgccgtgagctgcctgctgctgggcctggacctgagaagcggcctgctgaacctgctgagcatcgtgatgatcctggtggacaccgtgggcttcatggccctgtggggcatcagctacaacgccgtgagcctgatcaacctggtgagcgccgtgggcatgagcgtggagttcgtgagccacatcaccagaagcttcgccatcagcaccaagcccacctggctggagagagccaaggaggccaccatcagcatgggcagcgccgtgttcgccggcgtggccatgaccaacctgcccggcatcctggtgctgggcctggccaaggcccagctgatccagatcttcttcttcagactgaacctgctgatcaccctgctgggcctgctgcacggcctggtgttcctgcccgtgatcctgagctacgtgggccccgacgtgaaccccgccctggccctggagcagaagagagccgaggaggccgtggccgccgtgatggtggccagctgccccaaccaccccagcagagtgagcaccgccgacaacatctacgtgaaccacagcttcgagggcagcatcaagggcgccggcgccatcagcaacttcctgcccaacaacggcagacagttctag

SEQ ID NO: 91348 - DNA, 3861 bp, Artificial Sequence
  Description of Artificial Sequence: Synthetic coding sequence
atggccgaggccggcctgagaggctggctgctgtgggccctgctgctgagactggcccagagcgagccctacaccaccatccaccagcccggctactgcgccttctacgacgagtgcggcaagaaccccgagctgagcggcagcctgatgaccctgagcaacgtgagctgcctgagcaacacccccgccagaaagatcaccggcgaccacctgatcctgctgcagaagatctgccccagactgtacaccggccccaacacccaggcctgctgcagcgccaagcagctggtgagcctggaggccagcctgagcatcaccaaggccctgctgaccagatgccccgcctgcagcgacaacttcgtgaacctgcactgccacaacacctgcagccccaaccagagcctgttcatcaacgtgaccagagtggcccagctgggcgccggccagctgcccgccgtggtggcctacgaggccttctaccagcacagcttcgccgagcagagctacgacagctgcagcagagtgagagtgcccgccgccgccaccctggccgtgggcaccatgtgcggcgtgtacggcagcgccctgtgcaacgcccagagatggctgaacttccagggcgacaccggcaacggcctggcccccctggacatcaccttccacctgctggagcccggccaggccgtgggcagcggcatccagcccctgaacgagggcgtggccagatgcaacgagagccagggcgacgacgtggccacctgcagctgccaggactgcgccgccagctgccccgccatcgccagaccccaggccctggacagcaccttctacctgggccagatgcccggcagcctggtgctgatcatcatcctgtgcagcgtgttcgccgtggtgaccatcctgctggtgggcttcagagtggcccccgccagagacaagagcaagatggtggaccccaagaagggcaccagcctgagcgacaagctgagcttcagcacccacaccctgctgggccagttcttccagggctggggcacctgggtggccagctggcccctgaccatcctggtgctgagcgtgatccccgtggtggccctggccgccggcctggtgttcaccgagctgaccaccgaccccgtggagctgtggagcgcccccaacagccaggccagaagcgagaaggccttccacgaccagcacttcggccccttcttcagaaccaaccaggtgatcctgaccgcccccaacagaagcagctacagatacgacagcctgctgctgggccccaagaacttcagcggcatcctggacctggacctgctgctggagctgctggagctgcaggagagactgagacacctgcaggtgtggagccccgaggcccagagaaacatcagcctgcaggacatctgctacgcccccctgaaccccgacaacaccagcctgtacgactgctgcatcaacagcctgctgcagtacttccagaacaacagaaccctgctgctgctgaccgccaaccagaccctgatgggccagaccagccaggtggactggaaggaccacttcctgtactgcgccaacgcccccctgaccttcaaggacggcaccgccctggccctgagctgcatggccgactacggcgcccccgtgttccccttcctggccatcggcggctacaagggcaaggactacagcgaggccgaggccctgatcatgaccttcagcctgaacaactaccccgccggcgaccccagactggcccaggccaagctgtgggaggaggccttcctggaggagatgagagccttccagagaagaatggccggcatgttccaggtgaccttcatggccgagagaagcctggaggacgagatcaacagaaccaccgccgaggacctgcccatcttcgccaccagctacatcgtgatcttcctgtacatcagcctggccctgggcagctacagcagctggagcagagtgatggtggacagcaaggccaccctgggcctgggcggcgtggccgtggtgctgggcgccgtgatggccgccatgggcttcttcagctacctgggcatcagaagcagcctggtgatcctgcaggtggtgcccttcctggtgctgagcgtgggcgccgacaacatcttcatcttcgtgctggagtaccagagactgcccagaagacccggcgagcccagagaggtgcacatcggcagagccctgggcagagtggcccccagcatgctgctgtgcagcctgagcgaggccatctgcttcttcctgggcgccctgacccccatgcccgccgtgagaaccttcgccctgaccagcggcctggccgtgatcctggacttcctgctgcagatgagcgccttcgtggccctgctgagcctggacagcaagagacaggaggccagcagactggacgtgtgctgctgcgtgaagccccaggagctgcccccccccggccagggcgagggcctgctgctgggcttcttccagaaggcctacgcccccttcctgctgcactggatcaccagaggcgtggtggtgggcgcccccgtgtacttcgtgaccaccctgggctacaacttcagcagcgaggccggcatgaacgccatctgcagcagcgccggctgcaacaacttcagcttcacccagaagatccagtacgccaccgagttccccgagcagagctacctggccatccccgccagcagctgggtggacgacttcatcgactggctgacccccagcagctgctgcagactgtacatcagcggccccaacaaggacaagttctgccccagcaccgtgaacagcctgaactgcctgaagaactgcatgagcatcaccatgggcagcgtgagacccagcgtggagcagttccacaagtacctgccctggttcctgaacgacagacccaacatcaagtgccccaagggcggcctggccgcctacagcaccagcgtgaacctgaccagcgacggccaggtgctggccagcagattcatggcctaccacaagcccctgaagaacagccaggactacaccgaggccctgagagccgccagagagctggccgccaacatcaccgccgacctgagaaaggtgcccggcaccgaccccgccttcgaggtgttcccctacaccatcaccaacgtgttctacgagcagtacctgaccatcctgcccgagggcctgttcatgctgagcctgtgcctggtgcccaccttcgccgtgagctgcctgctgctgggcctggacctgagaagcggcctgctgaacctgctgagcatcgtgatgatcctggtggacaccgtgggcttcatggccctgtggggcatcagctacaacgccgtgagcctgatcaacctggtgagcgccgtgggcatgagcgtggagttcgtgagccacatcaccagaagcttcgccatcagcaccaagcccacctggctggagagagccaaggaggccaccatcagcatgggcagcgccgtgttcgccggcgtggccatgaccaacctgcccggcatcctggtgctgggcctggccaaggcccagctgatccagatcttcttcttcagactgaacctgctgatcaccctgctgggcctgctgcacggcctggtgttcctgcccgtgatcctgagctacgtgggccccgacgtgaaccccgccctggccctggagcagaagagagccgaggaggccgtggccgccgtgatggtggccagctgccccaaccaccccagcagagtgagcaccgccgacaacatctacgtgaaccacagcttcgagggcagcatcaagggcgccggcgccatcagcaacttcctgcccaacaacggcagacagttctag

SEQ ID NO: 91349 - DNA, 783 bp, Artificial Sequence
  Description of Artificial Sequence: Synthetic coding sequence
atgccccagaacgagtacatcgagctgcacagaaagagatacggctacagactggactaccacgagaagaagagaaagaaggagagcagagaggcccacgagagaagcaagaaggccaagaagatgatcggcctgaaggccaagctgtaccacaagcagagacacgccgagaagatccagatgaagaagaccatcaagatgcacgagaagagaaacaccaagcagaagaacgacgagaagaccccccagggcgccgtgcccgcctacctgctggacagagagggccagagcagagccaaggtgctgagcaacatgatcaagcagaagagaaaggagaaggccggcaagtgggaggtgcccctgcccaaggtgagagcccagggcgagaccgaggtgctgaaggtgatcagaaccggcaagagaaagaagaaggcctggaagagaatggtgaccaaggtgtgcttcgtgggcgacggcttcaccagaaagccccccaagtacgagagattcatcagacccatgggcctgagattcaagaaggcccacgtgacccaccccgagctgaaggccaccttctgcctgcccatcctgggcgtgaagaagaaccccagcagccccctgtacaccaccctgggcgtgatcaccaagggcaccgtgatcgaggtgaacgtgagcgagctgggcctggtgacccagggcggcaaggtgatctggggcaagtacgcccaggtgaccaacaaccccgagaacgacggctgcatcaacgccgtgctgctggtgtag

SEQ ID NO: 91350 - DNA, 1509 bp, Artificial Sequence
  Description of Artificial Sequence: Synthetic coding sequence
atgagctgccccgtgcccgcctgctgcgccctgctgctggtgctgggcctgtgcagagccagacccagaaacgccctgctgctgctggccgacgacggcggcttcgagagcggcgcctacaacaacagcgccatcgccaccccccacctggacgccctggccagaagaagcctgctgttcagaaacgccttcaccagcgtgagcagctgcagccccagcagagccagcctgctgaccggcctgccccagcaccagaacggcatgtacggcctgcaccaggacgtgcaccacttcaacagcttcgacaaggtgagaagcctgcccctgctgctgagccaggccggcgtgagaaccggcatcatcggcaagaagcacgtgggccccgagaccgtgtaccccttcgacttcgcctacaccgaggagaacggcagcgtgctgcaggtgggcagaaacatcaccagaatcaagctgctggtgagaaagttcctgcagacccaggacgacagacccttcttcctgtacgtggccttccacgacccccacagatgcggccacagccagccccagtacggcaccttctgcgagaagttcggcaacggcgagagcggcatgggcagaatccccgactggaccccccaggcctacgaccccctggacgtgctggtgccctacttcgtgcccaacacccccgccgccagagccgacctggccgcccagtacaccaccgtgggcagaatggaccagggcgtgggcctggtgctgcaggagctgagagacgccggcgtgctgaacgacaccctggtgatcttcaccagcgacaacggcatccccttccccagcggcagaaccaacctgtactggcccggcaccgccgagcccctgctggtgagcagccccgagcaccccaagagatggggccaggtgagcgaggcctacgtgagcctgctggacctgacccccaccatcctggactggttcagcatcccctaccccagctacgccatcttcggcagcaagaccatccacctgaccggcagaagcctgctgcccgccctggaggccgagcccctgtgggccaccgtgttcggcagccagagccaccacgaggtgaccatgagctaccccatgagaagcgtgcagcacagacacttcagactggtgcacaacctgaacttcaagatgcccttccccatcgaccaggacttctacgtgagccccaccttccaggacctgctgaacagaaccaccgccggccagcccaccggctggtacaaggacctgagacactactactacagagccagatgggagctgtacgacagaagcagagacccccacgagacccagaacctggccaccgaccccagattcgcccagctgctggagatgctgagagaccagctggccaagtggcagtgggagacccacgacccctgggtgtgcgcccccgacggcgtgctggaggagaagctgagcccccagtgccagcccctgcacaacgagctgtag

SEQ ID NO: 91351 - DNA, 900 bp, Artificial Sequence
  Description of Artificial Sequence: Synthetic coding sequence
atgggcagaatccccgactggaccccccaggcctacgaccccctggacgtgctggtgccctacttcgtgcccaacacccccgccgccagagccgacctggccgcccagtacaccaccgtgggcagaatggaccagggcgtgggcctggtgctgcaggagctgagagacgccggcgtgctgaacgacaccctggtgatcttcaccagcgacaacggcatccccttccccagcggcagaaccaacctgtactggcccggcaccgccgagcccctgctggtgagcagccccgagcaccccaagagatggggccaggtgagcgaggcctacgtgagcctgctggacctgacccccaccatcctggactggttcagcatcccctaccccagctacgccatcttcggcagcaagaccatccacctgaccggcagaagcctgctgcccgccctggaggccgagcccctgtgggccaccgtgttcggcagccagagccaccacgaggtgaccatgagctaccccatgagaagcgtgcagcacagacacttcagactggtgcacaacctgaacttcaagatgcccttccccatcgaccaggacttctacgtgagccccaccttccaggacctgctgaacagaaccaccgccggccagcccaccggctggtacaaggacctgagacactactactacagagccagatgggagctgtacgacagaagcagagacccccacgagacccagaacctggccaccgaccccagattcgcccagctgctggagatgctgagagaccagctggccaagtggcagtgggagacccacgacccctgggtgtgcgcccccgacggcgtgctggaggagaagctgagcccccagtgccagcccctgcacaacgagctgtag

SEQ ID NO: 91352 - DNA, 618 bp, Artificial Sequence
  Description of Artificial Sequence: Synthetic coding sequence
atgagctgccccgtgcccgcctgctgcgccctgctgctggtgctgggcctgtgcagagccagacccagaaacgccctgctgctgctggccgacagagccctgagcgtgagccacctgacccagagaatgaccgaggccctgagagtggccagaaccaccaccgcccccagcccccccagaacctggaccccctggcccgccgccgccagcagcttcgccatgcccagccccagaagcgccgccgccctgcccgccgcccccgccagcagcctggcctgccccagcatcagaatgggctgcaccggctgcaccagaacctgcaccaccagcacccccagcaccagatgcggcgcctgcagatgctgcagcgccaagctggtgtgcgcccaggccagcagcggcagaagcacctggggcagaagaccctgcaccagactgaccctgagaaccagaagaagaatggcccccagcagcagatggggcggcaccagcctggagctgagctgcagcagcggcaacagctgcagactgagaatgaccggcctgagcagcagcaccagccccagcaccacccccaccctgtgggccctgcccgcccccgtgagaaacctgctgtag

SEQ ID NO: 91353 - DNA, 1191 bp, Artificial Sequence
  Description of Artificial Sequence: Synthetic coding sequence
atggcctgcgccggcctgctgaccgtgtgcctgctgagaccccccgccccccagccccagccccagacccccagacacccccagctggcccccgaccccggccccgccggccacaccctgttccaggacgtgttcagaagagccgacaagaacgacgacggcaagctgagcttcgaggagttccagaactacttcgccgacggcgtgctgagcctgggcgagctgcaggagctgttcagcggcatcgacggccacctgaccgacaacctggagaccgagaagctgtgcgactacttcagcgagcacctgggcgtgtacagacccgtgctggccgccctggagagcctgaacagagccgtgctggccgccatggacgccaccaagctggagtacgagagagccagcaaggtggaccagttcgtgaccagattcctgctgagagagaccgtgagccagctgcaggccctgcagagcagcctggagggcgccagcgacaccctggaggcccaggcccacggctggagaagcgacgccgagagcgtggaggcccagagcagactgtgcggcagcagaagagccggcagaagagccctgagaagcgtgagcagaagcagcacctggagccccggcagcagcgacaccggcagaagcagcgaggccgagatgcagtggagactgcaggtgaacagactgcaggagctgatcgaccagctggagtgcaaggtgagagccgtgggccccggcccccacaagggcggccccagctggtacccccccgagcccggcccctgctggagacccggcccccacagcgtgcccagccaggcccccagactggagcccctgagagaggaggacctggccaagggccccgacctgcacatcctgatggcccagagacaggtgcaggtggccgaggagggcctgcaggacttccacagagccctgagatgctacgtggacttcaccggcgcccagagccactgcctgcacgtgagcgcccagaagatgctggacggcgccagcttcaccctgtacgagttctggcaggacgaggccagctggagaagacaccagcagagccccggcagcaaggccttccagagaatcctgatcgaccacctgagagcccccgacaccctgaccaccgtgttcttccccgccagctggtggatcatgaacaacaactag

SEQ ID NO: 91354 - DNA, 1089 bp, Artificial Sequence
  Description of Artificial Sequence: Synthetic coding sequence
atggcctgcgccggcctgctgaccgtgtgcctgctgagaccccccgccccccagccccagccccagacccccagacacccccagctggcccccgaccccggccccgccggccacaccctgttccaggacgtgttcagaagagccgacaagaacgacgacggcaagctgagcttcgaggagttccagaactacttcgccgacggcgtgctgagcctgggcgagctgcaggagctgttcagcggcatcgacggccacctgaccgacaacctggagaccgagaagctgtgcgactacttcagcgagcacctgggcgtgtacagacccgtgctggccgccctggagagcctgaacagagccgtgctggccgccatggacgccaccaagctggagtacgagagagccagcaaggtggaccagttcgtgaccagattcctgctgagagagaccgtgagccagctgcaggccctgcagagcagcctggagggcgccagcgacaccctggaggcccaggcccacggctggagaagcgacgccgagagcgtggaggcccagagcagactgtgcggcagcagaagagccggcagaagagccctgagaagcgtgagcagaagcagcacctggagccccggcagcagcgacaccggcagaagcagcgaggccgagatgcagtggagactgcaggtgaacagactgcaggagctgatcgaccagctggagtgcaaggcccccagactggagcccctgagagaggaggacctggccaagggccccgacctgcacatcctgatggcccagagacaggtgcaggtggccgaggagggcctgcaggacttccacagagccctgagatgctacgtggacttcaccggcgcccagagccactgcctgcacgtgagcgcccagaagatgctggacggcgccagcttcaccctgtacgagttctggcaggacgaggccagctggagaagacaccagcagagccccggcagcaaggccttccagagaatcctgatcgaccacctgagagcccccgacaccctgaccaccgtgttcttccccgccagctggtggatcatgaacaacaactag

SEQ ID NO: 91355 - DNA, 870 bp, Artificial Sequence
  Description of Artificial Sequence: Synthetic coding sequence
atggcctgcgccggcctgctgaccgtgtgcctgctgagaccccccgccccccagccccagccccagacccccagacacccccagctggcccccgaccccggccccgccggccacaccctgttccaggacgtgttcagaagagccgacaagaacgacgacggcaagctgagcttcgaggagttccagaactacttcgccgacggcgtgctgagcctgggcgagctgcaggagctgttcagcggcatcgacggccacctgaccgacaacctggagaccgagaagctgtgcgactacttcagcgagcacctgggcgtgtacagacccgtgctggccgccctggagagcctgaacagagccgtgctggccgccatggacgccaccaagctggagtacgagagagccagcaaggtggaccagttcgtgaccagattcctgctgagagagaccgtgagccagctgcaggccctgcagagcagcctggagggcgccagcgacaccctggaggcccaggcccacggctggagaagcgacgccgagagcgtggaggcccagagcagactgtgcggcagcagaagagccggcagaagagccctgagaagcgtgagcagaagcagcacctggagccccggcagcagcgacaccggcagaagcagcgaggccgagatgcagtggagactgcaggtgaacagactgcaggagctgatcgaccagctggagtgcaagcacatcctgatggcccagagacaggtgcaggtggccgaggagggcctgcaggacttccacagagccctgagatgctacgtggacttcaccggcgcccagagccactgcctgcacgtgagcgcccagaagatgctggacggcgcctag

SEQ ID NO: 91356 - DNA, 423 bp, Artificial Sequence
  Description of Artificial Sequence: Synthetic coding sequence
atggccagcgtggacttcaagacctacgtggaccaggcctgcagagccgccgaggagttcgtgaacgtgtactacaccaccatggacaagagaagaagactgctgagcagactgtacatgggcaccgccaccctggtgtggaacggcaacgccgtgagcggccaggagagcctgagcgagttcttcgagatgctgcccagcagcgagttccagatcagcgtggtggactgccagcccgtgcacgacgaggccacccccagccagaccaccgtgctggtggtgatctgcggcagcgtgaagttcgagggcaacaagcagagagacttcaaccagaacttcatcctgaccgcccaggccagccccagcaacaccgtgtggaagatcgccagcgactgcttcagattccaggactgggccagctag

SEQ ID NO: 91357 - DNA, 984 bp, Artificial Sequence
  Description of Artificial Sequence: Synthetic coding sequence
atggccgtgcccgccaagaagagaaagatgaacttcagcgagagagaggtggagatcatcgtggaggagctggagctgaagaagcacctgctggtgaaccacttcaacgccggcgtgcccctggccgccaagagcgccgcctggcacggcatcctgagaagagtgaacgccgtggccacctgcagaagagagctgcccgaggtgaagaagaagtggagcgacctgaagaccgaggtgagaagaaaggtggcccaggtgagagccgccgtggagggcggcgaggcccccggccccaccgaggaggacggcgccggcggccccggcaccggcggcggcagcggcggcggcggccccgccgtggcccccgtgctgctgacccccatgcagcagagaatctgcaacctgctgggcgaggccaccatcatcagcctgcccagcaccaccgagatccaccccgtggccctgggccccagcgccaccgccgccgccgccaccgtgaccctgacccagatccccaccgagaccacctaccacaccctggaggagggcgtggtggagtactgcaccgccgaggcccccccccccctgccccccgagacccccgtggacatgatggcccagcacgccgacaccagcgtgaagccccaggccctgaagagcagaatcgccctgaacagcgccaagctgatccaggagcagagagtgaccaacctgcacgtgaaggagatcgcccagcacctggagcagcagaacgacctgctgcagatgatcagaagaagccaggaggtgcaggcctgcgcccaggagagacaggcccaggccatggagggcacccaggccgccctgagcgtgctgatccaggtgctgagacccatgatcaaggacttcagaagatacctgcagagcaacaccgccaaccccgcccccgccagcgaccccggccaggtggcccagaacggccagcccgacagcatcatccagtag

SEQ ID NO: 91358 - DNA, 1485 bp, Artificial Sequence
  Description of Artificial Sequence: Synthetic coding sequence
atggaggtggtggaggccgccgccgcccagctggagaccctgaagttcaacggcaccgacttcggcgtgggcgagggccccgccgcccccagccccggcagcgcccccgtgcccggcacccagccccccctgcagagcttcgagggcagccccgacgccggccagaccgtggaggtgaagcccgccggcgagcagcccctgcagcccgtgctgaacgccgtggccgccggcacccccgccccccagccccagccccccgccgagagccccgcctgcggcgactgcgtgaccagccccggcgccgccgagcccgccagagcccccgacagcctggagaccagcgacagcgacagcgacagcgacagcgagaccgacagcgacagcagcagcagcagcagcagcagcagcagcagcagcagcagcagcagcagcagctgcatcagcctgccccccgtgctgagcgacggcgacgacgacctgcagatcgagaaggagaacaagaacttccccctgaagaccaaggacgagctgctgctgaacgagctgcccagcgtggaggagctgaccatcatcctgcccgaggacatcgagctgaagcccctgggcatggtgagcagcatcatcgagcagctggtgatcatcgagagcatgaccaacctgccccccgtgaacgaggagaccgtgatcttcaagagcgacagacaggccgccggcaagatcttcgagatcttcggccccgtggcccaccccttctacgtgctgagattcaacagcagcgaccacatcgagagcaagggcatcaagatcaaggagaccatgtacttcgcccccagcatgaaggacttcacccagtacatcttcaccgagaagctgaagcaggacaagggcagcgacgccagctggaagaacgaccaggagcccccccccgaggccctggacttcagcgacgacgagaaggagaaggaggccaagcagagaaagaagagccagatccagggcagaaagaagctgaagagcgagttcaacgagcccggcgaggacttcaccgaggtgcaccagaactggaacgcccacagcagcgccagcgagcacgccaagggctacagaaacagagagttcaccagaggcttcagcagagccagataccccagaagctgccacggcagaccccccccccagcacttctacaacagcgagcacatggtgagccaggagaccagcggcttccccagccagagacagaacaaccccatcatgccccagtaccccttccccctgcccgtgttcgacatgcacaacttccccctgagacccccccccccccccccccccccccccgtgaacatgggctgggccacccccaacatggccgcccaccccctgctgaacctgccctacagcctgccccccccccccccccccccccccctgccccccccccccagcagcggcgacagcaacagccacttcggcccctactactag

SEQ ID NO: 91359 - DNA, 1170 bp, Artificial Sequence
  Description of Artificial Sequence: Synthetic coding sequence
atggaggtggtggaggccgccgccgcccagctggagaccctgaagttcaacggcaccgacttcggcgtgggcgagggccccgccgcccccagccccggcagcgcccccgtgcccggcacccagccccccctgcagagcttcgagggcagccccgacgccggccagaccgtggaggtgaagcccgccggcgagcagcccctgcagcccgtgctgaacgccgtggccgccggcacccccgccccccagccccagccccccgccgagagccccgcctgcggcgactgcgtgaccagccccggcgccgccgagcccgccagagcccccgacagcctggagaccagcgacagcgacagcgacagcgacagcgagaccgacagcgacagcagcagcagcagcagcagcagcagcagcagcagcagcagcagcagcagcagctgcatcagcctgccccccgtgctgagcgacggcgacgacgacctgcagatcgagaaggagaacaagaacttccccctgaagaccaaggacgagctgctgctgaacgagctgcccagcgtggaggagctgaccatcatcctgcccgaggacatcgagctgaagcccctgggcatggtgagcagcatcatcgagcagctggtgatcatcgagagcatgaccaacctgccccccgtgaacgaggagaccgtgatcttcaagagcgacagacaggccgccggcaagatcttcgagatcttcggccccgtggcccaccccttctacgtgctgagattcaacagcagcgaccacatcgagagcaagggcatcaagatcaaggagaccatgtacttcgcccccagcatgaaggacttcacccagtacatcttcaccgagaagctgaagcaggacaagggcagcgacgccagctggaagaacgaccaggagcccccccccgaggccctggacttcagcgacgacgagaaggagaaggaggccaagcagagaaagaagagccagatccagggcagaaagaagctgaagagcgagttcaacgagcccggcaccggcatcagccacagatactgcggcctgggcagcagacccctgcagagcagcgagagccacaagctgttcggcttccagatgcacatcaaggtgaccttcacctgctacttcagcctgctgagcatgcagtag

SEQ ID NO: 91360 - DNA, 345 bp, Artificial Sequence
  Description of Artificial Sequence: Synthetic coding sequence
ctggccagcagactgggccccgtgagcaccgccaacatgagcagacccgtgagaaacagaaaggtggtggactacagccagttccaggagagcgacgacgccgacttcgagagcgaggacagcgaggacaaggacgtgaagaccaagaaggacgacagccacagcgccgaggacagcgaggacgagaaggaggaccacaagaacgtgagacagcagagacaggccgccagcaaggccgccagcaagcagagagagatgctgatggaggacgtgggcagcgaggaggagcaggaggaggaggacgaggcccccttccaggagagaaaggacagcttcagccagtag

SEQ ID NO: 91361 - DNA, 732 bp, Artificial Sequence
  Description of Artificial Sequence: Synthetic coding sequence
atgagcagacccgtgagaaacagaaaggtggtggactacagccagttccaggagagcgacgacgccgacgaggactacggcagagacagcggcccccccaccaagaagatcagaagcagccccagagaggccaagaacaagagaagaagcggcaagaacagccaggaggacagcgaggacagcgaggacaaggacgtgaagaccaagaaggacgacagccacagcgccgaggacagcgaggacgagaaggaggaccacaagaacgtgagacagcagagacaggccgccagcaaggccgccagcaagcagagagagatgctgatggaggacgtgggcagcgaggaggagcaggaggaggaggacgaggcccccttccaggagaaggacagcggcagcgacgaggacttcctgatggaggacgacgacgacagcgactacggcagcagcaagaagaagaacaagaagatggtgaagaagagcaagcccgagagaaaggagaagaagatgcccaagcccagactgaaggccaccgtgacccccagccccgtgaagggcaagggcaaggtgggcagacccaccgccagcaaggccagcaaggagaagacccccagccccaaggaggaggacgaggagcccgagagcccccccgagaagaagaccagcaccagccccccccccgagaagagcggcgacgagggcagcgaggacgaggcccccagcggcgaggactag

SEQ ID NO: 91362 - DNA, 1122 bp, Artificial Sequence
  Description of Artificial Sequence: Synthetic coding sequence
atgagcccctgccccccccagcagagcagaaacagagtgatccagctgagcaccagcgagctgggcgagatggagctgacctggcaggagatcatgagcatcaccgagctgcagggcctgaacgcccccagcgagcccagcttcgagccccaggcccccgccccctacctgggcccccccccccccaccacctactgcccctgcagcatccaccccgacagcggcttccccctgcccccccccccctacgagctgcccgccagcaccagccacgtgcccgaccccccctacagctacggcaacatggccatccccgtgagcaagcccctgagcctgagcggcctgctgagcgagcccctgcaggaccccctggccctgctggacatcggcctgcccgccggcccccccaagccccaggaggaccccgagagcgacagcggcctgagcctgaactacagcgacgccgagagcctggagctggagggcaccgaggccggcagaagaagaagcgagtacgtggagatgtaccccgtggagtacccctacagcctgatgcccaacagcctggcccacagcaactacaccctgcccgccgccgagacccccctggccctggagcccagcagcggccccgtgagagccaagcccaccgccagaggcgaggccggcagcagagacgagagaagagccctggccatgaagatccccttccccaccgacaagatcgtgaacctgcccgtggacgacttcaacgagctgctggccagataccccctgaccgagagccagctggccctggtgagagacatcagaagaagaggcaagaacaaggtggccgcccagaactgcagaaagagaaagctggagaccatcgtgcagctggagagagagctggagagactgaccaacgagagagagagactgctgagagccagaggcgaggccgacagaaccctggaggtgatgagacagcagctgaccgagctgtacagagacatcttccagcacctgagagacgagagcggcaacagctacagccccgaggagtacgccctgcagcaggccgccgacggcaccatcttcctggtgcccagaggcaccaagatggaggccaccgactag

SEQ ID NO: 91363 - DNA, 1122 bp, Artificial Sequence; identical to SEQ ID NO: 91362
  Description of Artificial Sequence: Synthetic coding sequence

SEQ ID NO: 91364 - DNA, 1122 bp, Artificial Sequence; identical to SEQ ID NO: 91362
  Description of Artificial Sequence: Synthetic coding sequence

SEQ ID NO: 91365 - DNA, 1122 bp, Artificial Sequence; identical to SEQ ID NO: 91362
  Description of Artificial Sequence: Synthetic coding sequence

SEQ ID NO: 91366 - DNA, 1032 bp, Artificial Sequence
  Description of Artificial Sequence: Synthetic coding sequence
atgagcccctgccccccccagcagagcagaaacagagtgatccagctgagcaccagcgagctgggcgagatggagctgacctggcaggagatcatgagcatcaccgagctgcagggcctgaacgcccccagcgagcccagcttcgagccccaggcccccgccccctacctgggcccccccccccccaccacctactgcccctgcagcatccaccccgacagcggcttccccctgcccccccccccctacgagctgcccgccagcaccagccacgtgcccgaccccccctacagctacggcaacatggccatccccgtgagcaagcccctgagcctgagcggcctgctgagcgagcccctgcaggaccccctggccctgctggacatcggcctgcccgccggcccccccaagccccaggaggaccccgagagcgacagcggcctgagcctgaactacagcgacgccgagagcctggagctggagggcaccgaggccggcagaagaagaagcgagtacgtggagatgtaccccgtggagtacccctacagcctgatgcccaacagcctggcccacagcaactacaccctgcccgccgccgagacccccctggccctggagcccagcagcggccccgtgagagccaagcccaccgccagaggcgaggccggcagcagagacgagagaagagccctggccatgaagatccccttccccaccgacaagatcgtgaacctgcccgtggacgacttcaacgagctgctggccagataccccctgaccgagagccagctggccctggtgagagacatcagaagaagaggcaagaacaaggtggccgcccagaactgcagaaagagaaagctggagaccatcgtgcagctggagagagagctggagagactgaccaacgagagagagagactgctgagagccagaggcgaggccgacagaaccctggaggtgatgagacagcagctgaccgagctgtacagagacatcttccagcacctgagagacgagagcggcaactag

SEQ ID NO: 91367 - DNA, 2229 bp, Artificial Sequence
  Description of Artificial Sequence: Synthetic coding sequence
atgctgagcctgaagaagtacctgaccgagggcctgctgcagttcaccatcctgctgagcctgatcggcgtgagagtggacgtggacacctacctgaccagccagctgccccccctgagagagatcatcctgggccccagcagcgcctacacccagacccagttccacaacctgagaaacaccctggacggctacggcatccaccccaagagcatcgacctggacaactacttcaccgccagaagactgctgagccaggtgagagccctggacagattccaggtgcccaccaccgaggtgaacgcctggctggtgcacagagaccccgagggcagcgtgagcggcagccagcccaacagcggcctggccctggagagcagcagcggcctgcaggacgtgaccggccccgacaacggcgtgagagagagcgagaccgagcagggcttcggcgaggacctggaggacctgggcgccgtggccccccccgtgagcggcgacctgaccaaggaggacatcgacctgatcgacatcctgtggagacaggacatcgacctgggcgccggcagagaggtgttcgactacagccacagacagaaggagcaggacgtggagaaggagctgagagacggcggcgagcaggacacctgggccggcgagggcgccgaggccctggccagaaacctgctggtggacggcgagaccggcgagagcttccccgcccagttccccgccgacatcagcagcatcaccgaggccgtgcccagcgagagcgagccccccgccctgcagaacaacctgctgagccccctgctgaccggcaccgagagccccttcgacctggagcagcagtggcaggacctgatgagcatcatggagatgcaggccatggaggtgaacaccagcgccagcgagatcctgtacagcgccccccccggcgaccccctgagcaccaactacagcctggcccccaacacccccatcaaccagaacgtgagcctgcaccaggccagcctgggcggctgcagccaggacttcctgctgttcagccccgaggtggagagcctgcccgtggccagcagcagcaccctgctgcccctggcccccagcaacagcaccagcctgaacagcaccttcggcagcaccaacctgaccggcctgttcttccccccccagctgaacggcaccgccaacgacaccgccggccccgagctgcccgaccccctgggcggcctgctggacgaggccatgctggacgagatcagcctgatggacctggccatcgaggagggcttcaaccccgtgcaggccagccagctggaggaggagttcgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgccgtgggctacagcagcgacagcgagaccctggacctggaggaggccgagggcgccgtgggctaccagcccgagtacagcaagttctgcagaatgagctaccaggaccccgcccagctgagctgcctgccctacctggagcacgtgggccacaaccacacctacaacatggcccccagcgccctggacagcgccgacctgcccccccccagcgccctgaagaagggcagcaaggagaagcaggccgacttcctggacaagcagatgagcagagacgagcacagagccagagccatgaagatccccttcaccaacgacaagatcatcaacctgcccgtggaggagttcaacgagctgctgagcaagtaccagctgagcgaggcccagctgagcctgatcagagacatcagaagaagaggcaagaacaagatggccgcccagaactgcagaaagagaaagctggacaccatcctgaacctggagagagacgtggaggacctgcagagagacaaggccagactgctgagagagaaggtggagttcctgagaagcctgagacagatgaagcagaaggtgcagagcctgtaccaggaggtgttcggcagactgagagacgagaacggcagaccctacagccccagccagtacgccctgcagtacgccggcgacggcagcgtgctgctgatccccagaaccatggccgaccagcaggccagaagacaggagagaaagcccaaggacagaagaaagtag

SEQ ID NO: 91368 - DNA, 2319 bp, Artificial Sequence
  Description of Artificial Sequence: Synthetic coding sequence
atgctgagcctgaagaagtacctgaccgagggcctgctgcagttcaccatcctgctgagcctgatcggcgtgagagtggacgtggacacctacctgaccagccagctgccccccctgagagagatcatcctgggccccagcagcgcctacacccagacccagttccacaacctgagaaacaccctggacggctacggcatccaccccaagagcatcgacctggacaactacttcaccgccagaagactgctgagccaggtgagagccctggacagattccaggtgcccaccaccgaggtgaacgcctggctggtgcacagagaccccgagggcagcgtgagcggcagccagcccaacagcggcctggccctggagagcagcagcggcctgcaggacgtgaccggccccgacaacggcgtgagagagagcgagaccgagcagggcttcggcgaggacctggaggacctgggcgccgtggccccccccgtgagcggcgacctgaccaaggaggacatcgacctgatcgacatcctgtggagacaggacatcgacctgggcgccggcagagaggtgttcgactacagccacagacagaaggagcaggacgtggagaaggagctgagagacggcggcgagcaggacacctgggccggcgagggcgccgaggccctggccagaaacctgctggtggacggcgagaccggcgagagcttccccgcccaggtgcccagcggcgaggaccagaccgccctgagcctggaggagtgcctgagactgctggaggccacctgccccttcggcgagaacgccgagttccccgccgacatcagcagcatcaccgaggccgtgcccagcgagagcgagccccccgccctgcagaacaacctgctgagccccctgctgaccggcaccgagagccccttcgacctggagcagcagtggcaggacctgatgagcatcatggagatgcaggccatggaggtgaacaccagcgccagcgagatcctgtacagcgccccccccggcgaccccctgagcaccaactacagcctggcccccaacacccccatcaaccagaacgtgagcctgcaccaggccagcctgggcggctgcagccaggacttcctgctgttcagccccgaggtggagagcctgcccgtggccagcagcagcaccctgctgcccctggcccccagcaacagcaccagcctgaacagcaccttcggcagcaccaacctgaccggcctgttcttccccccccagctgaacggcaccgccaacgacaccgccggccccgagctgcccgaccccctgggcggcctgctggacgaggccatgctggacgagatcagcctgatggacctggccatcgaggagggcttcaaccccgtgcaggccagccagctggaggaggagttcgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgccgtgggctacagcagcgacagcgagaccctggacctggaggaggccgagggcgccgtgggctaccagcccgagtacagcaagttctgcagaatgagctaccaggaccccgcccagctgagctgcctgccctacctggagcacgtgggccacaaccacacctacaacatggcccccagcgccctggacagcgccgacctgcccccccccagcgccctgaagaagggcagcaaggagaagcaggccgacttcctggacaagcagatgagcagagacgagcacagagccagagccatgaagatccccttcaccaacgacaagatcatcaacctgcccgtggaggagttcaacgagctgctgagcaagtaccagctgagcgaggcccagctgagcctgatcagagacatcagaagaagaggcaagaacaagatggccgcccagaactgcagaaagagaaagctggacaccatcctgaacctggagagagacgtggaggacctgcagagagacaaggccagactgctgagagagaaggtggagttcctgagaagcctgagacagatgaagcagaaggtgcagagcctgtaccaggaggtgttcggcagactgagagacgagaacggcagaccctacagccccagccagtacgccctgcagtacgccggcgacggcagcgtgctgctgatccccagaaccatggccgaccagcaggccagaagacaggagagaaagcccaaggacagaagaaagtag

SEQ ID NO: 91369 - DNA, 2376 bp, Artificial Sequence
  Description of Artificial Sequence: Synthetic coding sequence
ttcgtgttctggaagatcctgaagaccaagaagcacaagcacagcggccccagcgccatgctgagcctgaagaagtacctgaccgagggcctgctgcagttcaccatcctgctgagcctgatcggcgtgagagtggacgtggacacctacctgaccagccagctgccccccctgagagagatcatcctgggccccagcagcgcctacacccagacccagttccacaacctgagaaacaccctggacggctacggcatccaccccaagagcatcgacctggacaactacttcaccgccagaagactgctgagccaggtgagagccctggacagattccaggtgcccaccaccgaggtgaacgcctggctggtgcacagagaccccgagggcagcgtgagcggcagccagcccaacagcggcctggccctggagagcagcagcggcctgcaggacgtgaccggccccgacaacggcgtgagagagagcgagaccgagcagggcttcggcgaggacctggaggacctgggcgccgtggccccccccgtgagcggcgacctgaccaaggaggacatcgacctgatcgacatcctgtggagacaggacatcgacctgggcgccggcagagaggtgttcgactacagccacagacagaaggagcaggacgtggagaaggagctgagagacggcggcgagcaggacacctgggccggcgagggcgccgaggccctggccagaaacctgctggtggacggcgagaccggcgagagcttccccgcccaggtgcccagcggcgaggaccagaccgccctgagcctggaggagtgcctgagactgctggaggccacctgccccttcggcgagaacgccgagttccccgccgacatcagcagcatcaccgaggccgtgcccagcgagagcgagccccccgccctgcagaacaacctgctgagccccctgctgaccggcaccgagagccccttcgacctggagcagcagtggcaggacctgatgagcatcatggagatgcaggccatggaggtgaacaccagcgccagcgagatcctgtacagcgccccccccggcgaccccctgagcaccaactacagcctggcccccaacacccccatcaaccagaacgtgagcctgcaccaggccagcctgggcggctgcagccaggacttcctgctgttcagccccgaggtggagagcctgcccgtggccagcagcagcaccctgctgcccctggcccccagcaacagcaccagcctgaacagcaccttcggcagcaccaacctgaccggcctgttcttccccccccagctgaacggcaccgccaacgacaccgccggccccgagctgcccgaccccctgggcggcctgctggacgaggccatgctggacgagatcagcctgatggacctggccatcgaggagggcttcaaccccgtgcaggccagccagctggaggaggagttcgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgccgtgggctacagcagcgacagcgagaccctggacctggaggaggccgagggcgccgtgggctaccagcccgagtacagcaagttctgcagaatgagctaccaggaccccgcccagctgagctgcctgccctacctggagcacgtgggccacaaccacacctacaacatggcccccagcgccctggacagcgccgacctgcccccccccagcgccctgaagaagggcagcaaggagaagcaggccgacttcctggacaagcagatgagcagagacgagcacagagccagagccatgaagatccccttcaccaacgacaagatcatcaacctgcccgtggaggagttcaacgagctgctgagcaagtaccagctgagcgaggcccagctgagcctgatcagagacatcagaagaagaggcaagaacaagatggccgcccagaactgcagaaagagaaagctggacaccatcctgaacctggagagagacgtggaggacctgcagagagacaaggccagactgctgagagagaaggtggagttcctgagaagcctgagacagatgaagcagaaggtgcagagcctgtaccaggaggtgttcggcagactgagagacgagaacggcagaccctacagccccagccagtacgccctgcagtacgccggcgacggcagcgtgctgctgatccccagaaccatggccgaccagcaggccagaagacaggagagaaagcccaaggacagaagaaagtag

SEQ ID NO: 91370 - DNA, 1851 bp, Artificial Sequence
  Description of Artificial Sequence: Synthetic coding sequence
atgaccagactggacagaagcagccacagcggcggcggccacgccaagggcagcagacccctgaacagcctgctggccggccacagagtggcccagcccgccagcgcccccggcagcagagccagcgtgcaggacatcgacctgatcgacatcctgtggagacaggacatcgacctgggcgccggcagagaggtgttcgactacagccacagacagaaggagcaggacgtggagaaggagctgagagacggcggcgagcaggacacctgggccggcgagggcgccgaggccctggccagaaacctgctggtggacggcgagaccggcgagagcttccccgcccagttccccgccgacatcagcagcatcaccgaggccgtgcccagcgagagcgagccccccgccctgcagaacaacctgctgagccccctgctgaccggcaccgagagccccttcgacctggagcagcagtggcaggacctgatgagcatcatggagatgcaggccatggaggtgaacaccagcgccagcgagatcctgtacagcgccccccccggcgaccccctgagcaccaactacagcctggcccccaacacccccatcaaccagaacgtgagcctgcaccaggccagcctgggcggctgcagccaggacttcctgctgttcagccccgaggtggagagcctgcccgtggccagcagcagcaccctgctgcccctggcccccagcaacagcaccagcctgaacagcaccttcggcagcaccaacctgaccggcctgttcttccccccccagctgaacggcaccgccaacgacaccgccggccccgagctgcccgaccccctgggcggcctgctggacgaggccatgctggacgagatcagcctgatggacctggccatcgaggagggcttcaaccccgtgcaggccagccagctggaggaggagttcgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgccgtgggctacagcagcgacagcgagaccctggacctggaggaggccgagggcgccgtgggctaccagcccgagtacagcaagttctgcagaatgagctaccaggaccccgcccagctgagctgcctgccctacctggagcacgtgggccacaaccacacctacaacatggcccccagcgccctggacagcgccgacctgcccccccccagcgccctgaagaagggcagcaaggagaagcaggccgacttcctggacaagcagatgagcagagacgagcacagagccagagccatgaagatccccttcaccaacgacaagatcatcaacctgcccgtggaggagttcaacgagctgctgagcaagtaccagctgagcgaggcccagctgagcctgatcagagacatcagaagaagaggcaagaacaagatggccgcccagaactgcagaaagagaaagctggacaccatcctgaacctggagagagacgtggaggacctgcagagagacaaggccagactgctgagagagaaggtggagttcctgagaagcctgagacagatgaagcagaaggtgcagagcctgtaccaggaggtgttcggcagactgagagacgagaacggcagaccctacagccccagccagtacgccctgcagtacgccggcgacggcagcgtgctgctgatccccagaaccatggccgaccagcaggccagaagacaggagagaaagcccaaggacagaagaaagtag

SEQ ID NO: 91371 - DNA, 1818 bp, Artificial Sequence
  Description of Artificial Sequence: Synthetic coding sequence
atgatggacctggagctgcccccccccggcctgcccagccagcaggacatggacctgatcgacatcctgtggagacaggacatcgacctgggcgtgagcagagaggtgttcgacttcagccagagaagaaaggagtacgagctggagaagcagaagaagctggagaaggagagacaggagcagctgcagaaggagcaggagaaggccttcttcgcccagctgcagctggacgaggagaccggcgagttcctgcccatccagcccgcccagcacatccagagcgagaccagcggcagcgccaactacagccaggtggcccacatccccaagagcgacgccctgtacttcgacgactgcatgcagctgctggcccagaccttccccttcgtggacgacaacgaggtgagcagcgccaccttccagagcctggtgcccgacatccccggccacatcgagagccccgtgttcatcgccaccaaccaggcccagagccccgagaccagcgtggcccaggtggcccccgtggacctggacggcatgcagcaggacatcgagcaggtgtgggaggagctgctgagcatccccgagctgcagtgcctgaacatcgagaacgacaagctggtggagaccaccatggtgcccagccccgaggccaagctgaccgaggtggacaactaccacttctacagcagcatccccagcatggagaaggaggtgggcaactgcagcccccacttcctgaacgccttcgaggacagcttcagcagcatcctgagcaccgaggaccccaaccagctgaccgtgaacagcctgaacagcgacgccaccgtgaacaccgacttcggcgacgagttctacagcgccttcatcgccgagcccagcatcagcaacagcatgcccagccccgccaccctgagccacagcctgagcgagctgctgaacggccccatcgacgtgagcgacctgagcctgtgcaaggccttcaaccagaaccaccccgagagcaccgccgagttcaacgacagcgacagcggcatcagcctgaacaccagccccagcgtggccagccccgagcacagcgtggagagcagcagctacggcgacaccctgctgggcctgagcgacagcgaggtggaggagctggacagcgcccccggcagcgtgaagcagaacggccccaagacccccgtgcacagcagcggcgacatggtgcagcccctgagccccagccagggccagagcacccacgtgcacgacgcccagtgcgagaacacccccgagaaggagctgcccgtgagccccggccacagaaagacccccttcaccaaggacaagcacagcagcagactggaggcccacctgaccagagacgagctgagagccaaggccctgcacatccccttccccgtggagaagatcatcaacctgcccgtggtggacttcaacgagatgatgagcaaggagcagttcaacgaggcccagctggccctgatcagagacatcagaagaagaggcaagaacaaggtggccgcccagaactgcagaaagagaaagctggagaacatcgtggagctggagcaggacctggaccacctgaaggacgagaaggagaagctgctgaaggagaagggcgagaacgacaagagcctgcacctgctgaagaagcagctgagcaccctgtacctggaggtgttcagcatgctgagagacgaggacggcaagccctacagccccagcgagtacagcctgcagcagaccagagacggcaacgtgttcctggtgcccaagagcaagaagcccgacgtgaagaagaactag

SEQ ID NO: 91372 - DNA, 1770 bp, Artificial Sequence
  Description of Artificial Sequence: Synthetic coding sequence
atggacctgatcgacatcctgtggagacaggacatcgacctgggcgtgagcagagaggtgttcgacttcagccagagaagaaaggagtacgagctggagaagcagaagaagctggagaaggagagacaggagcagctgcagaaggagcaggagaaggccttcttcgcccagctgcagctggacgaggagaccggcgagttcctgcccatccagcccgcccagcacatccagagcgagaccagcggcagcgccaactacagccaggtggcccacatccccaagagcgacgccctgtacttcgacgactgcatgcagctgctggcccagaccttccccttcgtggacgacaacgaggtgagcagcgccaccttccagagcctggtgcccgacatccccggccacatcgagagccccgtgttcatcgccaccaaccaggcccagagccccgagaccagcgtggcccaggtggcccccgtggacctggacggcatgcagcaggacatcgagcaggtgtgggaggagctgctgagcatccccgagctgcagtgcctgaacatcgagaacgacaagctggtggagaccaccatggtgcccagccccgaggccaagctgaccgaggtggacaactaccacttctacagcagcatccccagcatggagaaggaggtgggcaactgcagcccccacttcctgaacgccttcgaggacagcttcagcagcatcctgagcaccgaggaccccaaccagctgaccgtgaacagcctgaacagcgacgccaccgtgaacaccgacttcggcgacgagttctacagcgccttcatcgccgagcccagcatcagcaacagcatgcccagccccgccaccctgagccacagcctgagcgagctgctgaacggccccatcgacgtgagcgacctgagcctgtgcaaggccttcaaccagaaccaccccgagagcaccgccgagttcaacgacagcgacagcggcatcagcctgaacaccagccccagcgtggccagccccgagcacagcgtggagagcagcagctacggcgacaccctgctgggcctgagcgacagcgaggtggaggagctggacagcgcccccggcagcgtgaagcagaacggccccaagacccccgtgcacagcagcggcgacatggtgcagcccctgagccccagccagggccagagcacccacgtgcacgacgcccagtgcgagaacacccccgagaaggagctgcccgtgagccccggccacagaaagacccccttcaccaaggacaagcacagcagcagactggaggcccacctgaccagagacgagctgagagccaaggccctgcacatccccttccccgtggagaagatcatcaacctgcccgtggtggacttcaacgagatgatgagcaaggagcagttcaacgaggcccagctggccctgatcagagacatcagaagaagaggcaagaacaaggtggccgcccagaactgcagaaagagaaagctggagaacatcgtggagctggagcaggacctggaccacctgaaggacgagaaggagaagctgctgaaggagaagggcgagaacgacaagagcctgcacctgctgaagaagcagctgagcaccctgtacctggaggtgttcagcatgctgagagacgaggacggcaagccctacagccccagcgagtacagcctgcagcagaccagagacggcaacgtgttcctggtgcccaagagcaagaagcccgacgtgaagaagaactag

SEQ ID NO: 91373 - DNA, 705 bp, Artificial Sequence
  Description of Artificial Sequence: Synthetic coding sequence
atggacctgatcgacatcctgtggagacaggacatcgacctgggcgtgagcagagaggtgttcgacttcagccagagaagaaaggagtacgagctggagaagcagaagaagctggagaaggagagacaggagcagctgcagaaggagcaggagaaggccttcttcgcccagctgcagctggacgaggagaccggcgagttcctgcccatccagcccgcccagcacatccagagcgagaccagcggcagcgccaactacagccaggtggcccacatccccaagagcgacgccctgtacttcgacgactgcatgcagctgctggcccagaccttccccttcgtggacgacaacgaggtgagcagcgccaccttccagagcctggtgcccgacatccccggccacatcgagagccccgtgttcatcgccaccaaccaggcccagagccccgagaccagcgtggcccaggtggcccccgtggacctggacggcatgcagcaggacatcgagcaggtgtgggaggagctgctgagcatccccgagctgcagtgcctgaacatcgagaacgacaagctggtggagaccaccatggtgcccagccccgaggccaagctgaccgaggtggacaactaccacttctacagcagcatccccagcatggagaaggaggtgggcaactgcagcccccacttcctgaacgccttctag

SEQ ID NO: 91374 - DNA, 843 bp, Artificial Sequence
  Description of Artificial Sequence: Synthetic coding sequence
atggacctgatcgacatcctgtggagacaggacatcgacctgggcgtgagcagagaggtgttcgacttcagccagagaagaaaggagtacgagctggagaagcagaagaagctggagaaggagagacaggagcagctgcagaaggagcaggagaaggccttcttcgcccagctgcagctggacgaggagaccggcgagttcctgcccatccagcccgcccagcacatccagagcgagaccagcggcagcgccaactacagccaggtggcccacatccccaagagcgacgccctgtacttcgacgactgcatgcagctgctggcccagaccttccccttcgtggacgacaacgaggtgagcagcgccaccttccagagcctggtgcccgacatccccggccacatcgagagccccgtgttcatcgccaccaaccaggcccagagccccgagaccagcgtggcccaggtggcccccgtggacctggacggcatgcagcaggacatcgagcaggtgtgggaggagctgctgagcatccccgagctgcagtgcctgaacatcgagaacgacaagctggtggagaccaccatggtgcccagccccgaggccaagctgaccgaggtggacaactaccacttctacagcagcatccccagcatggagaaggaggtgggcaactgcagcccccacttcctgaacgccttcgaggacagcttcagcagcatcctgagcaccgaggaccccaaccagctgaccgtgaacagcctgaacagcgacgccaccgtgaacaccgacttcggcgacgagttctacagcgccttcatcgccgagcccagcatcagctag

SEQ ID NO: 91375 - DNA, 1749 bp, Artificial Sequence
  Description of Artificial Sequence: Synthetic coding sequence
atggacctgatcgacatcctgtggagacaggacatcgacctgggcgtgagcagagaggtgttcgacttcagccagagaagaaaggagtacgagctggagaagcagaagaagctggagaaggagagacaggagcagctgcagaaggagcaggagaaggccttcttcgcccagctgcagctggacgaggagaccggcgagttcctgcccatccagcccgcccagcacatccagagcgagaccagcggcagcgccaactacagccaggtggcccacatccccaagagcgacgccctgtacttcgacgactgcatgcagctgctggcccagaccttccccttcgtggacgacaacgagagcctggtgcccgacatccccggccacatcgagagccccgtgttcatcgccaccaaccaggcccagagccccgagaccagcgtggcccaggtggcccccgtggacctggacggcatgcagcaggacatcgagcaggtgtgggaggagctgctgagcatccccgagctgcagtgcctgaacatcgagaacgacaagctggtggagaccaccatggtgcccagccccgaggccaagctgaccgaggtggacaactaccacttctacagcagcatccccagcatggagaaggaggtgggcaactgcagcccccacttcctgaacgccttcgaggacagcttcagcagcatcctgagcaccgaggaccccaaccagctgaccgtgaacagcctgaacagcgacgccaccgtgaacaccgacttcggcgacgagttctacagcgccttcatcgccgagcccagcatcagcaacagcatgcccagccccgccaccctgagccacagcctgagcgagctgctgaacggccccatcgacgtgagcgacctgagcctgtgcaaggccttcaaccagaaccaccccgagagcaccgccgagttcaacgacagcgacagcggcatcagcctgaacaccagccccagcgtggccagccccgagcacagcgtggagagcagcagctacggcgacaccctgctgggcctgagcgacagcgaggtggaggagctggacagcgcccccggcagcgtgaagcagaacggccccaagacccccgtgcacagcagcggcgacatggtgcagcccctgagccccagccagggccagagcacccacgtgcacgacgcccagtgcgagaacacccccgagaaggagctgcccgtgagccccggccacagaaagacccccttcaccaaggacaagcacagcagcagactggaggcccacctgaccagagacgagctgagagccaaggccctgcacatccccttccccgtggagaagatcatcaacctgcccgtggtggacttcaacgagatgatgagcaaggagcagttcaacgaggcccagctggccctgatcagagacatcagaagaagaggcaagaacaaggtggccgcccagaactgcagaaagagaaagctggagaacatcgtggagctggagcaggacctggaccacctgaaggacgagaaggagaagctgctgaaggagaagggcgagaacgacaagagcctgcacctgctgaagaagcagctgagcaccctgtacctggaggtgttcagcatgctgagagacgaggacggcaagccctacagccccagcgagtacagcctgcagcagaccagagacggcaacgtgttcctggtgcccaagagcaagaagcccgacgtgaagaagaactag

SEQ ID NO: 91376 - DNA, 2085 bp, Artificial Sequence
  Description of Artificial Sequence: Synthetic coding sequence
atgaagcacctgaagagatggtggagcgccggcggcggcctgctgcacctgaccctgctgctgagcctggccggcctgagagtggacctggacctgtacctgctgctgcccccccccaccctgctgcaggacgagctgctgttcctgggcggccccgccagcagcgcctacgccctgagccccttcagcgccagcggcggctggggcagagccggccacctgcaccccaagggcagagagctggaccccgccgccccccccgagggccagctgctgagagaggtgagagccctgggcgtgcccttcgtgcccagaaccagcgtggacgcctggctggtgcacagcgtggccgccggcagcgccgacgaggcccacggcctgctgggcgccgccgccgccagcagcaccggcggcgccggcgccagcgtggacggcggcagccaggccgtgcagggcggcggcggcgaccccagagccgccagaagcggccccctggacgccggcgaggaggagaaggcccccgccgagcccaccgcccaggtgcccgacgccggcggctgcgccagcgaggagaacggcgtgctgagagagaagcacgaggccgtggaccacagcagccagcacgaggagaacgaggagagagtgagcgcccagaaggagaacagcctgcagcagaacgacgacgacgagaacaagatcgccgagaagcccgactgggaggccgagaagaccaccgagagcagaaacgagagacacctgaacggcaccgacaccagcttcagcctggaggacctgttccagctgctgagcagccagcccgagaacagcctggagggcatcagcctgggcgacatccccctgcccggcagcatcagcgacggcatgaacagcagcgcccactaccacgtgaacttcagccaggccatcagccaggacgtgaacctgcacgaggccatcctgctgtgccccaacaacaccttcagaagagaccccaccgccagaaccagccagagccaggagcccttcctgcagctgaacagccacaccaccaaccccgagcagaccctgcccggcaccaacctgaccggcttcctgagccccgtggacaaccacatgagaaacctgaccagccaggacctgctgtacgacctggacatcaacatcttcgacgagatcaacctgatgagcctggccaccgaggacaacttcgaccccatcgacgtgagccagctgttcgacgagcccgacagcgacagcggcctgagcctggacagcagccacaacaacaccagcgtgatcaagagcaacagcagccacagcgtgtgcgacgagggcgccatcggctactgcaccgaccacgagagcagcagccaccacgacctggagggcgccgtgggcggctactaccccgagcccagcaagctgtgccacctggaccagagcgacagcgacttccacggcgacctgaccttccagcacgtgttccacaaccacacctaccacctgcagcccaccgcccccgagagcaccagcgagcccttcccctggcccggcaagagccagaagatcagaagcagatacctggaggacaccgacagaaacctgagcagagacgagcagagagccaaggccctgcacatccccttcagcgtggacgagatcgtgggcatgcccgtggacagcttcaacagcatgctgagcagatactacctgaccgacctgcaggtgagcctgatcagagacatcagaagaagaggcaagaacaaggtggccgcccagaactgcagaaagagaaagctggacatcatcctgaacctggaggacgacgtgtgcaacctgcaggccaagaaggagaccctgaagagagagcaggcccagtgcaacaaggccatcaacatcatgaagcagaagctgcacgacctgtaccacgacatcttcagcagactgagagacgaccagggcagacccgtgaaccccaaccactacgccctgcagtgcacccacgacggcagcatcctgatcgtgcccaaggagctggtggccagcggccacaagaaggagacccagaagggcaagagaaagtag

SEQ ID NO: 91377 - DNA, 1200 bp, Artificial Sequence
  Description of Artificial Sequence: Synthetic coding sequence
atgaacagcagcgcccactaccacgtgaacttcagccaggccatcagccaggacgtgaacctgcacgaggccatcctgctgtgccccaacaacaccttcagaagagaccccaccgccagaaccagccagagccaggagcccttcctgcagctgaacagccacaccaccaaccccgagcagaccctgcccggcaccaacctgaccggcttcctgagccccgtggacaaccacatgagaaacctgaccagccaggacctgctgtacgacctggacatcaacatcttcgacgagatcaacctgatgagcctggccaccgaggacaacttcgaccccatcgacgtgagccagctgttcgacgagcccgacagcgacagcggcctgagcctggacagcagccacaacaacaccagcgtgatcaagagcaacagcagccacagcgtgtgcgacgagggcgccatcggctactgcaccgaccacgagagcagcagccaccacgacctggagggcgccgtgggcggctactaccccgagcccagcaagctgtgccacctggaccagagcgacagcgacttccacggcgacctgaccttccagcacgtgttccacaaccacacctaccacctgcagcccaccgcccccgagagcaccagcaacctgttcagacccggcaagagccagaagatcagaagcagatacctggaggacaccgacagaaacctgagcagagacgagcagagagccaaggccctgcacatccccttcagcgtggacgagatcgtgggcatgcccgtggacagcttcaacagcatgctgagcagatactacctgaccgacctgcaggtgagcctgatcagagacatcagaagaagaggcaagaacaaggtggccgcccagaactgcagaaagagaaagctggacatcatcctgaacctggaggacgacgtgtgcaacctgcaggccaagaaggagaccctgaagagagagcaggcccagtgcaacaaggccatcaacatcatgaagcagaagctgcacgacctgtaccacgacatcttcagcagactgagagacgaccagggcagacccgtgaaccccaaccactacgccctgcagtgcacccacgacggcagcatcctgatcgtgcccaaggagctggtggccagcggccacaagaaggagacccagaagggcaagagaaagtag

SEQ ID NO: 91378 - DNA, 1143 bp, Artificial Sequence
  Description of Artificial Sequence: Synthetic coding sequence
atgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91379 - DNA, 1464 bp, Artificial Sequence
  Description of Artificial Sequence: Synthetic coding sequence
atgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91380 - DNA, 1401 bp, Artificial Sequence
  Description of Artificial Sequence: Synthetic coding sequence
atgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccgccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91381 - DNA, 1665 bp, Artificial Sequence
  Description of Artificial Sequence: Synthetic coding sequence
atgcagatgtgcagacccgccagcagcagcgtgctgtacgtgcccaccagatggcccggcggctgcggcgccacctggcagagctgccccagccccccccccagaagaaccagaatcccccagagacccgccgtgatgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91382 - DNA, 1599 bp, Artificial Sequence
  Description of Artificial Sequence: Synthetic coding sequence
atgaagctggccgacagcgtgatggccggcaaggccagcgacggcagcatcaagtggcagctgtgctacgacatcagcgccagaacctggtggatggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91383 - DNA, 1530 bp, Artificial Sequence
  Description of Artificial Sequence: Synthetic coding sequence
atgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91384 - DNA, 1506 bp, Artificial Sequence
  Description of Artificial Sequence: Synthetic coding sequence
atggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccacctacagcacccccagcaccagccccgccaacagattcgtgagcgtgggccccagagaccccagcttcgtgaacatcccccagcagacccagagctggtacctgggctag

SEQ ID NO: 91385 - DNA, 1497 bp, Artificial Sequence
  Description of Artificial Sequence: Synthetic coding sequence
atgtacagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggaggaggagagagccgtgaaggacgagctgctgagcgagaagcccgaggtgaagcagaagtgggccagcagactgctggccaagctgagaaaggacatcagacccgagtacagagaggacttcgtgctgaccgtgaccggcaagaagcccccctgctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaagagcccccagtgcagcaaccccggcctgtgcgtgcagccccaccacatcggcgtgagcgtgaaggagctggacctgtacctggcctacttcgtgcacgccgccgacagcagccagagcgagagccccagccagcccagcgacgccgacatcaaggaccagcccgagaacggccacctgggcttccaggacagcttcgtgaccagcggcgtgttcagcgtgaccgagctggtgagagtgagccagacccccatcgccgccggcaccggccccaacttcagcctgagcgacctggagagcagcagctactacagcatgagccccggcgccatgagaagaagcctgcccagcaccagcagcaccagcagcaccaagagactgaagagcgtggaggacgagatggacagccccggcgaggagcccttctacaccggccagggcagaagccccggcagcggcagccagagcagcggctggcacgaggtggagcccggcatgcccagccccaccaccctgaagaagagcgagaagagcggcttcagcagccccagccccagccagaccagcagcctgggcaccgccttcacccagcaccacagacccgtgatcaccggccccagagccagcccccacgccacccccagcaccctgcacttccccaccagccccatcatccagcagcccggcccctacttcagccaccccgccatcagataccacccccaggagaccctgaaggagttcgtgcagctggtgtgccccgacgccggccagcaggccggccaggtgggcttcctgaaccccaacggcagcagccagggcaaggtgcacaaccccttcctgcccacccccatgctgcccccccccccccccccccccatggccagacccgtgcccctgcccgtgcccgacaccaagccccccaccaccagcaccgagggcggcgccgccagccccaccagccccatcctggtgcccggcatcaaggtggccgccagccaccacccccccgacagaccccccgaccccttcagcaccctgtag

SEQ ID NO: 91386 - DNA, 603 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcagggcaagaacttcttcagcagcaacaagtgcatcaagatctag

SEQ ID NO: 91387 - DNA, 507 bp, Artificial Sequence
  Description of Artificial Sequence: Synthetic coding sequence
atgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagagctggtacctgggctag

SEQ ID NO: 91388 - DNA, 1341 bp, Artificial Sequence
  Description of Artificial Sequence: Synthetic coding sequence
atggagagaatccccgtgagcgtggacttctgggtggtgtgctgcgccgtgctgaagtgcaaccccggcatccccaagagaatgagcaccctgtgcttcggcttcagcgacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagagctggtacctgggctag

SEQ ID NO: 91389 - DNA, 1485 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagcccaacggcagcggccaggtggtgggcaaggtgcccggccacttcacccccgtgctggcccccagcccccaccccagcgccgtgagacccgtgaccctgagcatgaccgacaccaagcccatcaccaccagcaccgaggcctacaccgccagcggcaccagccaggccaacagatacgtgggcctgagccccagagaccccagcttcctgcaccagcagcagagctggtacctgggctag

SEQ ID NO: 91390 - DNA, 1263 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagagctggtacctgggctag

SEQ ID NO: 91391 - DNA, 1686 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagcccaacggcagcggccaggtggtgggcaaggtgcccggccacttcacccccgtgctggcccccagcccccaccccagcgccgtgagacccgtgaccctgagcatgaccgacaccaagcccatcaccaccagcaccgaggcctacaccgccagcggcaccagccaggccaacagatacgtgggcctgagccccagagaccccagcttcctgcaccagcagcagctgagaatctgcgactggaccatgaaccagaacggcagacacctgtaccccagcaccagcgaggacaccctgggcatcacctggcagagccccggcacctgggccagcctggtgcccttccaggtgagcaacagaacccccatcctgcccgccaacgtgcagaactacggcctgaacatcatcggcgagcccttcctgcaggccgagaccagcaactag

SEQ ID NO: 91392 - DNA, 1464 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagctgagaatctgcgactggaccatgaaccagaacggcagacacctgtaccccagcaccagcgaggacaccctgggcatcacctggcagagccccggcacctgggccagcctggtgcccttccaggtgagcaacagaacccccatcctgcccgccaacgtgcagaactacggcctgaacatcatcggcgagcccttcctgcaggccgagaccagcaactag

SEQ ID NO: 91393 - DNA, 1713 bp, Artificial Sequence
  Description of Artificial Sequence: Synthetic coding sequence
atgatgtacagccccatctgcctgacccaggacgagttccaccccttcatcgaggccctgctgccccacgtgagagccatcgcctacacctggttcaacctgcaggccagaaagagaaagtacttcaagaagcacgagaagagaatgagcaaggacgaggagagagccgtgaaggacgagctgctgagcgagaagcccgagatcaagcagaagtgggccagcagactgctggccaagctgagaaaggacatcagacaggagtacagagaggacttcgtgctgaccgtgaccggcaagaagcacccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgatgaagagcccccactgcaccaaccccgccctgtgcgtgcagccccaccacatcaccgtgagcgtgaaggagctggacctgttcctggcctactacgtgcaggagcaggacagcggccagagcggcagccccagccacaacgaccccgccaagaacccccccggctacctggaggacagcttcgtgaagagcggcgtgttcaacgtgagcgagctggtgagagtgagcagaacccccatcacccagggcaccggcgtgaacttccccatcggcgagatccccagccagccctactaccacgacatgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagcccaacggcagcggccaggtggtgggcaaggtgcccggccacttcacccccgtgctggcccccagcccccaccccagcgccgtgagacccgtgaccctgagcatgaccgacaccaagcccatcaccaccagcaccgagggcgaggccgccagccccaccgccaccacctacaccgccagcggcaccagccaggccaacagatacgtgggcctgagccccagagaccccagcttcctgcaccagcagcagctgagaatctgcgactggaccatgaaccagaacggcagacacctgtaccccagcaccagcgaggacaccctgggcatcacctggcagagccccggcacctgggccagcctggtgcccttccaggtgagcaacagaacccccatcctgcccgccaacgtgcagaactacggcctgaacatcatcggcgagcccttcctgcaggccgagaccagcaactag

SEQ ID NO: 91394 - DNA, 930 bp, Artificial Sequence
  Description of Artificial Sequence: Synthetic coding sequence
atgaacagcggcgtgaacctgcagagaagcctgagcagcccccccagcagcaagagacccaagaccatcagcatcgacgagaacatggagcccagccccaccggcgacttctaccccagccccagcagccccgccgccggcagcagaacctggcacgagagagaccaggacatgagcagccccaccaccatgaagaagcccgagaagcccctgttcagcagcgccagcccccaggacagcagccccagactgagcaccttcccccagcaccaccaccccggcatccccggcgtggcccacagcgtgatcagcaccagaaccccccccccccccagccccctgcccttccccacccaggccatcctgccccccgcccccagcagctacttcagccaccccaccatcagataccccccccacctgaacccccaggacaccctgaagaactacgtgcccagctacgaccccagcagcccccagaccagccagcccaacggcagcggccaggtggtgggcaaggtgcccggccacttcacccccgtgctggcccccagcccccaccccagcgccgtgagacccgtgaccctgagcatgaccgacaccaagcccatcaccaccagcaccgaggcctacaccgccagcggcaccagccaggccaacagatacgtgggcctgagccccagagaccccagcttcctgcaccagcagcagctgagaatctgcgactggaccatgaaccagaacggcagacacctgtaccccagcaccagcgaggacaccctgggcatcacctggcagagccccggcacctgggccagcctggtgcccttccaggtgagcaacagaacccccatcctgcccgccaacgtgcagaactacggcctgaacatcatcggcgagcccttcctgcaggccgagaccagcaactag

SEQ ID NO: 91395 - DNA, 1272 bp, Artificial Sequence
  Description of Artificial Sequence: Synthetic coding sequence
atgtacagcagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacgccgagcagagcggcagccccagaaccggcatgggcagcgaccaggaggacagcaagcccatcaccctggacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggcccctag

SEQ ID NO: 91396 - DNA, 1287 bp, Artificial Sequence
  Description of Artificial Sequence: Synthetic coding sequence
atgtacagcagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacgccgagcagagcggcagccccagaaccggcatgggcagcgaccaggaggacagcaagcccatcaccctggacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggccccagctggtacctgggctag

SEQ ID NO: 91397 - DNA, 1527 bp, Artificial Sequence
  Description of Artificial Sequence: Synthetic coding sequence
atgtacagcagccccctgtgcctgacccaggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacgccgagcagagcggcagccccagaaccggcatgggcagcgaccaggaggacagcaagcccatcaccctggacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggccccctgaacggcagcggccagctgaagatgcccagccactgcctgagcgcccagatgctggccccccccccccccggcctgcccagactggccctgccccccgccaccaagcccgccaccaccagcgagggcggcgccaccagccccaccagccccagctacagcccccccgacaccagccccgccaacagaagcttcgtgggcctgggccccagagaccccgccggcatctaccaggcccagagctggggcgacggctag

SEQ ID NO: 91398 - DNA, 1221 bp, Artificial Sequence
  Description of Artificial Sequence: Synthetic coding sequence
atggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggcccccccaccctgagacccaccagacccctgcagaccgtgcccctgtgggactag

SEQ ID NO: 91399 - DNA, 1293 bp, Artificial Sequence
  Description of Artificial Sequence: Synthetic coding sequence
atggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacgccgagcagagcggcagccccagaaccggcatgggcagcgaccaggaggacagcaagcccatcaccctggacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggcccccccaccctgagacccaccagacccctgcagaccgtgcccctgtgggactag

SEQ ID NO: 91400 - DNA, 1500 bp, Artificial Sequence
  Description of Artificial Sequence: Synthetic coding sequence
atggacgagttccaccccttcatcgaggccctgctgccccacgtgagagccttcgcctacacctggttcaacctgcaggccagaaagagaaagtacttcaagaagcacgagaagagaatgagcaaggacgaggagagagccgtgaaggacgagctgctgggcgagaagcccgaggtgaagcagaagtgggccagcagactgctggccaagctgagaaaggacatcagacccgagtgcagagaggacttcgtgctgagcatcaccggcaagaaggcccccggctgcgtgctgagcaaccccgaccagaagggcaagatgagaagaatcgactgcctgagacaggccgacaaggtgtggagactggacctggtgatggtgatcctgttcaagggcatccccctggagagcaccgacggcgagagactggtgaaggccgcccagtgcggccaccccgtgctgtgcgtgcagccccaccacatcggcgtggccgtgaaggagctggacctgtacctggcctacttcgtgagagagagagacgccgagcagagcggcagccccagaaccggcatgggcagcgaccaggaggacagcaagcccatcaccctggacaccaccgacttccaggagagcttcgtgaccagcggcgtgttcagcgtgaccgagctgatccaggtgagcagaacccccgtggtgaccggcaccggccccaacttcagcctgggcgagctgcagggccacctggcctacgacctgaaccccgccagcaccggcctgagaagaaccctgcccagcaccagcagcagcggcagcaagagacacaagagcggcagcatggaggaggacgtggacaccagccccggcggcgactactacaccagccccagcagccccaccagcagcagcagaaactggaccgaggacatggagggcggcatcagcagccccgtgaagaagaccgagatggacaagagccccttcaacagccccagcccccaggacagccccagactgagcagcttcacccagcaccacagacccgtgatcgccgtgcacagcggcatcgccagaagcccccaccccagcagcgccctgcacttccccaccaccagcatcctgccccagaccgccagcacctacttcccccacaccgccatcagataccccccccacctgaacccccaggaccccctgaaggacctggtgagcctggcctgcgaccccgccagccagcagcccggccccctgaacggcagcggccagctgaagatgcccagccactgcctgagcgcccagatgctggccccccccccccccggcctgcccagactggccctgccccccgccaccaagcccgccaccaccagcgagggcggcgccaccagccccaccagccccagctacagcccccccgacaccagccccgccaacagaagcttcgtgggcctgggccccagagaccccgccggcatctaccaggcccagagctggtacctgggctag

SEQ ID NO: 91401 - DNA, 1500 bp, Artificial Sequence; identical to SEQ ID NO: 91400
  Description of Artificial Sequence: Synthetic coding sequence

SEQ ID NO: 91402 - DNA, 1212 bp, Artificial Sequence
  Description of Artificial Sequence: Synthetic coding sequence
atgggcgccaccgagcccggcggcgacaccagcagcgacgagttccaccccttcatcgaggccctgctgccccacgtgagagccttcagctacacctggttcaacctgcaggccagaaagagaaagtacttcaagaagcacgagaagagaatgagcaaggacgaggagagagccgtgaaggacgagctgctgggcgagaagcccgagatcaagcagaagtgggccagcagactgctggccaagctgagaaaggacatcagacccgagttcagagaggacttcgtgctgaccatcaccggcaagaagcccccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgtacaagagcccccagtgcagcaaccccggcctgtgcgtgcagccccaccacatcggcgtgaccatcaaggagctggacctgtacctggcctacttcgtgcacacccccgagagcggccagagcgacagcagcaaccagcagggcgacgccgacatcaagcccctgcccaacggccacctgagcttccaggactgcttcgtgaccagcggcgtgtggaacgtgaccgagctggtgagagtgagccagacccccgtggccaccgccagcggccccaacttcagcctggccgacctggagagccccagctactacaacatcaaccaggtgaccctgggcagaagaagcatcaccagcccccccagcaccagcaccaccaagagacccaagagcatcgacgacagcgagatggagagccccgtggacgacgtgttctaccccggcaccggcagaagccccgccgccggcagcagccagagcagcggctggcccaacgacgtggacgccggcagccccagagccaccgccagcgccctgcacttccccagcaccagcatcatccagcagagcagcccctacttcacccaccccaccatcagataccaccaccaccacggccaggacagcctgaaggagttcgtgcagttcgtgtgcagcgacggcagcggccaggccaccggccagcacagccagagacaggccccccccctgcccaccggcctgagcgccagcgaccccggcaccgccaccttctag

SEQ ID NO: 91403 - DNA, 1383 bp, Artificial Sequence
  Description of Artificial Sequence: Synthetic coding sequence
atgctgcccgcctgcagactgcaggacgagttccaccccttcatcgaggccctgctgccccacgtgagagccttcagctacacctggttcaacctgcaggccagaaagagaaagtacttcaagaagcacgagaagagaatgagcaaggacgaggagagagccgtgaaggacgagctgctgggcgagaagcccgagatcaagcagaagtgggccagcagactgctggccaagctgagaaaggacatcagacccgagttcagagaggacttcgtgctgaccatcaccggcaagaagcccccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgtacaagagcccccagtgcagcaaccccggcctgtgcgtgcagccccaccacatcggcgtgaccatcaaggagctggacctgtacctggcctacttcgtgcacacccccgagagcggccagagcgacagcagcaaccagcagggcgacgccgacatcaagcccctgcccaacggccacctgagcttccaggactgcttcgtgaccagcggcgtgtggaacgtgaccgagctggtgagagtgagccagacccccgtggccaccgccagcggccccaacttcagcctggccgacctggagagccccagctactacaacatcaaccaggtgaccctgggcagaagaagcatcaccagcccccccagcaccagcaccaccaagagacccaagagcatcgacgacagcgagatggagagccccgtggacgacgtgttctaccccggcaccggcagaagccccgccgccggcagcagccagagcagcggctggcccaacgacgtggacgccggcagccccagagccaccgccagcgccctgcacttccccagcaccagcatcatccagcagagcagcccctacttcacccaccccaccatcagataccaccaccaccacggccaggacagcctgaaggagttcgtgcagttcgtgtgcagcgacggcagcggccaggccaccggccagcccaacggcagcggccagggcaaggtgcccggcagcttcctgctgcccccccccccccccgtggccagacccgtgcccctgcccatgcccgacagcaagagcaccagcaccgcccccgacggcgccgccctgaccccccccagccccagcttcgccaccaccggcgccagcagcgccaacagattcgtgagcatcggccccagagacggcaacttcctgaacatcccccagcagagccagagctggttcctgtag

SEQ ID NO: 91404 - DNA, 1326 bp, Artificial Sequence
  Description of Artificial Sequence: Synthetic coding sequence
atgtacagcccctactgcctgacccaggacgagttccaccccttcatcgaggccctgctgccccacgtgagagccttcagctacacctggttcaacctgcaggccagaaagagaaagtacttcaagaagcacgagaagagaatgagcaaggacgaggagagagccgtgaaggacgagctgctgggcgagaagcccgagatcaagcagaagtgggccagcagactgctggccaagctgagaaaggacatcagacccgagttcagagaggacttcgtgctgaccatcaccggcaagaagcccccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgtacaagagcccccagtgcagcaaccccggcctgtgcgtgcagccccaccacatcggcgtgaccatcaaggagctggacctgtacctggcctacttcgtgcacacccccgagagcggccagagcgacagcagcaaccagcagggcgacgccgacatcaagcccctgcccaacggccacctgagcttccaggactgcttcgtgaccagcggcgtgtggaacgtgaccgagctggtgagagtgagccagacccccgtggccaccgccagcggccccaacttcagcctggccgacctggagagccccagctactacaacatcaaccaggtgaccctgggcagaagaagcatcaccagcccccccagcaccagcaccaccaagagacccaagagcatcgacgacagcgagatggagagccccgtggacgacgtgttctaccccggcaccggcagaagccccgccgccggcagcagccagagcagcggctggcccaacgacgtggacgccggccccgccagcctgaagaagagcggcaagctggacttctgcagcgccctgagcagccagggcagcagccccagaatggccttcacccaccaccccctgcccgtgctggccggcgtgagacccggcagccccagagccaccgccagcgccctgcacttccccagcaccagcatcatccagcagagcagcccctacttcacccaccccaccatcagataccaccaccaccacggccaggacagcctgaaggagttcgtgcagttcgtgtgcagcgacggcagcggccaggccaccggccagcacagccagagacaggccccccccctgcccaccggcctgagcgccagcgaccccggcaccgccaccttctag

SEQ ID NO: 91405 - DNA, 1509 bp, Artificial Sequence
  Description of Artificial Sequence: Synthetic coding sequence
atgtacagcccctactgcctgacccaggacgagttccaccccttcatcgaggccctgctgccccacgtgagagccttcagctacacctggttcaacctgcaggccagaaagagaaagtacttcaagaagcacgagaagagaatgagcaaggacgaggagagagccgtgaaggacgagctgctgggcgagaagcccgagatcaagcagaagtgggccagcagactgctggccaagctgagaaaggacatcagacccgagttcagagaggacttcgtgctgaccatcaccggcaagaagcccccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgtacaagagcccccagtgcagcaaccccggcctgtgcgtgcagccccaccacatcggcgtgaccatcaaggagctggacctgtacctggcctacttcgtgcacacccccgagagcggccagagcgacagcagcaaccagcagggcgacgccgacatcaagcccctgcccaacggccacctgagcttccaggactgcttcgtgaccagcggcgtgtggaacgtgaccgagctggtgagagtgagccagacccccgtggccaccgccagcggccccaacttcagcctggccgacctggagagccccagctactacaacatcaaccaggtgaccctgggcagaagaagcatcaccagcccccccagcaccagcaccaccaagagacccaagagcatcgacgacagcgagatggagagccccgtggacgacgtgttctaccccggcaccggcagaagccccgccgccggcagcagccagagcagcggctggcccaacgacgtggacgccggccccgccagcctgaagaagagcggcaagctggacttctgcagcgccctgagcagccagggcagcagccccagaatggccttcacccaccaccccctgcccgtgctggccggcgtgagacccggcagccccagagccaccgccagcgccctgcacttccccagcaccagcatcatccagcagagcagcccctacttcacccaccccaccatcagataccaccaccaccacggccaggacagcctgaaggagttcgtgcagttcgtgtgcagcgacggcagcggccaggccaccggccagcccaacggcagcggccagggcaaggtgcccggcagcttcctgctgcccccccccccccccgtggccagacccgtgcccctgcccatgcccgacagcaagagcaccagcaccgcccccgacggcgccgccctgaccccccccagccccagcttcgccaccaccggcgccagcagcgccaacagattcgtgagcatcggccccagagacggcaacttcctgaacatcccccagcagagccagagctggttcctgtag

SEQ ID NO: 91406 - DNA, 633 bp, Artificial Sequence
  Description of Artificial Sequence: Synthetic coding sequence
atgagcaaggacgaggagagagccgtgaaggacgagctgctgggcgagaagcccgagatcaagcagaagtgggccagcagactgctggccaagctgagaaaggacatcagacccgagttcagagaggacttcgtgctgaccatcaccggcaagaagcccccctgctgcgtgctgagcaaccccgaccagaagggcaagatcagaagaatcgactgcctgagacaggccgacaaggtgtggagactggacctggtgatggtgatcctgttcaagggcatccccctggagagcaccgacggcgagagactgtacaagagcccccagtgcagcaaccccggcctgtgcgtgcagccccaccacatcggcgtgaccatcaaggagctggacctgtacctggcctacttcgtgcacacccccgagagcggccagagcgacagcagcaaccagcagggcgacgccgacatcaagcccctgcccaacggccacctgagcttccaggactgcttcgtgaccagcggcgtgtggaacgtgaccgagctggtgtaccacagactgctgctgcagcagcaccagggccccaccagcccctggagaacctggagagtgcccgccaccaccaccagcaccagatag

SEQ ID NO: 91407 - DNA, 1071 bp, Artificial Sequence
  Description of Artificial Sequence: Synthetic coding sequence
atggccggcgtggcctgcctgggcaaggccgccgacgccgacgagtggtgcgacagcggcctgggcagcctgggccccgacgccgccgcccccggcggccccggcctgggcgccgagctgggccccggcctgagctgggcccccctggtgttcggctacgtgaccgaggacggcgacaccgccctgcacctggccgtgatccaccagcacgagcccttcctggacttcctgctgggcttcagcgccggcaccgagtacatggacctgcagaacgacctgggccagaccgccctgcacctggccgccatcctgggcgagaccagcaccgtggagaagctgtacgccgccggcgccggcctgtgcgtggccgagagaagaggccacaccgccctgcacctggcctgcagagtgggcgcccacgcctgcgccagagccctgctgcagcccagacccagaagacccagagaggcccccgacacctacctggcccagggccccgacagaacccccgacaccaaccacacccccgtggccctgtaccccgacagcgacctggagaaggaggaggaggagagcgaggaggactggaagctgcagctggaggccgagaactacgagggccacacccccctgcacgtggccgtgatccacaaggacgtggagatggtgagactgctgagagacgccggcgccgacctggacaagcccgagcccacctgcggcagaagccccctgcacctggccgtggaggcccaggccgccgacgtgctggagctgctgctgagagccggcgccaaccccgccgccagaatgtacggcggcagaacccccctgggcagcgccatgctgagacccaaccccatcctggccagactgctgagagcccacggcgcccccgagcccgagggcgaggacgagaagagcggcccctgcagcagcagcagcgacagcgacagcggcgacgagggcgacgagtacgacgacatcgtggtgcacagcagcagaagccagaccagactgccccccacccccgccagcaagcccctgcccgacgaccccagacccgtgtag

SEQ ID NO: 91408 - DNA, 921 bp, Artificial Sequence
  Description of Artificial Sequence: Synthetic coding sequence
atgaacggcgccaccgccgcctgggccccctgggtgagaacccagagaccccccgaggacctgggctgggccagaagctgggccagaggctgcagaggcctgcccagcagcagcgccaccagcctgagaatgggcaccagattcagcgccggcaccgagtacatggacctgcagaacgacctgggccagaccgccctgcacctggccgccatcctgggcgagaccagcaccgtggagaagctgtacgccgccggcgccggcctgtgcgtggccgagagaagaggccacaccgccctgcacctggcctgcagagtgggcgcccacgcctgcgccagagccctgctgcagcccagacccagaagacccagagaggcccccgacacctacctggcccagggccccgacagaacccccgacaccaaccacacccccgtggccctgtaccccgacagcgacctggagaaggaggaggaggagagcgaggaggactggaagctgcagctggaggccgagaactacgagggccacacccccctgcacgtggccgtgatccacaaggacgtggagatggtgagactgctgagagacgccggcgccgacctggacaagcccgagcccacctgcggcagaagccccctgcacctggccgtggaggcccaggccgccgacgtgctggagctgctgctgagagccggcgccaaccccgccgccagaatgtacggcggcagaacccccctgggcagcgccatgctgagacccaaccccatcctggccagactgctgagagcccacggcgcccccgagcccgagggcgaggacgagaagagcggcccctgcagcagcagcagcgacagcgacagcggcgacgagggcgtgagccaggaggagagacagggcagccccgccggcggcagcggctag

SEQ ID NO: 91409 - DNA, 1086 bp, Artificial Sequence
  Description of Artificial Sequence: Synthetic coding sequence
ctgcagaacagcagacagagccccgccaccggcggcagactgagaggcgcccccgaggccgccggcgccatggccggcgtggcctgcctgggcaaggccgccgacgccgacgagtggtgcgacagcggcctgggcagcctgggccccgacgccgccgcccccggcggccccggcctgggcgccgagctgggccccggcctgagctgggcccccctggtgttcggctacgtgaccgaggacggcgacaccgccctgcacctggccgtgatccaccagcacgagcccttcctggacttcctgctgggcttcagcgccggcaccgagtacatggacctgcagaacgacctgggccagaccgccctgcacctggccgccatcctgggcgagaccagcaccgtggagaagctgtacgccgccggcgccggcctgtgcgtggccgagagaagaggccacaccgccctgcacctggcctgcagagtgggcgcccacgcctgcgccagagccctgctgcagcccagacccagaagacccagagaggcccccgacacctacctggcccagggccccgacagaacccccgacaccaaccacacccccgtggccctgtaccccgacagcgacctggagaaggaggaggaggagagcgaggaggactggaagctgcagctggaggccgagaactacgagggccacacccccctgcacgtggccgtgatccacaaggacgtggagatggtgagactgctgagagacgccggcgccgacctggacaagcccgagcccacctgcggcagaagccccctgcacctggccgtggaggcccaggccgccgacgtgctggagctgctgctgagagccggcgccaaccccgccgccagaatgtacggcggcagaacccccctgggcagcgccatgctgagacccaaccccatcctggccagactgctgagagcccacggcgcccccgagcccgagggcgaggacgagaagagcggcccctgcagcagcagcagcgacagcgacagcggcgacgagggcgtgagccaggaggagagacagggcagccccgccggcggcagcggctag

SEQ ID NO: 91410 - DNA, 1791 bp, Artificial Sequence
  Description of Artificial Sequence: Synthetic coding sequence
atgatcgtggacaagctgctggacgacagcagaggcggcgagggcctgagagacgccgccggcggctgcggcctgatgaccagccccctgaacctgagctacttctacggcgccagcccccccgccgccgcccccggcgcctgcgacgccagctgcagcgtgctgggccccagcgcccccggcagccccggcagcgacagcagcgacttcagcagcgccagcagcgtgagcagctgcggcgccgtggagagcagaagcagaggcggcgccagagccgagagacagcccgtggagccccacatgggcgtgggcagacagcagagaggccccttccagggcgtgagagtgaagaacagcgtgaaggagctgctgctgcacatcagaagccacaagcagaaggccagcggccaggccgtggacgacttcaagacccagggcgtgaacatcgagcagttcagagagctgaagaacaccgtgagctacagcggcaagagaaagggccccgacagcctgagcgacggccccgcctgcaagagacccgccctgctgcacagccagttcctgacccccccccagacccccacccccggcgagagcatggaggacgtgcacctgaacgagcccaagcaggagagcagcgccgacctgctgcagaacatcatcaacatcaagaacgagtgcagccccgtgagcctgaacaccgtgcagaccagcagcagcgtgcagcagcagaacgacgcccacctgcacagcttcagcatgatgcccagcagcgcctgcgaggccatggtgggccacgagatggccagcgacagcagcaacaccagcctgcccttcagcaacatgggcaaccccatgaacaccacccagctgggcaagagcctgttccagtggcaggtggagcaggaggagagcaagctggccaacatcagccaggaccagttcctgagcaaggacgccgacggcgacaccttcctgcacatcgccgtggcccagggcagaagagccctgagctacgtgctggccagaaagatgaacgccctgcacatgctggacatcaaggagcacaacggccagagcgccttccaggtggccgtggccgccaaccagcacctgatcgtgcaggacctggtgaacatcggcgcccaggtgaacaccaccgactgctggggcagaacccccctgcacgtgtgcgccgagaagggccacagccaggtgctgcaggccatccagaagggcgccgtgggcagcaaccagttcgtggacctggaggccaccaactacgacggcctgacccccctgcactgcgccgtgatcgcccacaacgccgtggtgcacgagctgcagagaaaccagcagccccacagccccgaggtgcaggagctgctgctgaagaacaagagcctggtggacaccatcaagtgcctgatccagatgggcgccgccgtggaggccaaggacagaaagagcggcagaaccgccctgcacctggccgccgaggaggccaacctggagctgatcagactgttcctggagctgcccagctgcctgagcttcgtgaacgccaaggcctacaacggcaacaccgccctgcacgtggccgccagcctgcagtacagactgacccagctggacgccgtgagactgctgatgagaaagggcgccgaccccagcaccagaaacctggagaacgagcagcccgtgcacctggtgcccgacggccccgtgggcgagcagatcagaagaatcctgaagggcaagagcatccagcagagagcccccccctactag

SEQ ID NO: 91411 - DNA, 2157 bp, Artificial Sequence
  Description of Artificial Sequence: Synthetic coding sequence
atgatcgtggacaagctgctggacgacagcagaggcggcgagggcctgagagacgccgccggcggctgcggcctgatgaccagccccctgaacctgagctacttctacggcgccagcccccccgccgccgcccccggcgcctgcgacgccagctgcagcgtgctgggccccagcgcccccggcagccccggcagcgacagcagcgacttcagcagcgccagcagcgtgagcagctgcggcgccgtggagagcagaagcagaggcggcgccagagccgagagacagcccgtggagccccacatgggcgtgggcagacagcagagaggccccttccagggcgtgagagtgaagaacagcgtgaaggagctgctgctgcacatcagaagccacaagcagaaggccagcggccaggccgtggacgacttcaagacccagggcgtgaacatcgagcagttcagagagctgaagaacaccgtgagctacagcggcaagagaaagggccccgacagcctgagcgacggccccgcctgcaagagacccgccctgctgcacagccagttcctgacccccccccagacccccacccccggcgagagcatggaggacgtgcacctgaacgagcccaagcaggagagcagcgccgacctgctgcagaacatcatcaacatcaagaacgagtgcagccccgtgagcctgaacaccgtgcaggtgagctggctgaaccccgtggtggtgccccagagcagccccgccgagcagtgccaggacttccacggcggccaggtgttcagccccccccagaagtgccagcccttccaggtgagaggcagccagcagatgatcgaccaggccagcctgtaccagtacagcccccagaaccagcacgtggagcagcagccccactacacccacaagcccaccctggagtacagccccttccccatccccccccagagccccgcctacgagcccaacctgttcgacggccccgagagccagttctgccccaaccagagcctggtgagcctgctgggcgaccagagagagagcgagaacatcgccaaccccatgcagaccagcagcagcgtgcagcagcagaacgacgcccacctgcacagcttcagcatgatgcccagcagcgcctgcgaggccatggtgggccacgagatggccagcgacagcagcaacaccagcctgcccttcagcaacatgggcaaccccatgaacaccacccagctgggcaagagcctgttccagtggcaggtggagcaggaggagagcaagctggccaacatcagccaggaccagttcctgagcaaggacgccgacggcgacaccttcctgcacatcgccgtggcccagggcagaagagccctgagctacgtgctggccagaaagatgaacgccctgcacatgctggacatcaaggagcacaacggccagagcgccttccaggtggccgtggccgccaaccagcacctgatcgtgcaggacctggtgaacatcggcgcccaggtgaacaccaccgactgctggggcagaacccccctgcacgtgtgcgccgagaagggccacagccaggtgctgcaggccatccagaagggcgccgtgggcagcaaccagttcgtggacctggaggccaccaactacgacggcctgacccccctgcactgcgccgtgatcgcccacaacgccgtggtgcacgagctgcagagaaaccagcagccccacagccccgaggtgcaggagctgctgctgaagaacaagagcctggtggacaccatcaagtgcctgatccagatgggcgccgccgtggaggccaaggacagaaagagcggcagaaccgccctgcacctggccgccgaggaggccaacctggagctgatcagactgttcctggagctgcccagctgcctgagcttcgtgaacgccaaggcctacaacggcaacaccgccctgcacgtggccgccagcctgcagtacagactgacccagctggacgccgtgagactgctgatgagaaagggcgccgaccccagcaccagaaacctggagaacgagcagcccgtgcacctggtgcccgacggccccgtgggcgagcagatcagaagaatcctgaagggcaagagcatccagcagagagcccccccctactag

SEQ ID NO: 91412 - DNA, 1857 bp, Artificial Sequence
  Description of Artificial Sequence: Synthetic coding sequence
atgggcgtgggcagacagcagagaggccccttccagggcgtgagagtgaagaacagcgtgaaggagctgctgctgcacatcagaagccacaagcagaaggccagcggccaggccgtggacgacttcaagacccagggcgtgaacatcgagcagttcagagagctgaagaacaccgtgagctacagcggcaagagaaagggccccgacagcctgagcgacggccccgcctgcaagagacccgccctgctgcacagccagttcctgacccccccccagacccccacccccggcgagagcatggaggacgtgcacctgaacgagcccaagcaggagagcagcgccgacctgctgcagaacatcatcaacatcaagaacgagtgcagccccgtgagcctgaacaccgtgcaggtgagctggctgaaccccgtggtggtgccccagagcagccccgccgagcagtgccaggacttccacggcggccaggtgttcagccccccccagaagtgccagcccttccaggtgagaggcagccagcagatgatcgaccaggccagcctgtaccagtacagcccccagaaccagcacgtggagcagcagccccactacacccacaagcccaccctggagtacagccccttccccatccccccccagagccccgcctacgagcccaacctgttcgacggccccgagagccagttctgccccaaccagagcctggtgagcctgctgggcgaccagagagagagcgagaacatcgccaaccccatgcagaccagcagcagcgtgcagcagcagaacgacgcccacctgcacagcttcagcatgatgcccagcagcgcctgcgaggccatggtgggccacgagatggccagcgacagcagcaacaccagcctgcccttcagcaacatgggcaaccccatgaacaccacccagctgggcaagagcctgttccagtggcaggtggagcaggaggagagcaagctggccaacatcagccaggaccagttcctgagcaaggacgccgacggcgacaccttcctgcacatcgccgtggcccagggcagaagagccctgagctacgtgctggccagaaagatgaacgccctgcacatgctggacatcaaggagcacaacggccagagcgccttccaggtggccgtggccgccaaccagcacctgatcgtgcaggacctggtgaacatcggcgcccaggtgaacaccaccgactgctggggcagaacccccctgcacgtgtgcgccgagaagggccacagccaggtgctgcaggccatccagaagggcgccgtgggcagcaaccagttcgtggacctggaggccaccaactacgacggcctgacccccctgcactgcgccgtgatcgcccacaacgccgtggtgcacgagctgcagagaaaccagcagccccacagccccgaggtgcaggagctgctgctgaagaacaagagcctggtggacaccatcaagtgcctgatccagatgggcgccgccgtggaggccaaggacagaaagagcggcagaaccgccctgcacctggccgccgaggaggccaacctggagctgatcagactgttcctggagctgcccagctgcctgagcttcgtgaacgccaaggcctacaacggcaacaccgccctgcacgtggccgccagcctgcagtacagactgacccagctggacgccgtgagactgctgatgagaaagggcgccgaccccagcaccagaaacctggagaacgagcagcccgtgcacctggtgcccgacggccccgtgggcgagcagatcagaagaatcctgaagggcaagagcatccagcagagagcccccccctactag

SEQ ID NO: 91413 - DNA, 333 bp, Artificial Sequence
  Description of Artificial Sequence: Synthetic coding sequence
atgatcgtggacaagctgctggacgacagcagaggcggcgagggcctgagagacgccgccggcggctgcggcctgatgaccagccccctgaacctgagctacttctacggcgccagcccccccgccgccgcccccggcgcctgcgacgccagctgcagcgtgctgggccccagcgcccccggcagccccggcagcgacagcagcgacttcagcagcgccagcagcgtgagcagctgcggcgccgtggagagcagaagcagaggcggcgccagagccgagagacagcccgtggagccccacatgggcgtgggcagacagcagagaggcccctag

SEQ ID NO: 91414 - DNA, 1806 bp, Artificial Sequence
  Description of Artificial Sequence: Synthetic coding sequence
atgggcgtgggcagacagcagagaggccccttccagggcgtgagagtgaagaacagcgtgaaggagctgctgctgcacatcagaagccacaagcagaaggccagcggccaggccgtggacgacttcaagacccagggcgtgaacatcgagcagttcagagagctgaagaacaccgtgagctacagcggcaagagaaagggccccgacagcctgagcgacggccccgcctgcaagagacccgccctgctgcacagccagttcctgacccccccccagacccccacccccggcgagagcatggaggacgtgcacctgaacgagcccaagcaggagagcagcgccgacctgctgcagaacatcatcaacatcaagaacgagtgcagccccgtgagcctgaacaccgtgcaggtgagctggctgaaccccgtggtggtgccccagagcagccccgccgagcagtgccaggacttccacggcggccaggtgttcagccccccccagaagtgccagcccttccaggtgagaggcagccagcagatgatcgaccaggccagcctgtaccagtacagcccccagaaccagcacgtggagcagcagccccactacacccacaagcccaccctggagtacagccccttccccatccccccccagagccccgcctacgagcccaacctgttcgacggccccgagagccagttctgccccaaccagagcctggtgagcctgctgggcgaccagagagagagcgagaacatcgccaaccccatgcagaccagcagcagcgtgcagcagcagaacgacgcccacctgcacagcttcagcatgatgcccagcagcgcctgcgaggccatggtgggccacgagatggccagcgacagcagcaacaccagcctgcccttcagcaacatgggcaaccccatgaacaccacccagctgggcaagagcctgttccagtggcaggtggagcaggaggagagcaagctggccaacatcagccaggaccagttcctgagcaaggacgccgacggcgacaccttcctgcacatcgccgtggcccagggcagaagagccctgagctacgtgctggccagaaagatgaacgccctgcacatgctggacatcaaggagcacaacggccagagcgccttccaggtggccgtggccgccaaccagcacctgatcgtgcaggacctggtgaacatcggcgcccaggtgaacaccaccgactgctggggcagaacccccctgcacgtgtgcgccgagaagggccacagccaggtgctgcaggccatccagaagggcgccgtgggcagcaaccagttcgtggacctggaggccaccaactacgacggcctgacccccctgcactgcgccgtgatcgcccacaacgccgtggtgcacgagctgcagagaaaccagcagccccacagccccgaggtgcaggagctgctgctgaagaacaagagcctggtggacaccatcaagtgcctgatccagatgggcgccgccgtggaggccaaggacagaaagagcggcagaaccgccctgcacctggccgccgaggaggccaacctggagctgatcagactgttcctggagctgcccagctgcctgagcttcgtgaacgccaaggcctacaacggcaacaccgccctgcacgtggccgccagcctgcagtacagactgacccagctggacgccgtgagactgctgatgagaaagggcgccgaccccagcaccagaaacctggagaacgagcagcccgtgcacctggtgcccgacggccccgtgggcgagcagtag

SEQ ID NO: 91415 - DNA, 393 bp, Artificial Sequence
  Description of Artificial Sequence: Synthetic coding sequence
atgggcgtgggcagacagcagagaggccccttccagggcgtgagagtgaagaacagcgtgaaggagctgctgctgcacatcagaagccacaagcagaaggccagcggccaggccgtggacgacttcaagacccagggcgtgaacatcgagcagttcagagagctgaagaacaccgtgagctacagcggcaagagaaagggccccgacagcctgagcgacggccccgcctgcaagagacccgccctgctgcacagccagttcctgacccccccccagacccccacccccggcgagagcatggaggacgtgcacctgaacgagcccaagcaggagagcagcgccgacctgctgcagaacatcatcaacatcaagaacgagtgcagccccgtgtag

SEQ ID NO: 91416 - DNA, 1101 bp, Artificial Sequence
  Description of Artificial Sequence: Synthetic coding sequence
atgagcaaccccagcccccaggtgcccgaggaggaggccagcaccagcgtgtgcagacccaagagcagcatggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgacgccagccacgagacccaggagcccgagagcttcagcgcctggagcgacagactggccagagagcacgcccagaagtgccagcagcagcagagagaggccgagggcagcagaagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91417 - DNA, 1077 bp, Artificial Sequence
  Description of Artificial Sequence: Synthetic coding sequence
atggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagcagaagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91418 - DNA, 1146 bp, Artificial Sequence
  Description of Artificial Sequence: Synthetic coding sequence
atgagcaaccccagcccccaggtgcccgaggaggaggccagcaccagcgtgtgcagacccaagagcagcatggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagcagaagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91419 - DNA, 1101 bp, Artificial Sequence
  Description of Artificial Sequence: Synthetic coding sequence
atgagcaaccccagcccccaggtgcccgaggaggaggccagcaccagcgtgtgcagacccaagagcagcatggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgacgccagccacgagacccaggagcccgagagcttcagcgcctggagcgacagactggccagagagcacgcccagaagtgccagcagcagcagagagaggccgagggcagctgcagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91420 - DNA, 1077 bp, Artificial Sequence
  Description of Artificial Sequence: Synthetic coding sequence
atggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagctgcagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91421 - DNA, 1146 bp, Artificial Sequence
  Description of Artificial Sequence: Synthetic coding sequence
atgagcaaccccagcccccaggtgcccgaggaggaggccagcaccagcgtgtgcagacccaagagcagcatggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagctgcagaccccccagagccgagggcagcagccagagctggagacagcaggaggaggagcagagactgttcagagagagagccagagccaaggaggaggagctgagagagagcagagccagaagagcccaggaggccctgggcgacagagagcccaagcccaccagagccggccccagagaggagcaccccagaggcgccggcagaggcagcctgtggagattcggcgacgtgccctggccctgccccggcggcggcgaccccgaggccatggccgccgccctggtggccagaggcccccccctggaggagcagggcgccctgagaagatacctgagagtgcagcaggtgagatggcaccccgacagattcctgcagagattcagaagccagatcgagacctgggagctgggcagagtgatgggcgccgtgaccgccctgagccaggccctgaacagacacgccgaggccctgaagtag

SEQ ID NO: 91422 - DNA, 1101 bp, Artificial Sequence; identical to SEQ ID NO: 91419
  Description of Artificial Sequence: Synthetic coding sequence

SEQ ID NO: 91423 - DNA, 1146 bp, Artificial Sequence; identical to SEQ ID NO: 91421
  Description of Artificial Sequence: Synthetic coding sequence

SEQ ID NO: 91424 - DNA, 1101 bp, Artificial Sequence; identical to SEQ ID NO: 91419
  Description of Artificial Sequence: Synthetic coding sequence

SEQ ID NO: 91425 - DNA, 1101 bp, Artificial Sequence; identical to SEQ ID NO: 91419
  Description of Artificial Sequence: Synthetic coding sequence

SEQ ID NO: 91426 - DNA, 1146 bp, Artificial Sequence; identical to SEQ ID NO: 91421
  Description of Artificial Sequence: Synthetic coding sequence

SEQ ID NO: 91427 - DNA, 1077 bp, Artificial Sequence; identical to SEQ ID NO: 91420
  Description of Artificial Sequence: Synthetic coding sequence

SEQ ID NO: 91428 - DNA, 1101 bp, Artificial Sequence; identical to SEQ ID NO: 91419
  Description of Artificial Sequence: Synthetic coding sequence

SEQ ID NO: 91429 - DNA, 1077 bp, Artificial Sequence; identical to SEQ ID NO: 91420
  Description of Artificial Sequence: Synthetic coding sequence

SEQ ID NO: 91430 - DNA, 1146 bp, Artificial Sequence; identical to SEQ ID NO: 91421
  Description of Artificial Sequence: Synthetic coding sequence

SEQ ID NO: 91431 - DNA, 1077 bp, Artificial Sequence; identical to SEQ ID NO: 91420
  Description of Artificial Sequence: Synthetic coding sequence

SEQ ID NO: 91432 - DNA, 1146 bp, Artificial Sequence; identical to SEQ ID NO: 91421
  Description of Artificial Sequence: Synthetic coding sequence

SEQ ID NO: 91433 - DNA, 1101 bp, Artificial Sequence; identical to SEQ ID NO: 91419
  Description of Artificial Sequence: Synthetic coding sequence

SEQ ID NO: 91434 - DNA, 1077 bp, Artificial Sequence; identical to SEQ ID NO: 91420
  Description of Artificial Sequence: Synthetic coding sequence

SEQ ID NO: 91435 - DNA, 1146 bp, Artificial Sequence; identical to SEQ ID NO: 91421
  Description of Artificial Sequence: Synthetic coding sequence

SEQ ID NO: 91436 - DNA, 1077 bp, Artificial Sequence; identical to SEQ ID NO: 91420
  Description of Artificial Sequence: Synthetic coding sequence

SEQ ID NO: 91437 - DNA, 699 bp, Artificial Sequence
  Description of Artificial Sequence: Synthetic coding sequence
atggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagcagaagaccccccagagccgagggcagcagccagagctggagacagcaggaggaggagcagagactgttcagagagagagccagagccaaggaggagtag

SEQ ID NO: 91438 - DNA, 699 bp, Artificial Sequence
  Description of Artificial Sequence: Synthetic coding sequence
atggccagcaccagcagaagacagagaagagagagaagattcagaagatacctgagcgccggcagactggtgagagcccaggccctgctgcagagacaccccggcctggacgtggacgccggccagcccccccccctgcacagagcctgcgccagacacgacgcccccgccctgtgcctgctgctgagactgggcgccgaccccgcccaccaggacagacacggcgacaccgccctgcacgccgccgccagacagggccccgacgcctacaccgacttcttcctgcccctgctgagcagatgccccagcgccatgggcatcaagaacaaggacggcgagacccccggccagatcctgggctggggccccccctgggacagcgccgaggaggaggaggaggacgacgccagcaaggagagagagtggagacagaagctgcagggcgagctggaggacgagtggcaggaggtgatgggcagattcgagggcgacgccagccacgagacccaggagcccgagagcttcagcgcctggagcgacagactggccagagagcacgcccagaagtgccagcagcagcagagagaggccgagggcagctgcagaccccccagagccgagggcagcagccagagctggagacagcaggaggaggagcagagactgttcagagagagagccagagccaaggaggagtag

SEQ ID NO: 91439 - DNA, 699 bp, Artificial Sequence; identical to SEQ ID NO: 91438
  Description of Artificial Sequence: Synthetic coding sequence

SEQ ID NO: 91440 - DNA, 699 bp, Artificial Sequence; identical to SEQ ID NO: 91438
  Description of Artificial Sequence: Synthetic coding sequence

SEQ ID NO: 91441 - DNA, 699 bp, Artificial Sequence; identical to SEQ ID NO: 91438
  Description of Artificial Sequence: Synthetic coding sequence

SEQ ID NO: 91442 - DNA, 699 bp, Artificial Sequence; identical to SEQ ID NO: 91438
  Description of Artificial Sequence: Synthetic coding sequence

SEQ ID NO: 91443 - DNA, 699 bp, Artificial Sequence; identical to SEQ ID NO: 91438
  Description of Artificial Sequence: Synthetic coding sequence

SEQ ID NO: 91444 - DNA, 3900 bp, Artificial Sequence
  Description of Artificial Sequence: Synthetic coding sequence
atggacagcctggaccacatgctgaccgaccccctggagctgggcccctgcggcgacggccacggcaccagaatcatggaggactgcctgctgggcggcaccagagtgagcctgcccgaggacctgctggaggaccccgagatcttcttcgacgtggtgagcctgagcacctggcaggaggtgctgagcgacagccagagagagcacctgcagcagttcctgccccagttccccgaggacagcgccgagcagcagaacgagctgatcctggccctgttcagcggcgagaacttcagattcggcaaccccctgcacatcgcccagaagctgttcagagacggccacttcaaccccgaggtggtgaagtacagacagctgtgcttcaagagccagtacaagagatacctgaacagccagcagcagtacttccacagactgctgaagcagatcctggccagcagaagcgacctgctggagatggccagaagaagcggccccgccctgcccttcagacagaagagacccagccccagcagaacccccgaggagagagagtggagaacccagcagagatacctgaaggtgctgagagaggtgaaggaggagtgcggcgacaccgccctgagcagcgacgaggaggacctgagcagctggctgcccagcagccccgccagaagccccagccccgccgtgcccctgagagtggtgcccaccctgagcaccaccgacatgaagaccgccgacaaggtggagctgggcgacagcgacctgaagatcatgctgaagaagcaccacgagaagagaaagcaccagcccgaccaccccgacctgctgaccggcgacctgaccctgaacgacatcatgaccagagtgaacgccggcagaaagggcagcctggccgccctgtacgacctggccgtgctgaagaagaaggtgaaggagaaggaggagaagaagaagaagaagatcaagaccatcaagagcgaggccgaggacctggccgagcccctgagcagcaccgagggcgtggcccccctgagccaggcccccagccccctggccatccccgccatcaaggaggagcccctggaggacctgaagccctgcctgggcatcaacgagatcagcagcagcttcttcagcctgctgctggagatcctgctgctggagagccaggccagcctgcccatgctggaggagagagtgctggactggcagagcagccccgccagcagcctgaacagctggttcagcgccgcccccaactgggccgagctggtgctgcccgccctgcagtacctggccggcgagagcagagccgtgcccagcagcttcagccccttcgtggagttcaaggagaagacccagcagtggaagctgctgggccagagccaggacaacgagaaggagctggccgccctgttccagctgtggctggagaccaaggaccaggccttctgcaagcaggagaacgaggacagcagcgacgccaccacccccgtgcccagagtgagaaccgactacgtggtgagacccagcaccggcgaggagaagagagtgttccaggagcaggagagatacagatacagccagccccacaaggccttcaccttcagaatgcacggcttcgagagcgtggtgggccccgtgaagggcgtgttcgacaaggagaccagcctgaacaaggccagagagcacagcctgctgagaagcgacagacccgcctacgtgaccatcctgagcctggtgagagacgccgccgccagactgcccaacggcgagggcaccagagccgagatctgcgagctgctgaaggacagccagttcctggcccccgacgtgaccagcacccaggtgaacaccgtggtgagcggcgccctggacagactgcactacgagaaggacccctgcgtgaagtacgacatcggcagaaagctgtggatctacctgcacagagacagaagcgaggaggagttcgagagaatccaccaggcccaggccgccgccgccaaggccagaaaggccctgcagcagaagcccaagccccccagcaaggtgaagagcagcagcaaggagagcagcatcaaggtgctgagcagcggccccagcgagcagagccagatgagcctgagcgacagcagcatgccccccacccccgtgacccccgtgacccccaccacccccgccctgcccgccatccccatcagccccccccccgtgagcgccgtgaacaagagcggccccagcaccgtgagcgagcccgccaagagcagcagcggcgtgctgctggtgagcagccccaccatgccccacctgggcaccatgctgagccccgccagcagccagaccgcccccagcagccaggccgccgccagagtggtgagccacagcggcagcgccggcctgagccaggtgagagtggtggcccagcccagcctgcccgccgtgccccagcagagcggcggccccgcccagaccctgccccagatgcccgccggcccccagatcagagtgcccgccaccgccacccagaccaaggtggtgccccagaccgtgatggccaccgtgcccgtgaaggcccagaccaccgccgccaccgtgcagagacccggccccggccagaccggcctgaccgtgaccagcctgcccgccaccgccagccccgtgagcaagcccgccaccagcagccccggcaccagcgcccccagcgccagcaccgccgccgtgatccagaacgtgaccggccagaacatcatcaagcaggtggccatcaccggccagctgggcgtgaagccccagaccggcaacagcatccccctgaccgccaccaacttcagaatccagggcaaggacgtgctgagactgccccccagcagcatcaccaccgacgccaagggccagaccgtgctgagaatcacccccgacatgatggccaccctggccaagagccaggtgaccaccgtgaagctgacccaggacctgttcggcaccggcggcaacaccaccggcaagggcatcagcgccaccctgcacgtgaccagcaaccccgtgcacgccgccgacagccccgccaaggccagcagcgccagcgcccccagcagcacccccaccggcaccaccgtggtgaaggtgacccccgacctgaagcccaccgaggccagcagcagcgccttcagactgatgcccgccctgggcgtgagcgtggccgaccagaagggcaagagcaccgtggccagcagcgaggccaagcccgccgccaccatcagaatcgtgcagggcctgggcgtgatgccccccaaggccggccagaccatcaccgtggccacccacgccaagcagggcgccagcgtggccagcggcagcggcaccgtgcacaccagcgccgtgagcctgcccagcatgaacgccgccgtgagcaagaccgtggccgtggccagcggcgccgccagcacccccatcagcatcagcaccggcgcccccaccgtgagacaggtgcccgtgagcaccaccgtggtgagcaccagccaggccggcaagctgcccaccagaatcaccgtgcccctgagcgtgatcagccagcccatgaagggcaagagcgtggtgaccgcccccatcatcaagggcaacctgggcgccaacctgagcggcctgggcagaaacatcatcctgaccaccatgcccgccggcaccaagctgatcgccggcaacaagcccgtgagcttcctgaccgcccagcagctgcagcagctgcagcagcagggccaggccacccaggtgagaatccagaccgtgcccgccagccacctgcagcagggcaccgccagcggcagcagcaaggccgtgagcaccgtggtggtgaccaccgcccccagccccaagcaggcccccgagcagcagtag

SEQ ID NO: 91445 - DNA, 3900 bp, Artificial Sequence; identical to SEQ ID NO: 91444
  Description of Artificial Sequence: Synthetic coding sequence

SEQ ID NO: 91446 - DNA, 3900 bp, Artificial Sequence; identical to SEQ ID NO: 91444
  Description of Artificial Sequence: Synthetic coding sequence

SEQ ID NO: 91447 - DNA, 3975 bp, Artificial Sequence
  Description of Artificial Sequence: Synthetic coding sequence
atgcacgtgttcgtgcagagcacctgcggcgaggagaccatggacagcctggaccacatgctgaccgaccccctggagctgggcccctgcggcgacggccacggcaccagaatcatggaggactgcctgctgggcggcaccagagtgagcctgcccgaggacctgctggaggaccccgagatcttcttcgacgtggtgagcctgagcacctggcaggaggtgctgagcgacagccagagagagcacctgcagcagttcctgccccagttccccgaggacagcgccgagcagcagaacgagctgatcctggccctgttcagcggcgagaacttcagattcggcaaccccctgcacatcgcccagaagctgttcagagacggccacttcaaccccgaggtggtgaagtacagacagctgtgcttcaagagccagtacaagagatacctgaacagccagcagcagtacttccacagactgctgaagcagatcctggccagcagaagcgacctgctggagatggccagaagaagcggccccgccctgcccttcagacagaagagacccagccccagcagaacccccgaggagagagagtggagaacccagcagagatacctgaaggtgctgagagaggtgaaggaggagtgcggcgacaccgccctgagcagcgacgaggaggccaccctggacctgcaggagcagttcagcttcgaggacctgagcagctggctgcccagcagccccgccagaagccccagccccgccgtgcccctgagagtggtgcccaccctgagcaccaccgacatgaagaccgccgacaaggtggagctgggcgacagcgacctgaagatcatgctgaagaagcaccacgagaagagaaagcaccagcccgaccaccccgacctgctgaccggcgacctgaccctgaacgacatcatgaccagagtgaacgccggcagaaagggcagcctggccgccctgtacgacctggccgtgctgaagaagaaggtgaaggagaaggaggagaagaagaagaagaagatcaagaccatcaagagcgaggccgaggacctggccgagcccctgagcagcaccgagggcgtggcccccctgagccaggcccccagccccctggccatccccgccatcaaggaggagcccctggaggacctgaagccctgcctgggcatcaacgagatcagcagcagcttcttcagcctgctgctggagatcctgctgctggagagccaggccagcctgcccatgctggaggagagagtgctggactggcagagcagccccgccagcagcctgaacagctggttcagcgccgcccccaactgggccgagctggtgctgcccgccctgcagtacctggccggcgagagcagagccgtgcccagcagcttcagccccttcgtggagttcaaggagaagacccagcagtggaagctgctgggccagagccaggacaacgagaaggagctggccgccctgttccagctgtggctggagaccaaggaccaggccttctgcaagcaggagaacgaggacagcagcgacgccaccacccccgtgcccagagtgagaaccgactacgtggtgagacccagcaccggcgaggagaagagagtgttccaggagcaggagagatacagatacagccagccccacaaggccttcaccttcagaatgcacggcttcgagagcgtggtgggccccgtgaagggcgtgttcgacaaggagaccagcctgaacaaggccagagagcacagcctgctgagaagcgacagacccgcctacgtgaccatcctgagcctggtgagagacgccgccgccagactgcccaacggcgagggcaccagagccgagatctgcgagctgctgaaggacagccagttcctggcccccgacgtgaccagcacccaggtgaacaccgtggtgagcggcgccctggacagactgcactacgagaaggacccctgcgtgaagtacgacatcggcagaaagctgtggatctacctgcacagagacagaagcgaggaggagttcgagagaatccaccaggcccaggccgccgccgccaaggccagaaaggccctgcagcagaagcccaagccccccagcaaggtgaagagcagcagcaaggagagcagcatcaaggtgctgagcagcggccccagcgagcagagccagatgagcctgagcgacagcagcatgccccccacccccgtgacccccgtgacccccaccacccccgccctgcccgccatccccatcagccccccccccgtgagcgccgtgaacaagagcggccccagcaccgtgagcgagcccgccaagagcagcagcggcgtgctgctggtgagcagccccaccatgccccacctgggcaccatgctgagccccgccagcagccagaccgcccccagcagccaggccgccgccagagtggtgagccacagcggcagcgccggcctgagccaggtgagagtggtggcccagcccagcctgcccgccgtgccccagcagagcggcggccccgcccagaccctgccccagatgcccgccggcccccagatcagagtgcccgccaccgccacccagaccaaggtggtgccccagaccgtgatggccaccgtgcccgtgaaggcccagaccaccgccgccaccgtgcagagacccggccccggccagaccggcctgaccgtgaccagcctgcccgccaccgccagccccgtgagcaagcccgccaccagcagccccggcaccagcgcccccagcgccagcaccgccgccgtgatccagaacgtgaccggccagaacatcatcaagcaggtggccatcaccggccagctgggcgtgaagccccagaccggcaacagcatccccctgaccgccaccaacttcagaatccagggcaaggacgtgctgagactgccccccagcagcatcaccaccgacgccaagggccagaccgtgctgagaatcacccccgacatgatggccaccctggccaagagccaggtgaccaccgtgaagctgacccaggacctgttcggcaccggcggcaacaccaccggcaagggcatcagcgccaccctgcacgtgaccagcaaccccgtgcacgccgccgacagccccgccaaggccagcagcgccagcgcccccagcagcacccccaccggcaccaccgtggtgaaggtgacccccgacctgaagcccaccgaggccagcagcagcgccttcagactgatgcccgccctgggcgtgagcgtggccgaccagaagggcaagagcaccgtggccagcagcgaggccaagcccgccgccaccatcagaatcgtgcagggcctgggcgtgatgccccccaaggccggccagaccatcaccgtggccacccacgccaagcagggcgccagcgtggccagcggcagcggcaccgtgcacaccagcgccgtgagcctgcccagcatgaacgccgccgtgagcaagaccgtggccgtggccagcggcgccgccagcacccccatcagcatcagcaccggcgcccccaccgtgagacaggtgcccgtgagcaccaccgtggtgagcaccagccaggccggcaagctgcccaccagaatcaccgtgcccctgagcgtgatcagccagcccatgaagggcaagagcgtggtgaccgcccccatcatcaagggcaacctgggcgccaacctgagcggcctgggcagaaacatcatcctgaccaccatgcccgccggcaccaagctgatcgccggcaacaagcccgtgagcttcctgaccgcccagcagctgcagcagctgcagcagcagggccaggccacccaggtgagaatccagaccgtgcccgccagccacctgcagcagggcaccgccagcggcagcagcaaggccgtgagcaccgtggtggtgaccaccgcccccagccccaagcaggcccccgagcagcagtag

SEQ ID NO: 91448 - DNA, 1389 bp, Artificial Sequence
  Description of Artificial Sequence: Synthetic coding sequence
atgcagctgagaaagatgcagaccgtgaagaaggagcaggccagcctggacgccagcagcaacgtggacaagatgatggtgctgaacagcgccctgaccgaggtgagcgaggacagcaccaccggcgaggagctgctgctgagcgagggcagcgtgggcaagaacaagagcagcgcctgcagaagaaagagagagttcatccccgacgagaagaaggacgccatgtactgggagaagagaagaaagaacaacgaggccgccaagagaagcagagagaagagaagactgaacgacctggtgctggagaacaagctgatcgccctgggcgaggagaacgccaccctgaaggccgagctgctgagcctgaagctgaagttcggcctgatcagcagcaccgcctacgcccaggagatccagaagctgagcaacagcaccgccgtgtacttccaggactaccagaccagcaagagcaacgtgagcagcttcgtggacgagcacgagcccagcatggtgagcagcagctgcatcagcgtgatcaagcacagcccccagagcagcctgagcgacgtgagcgaggtgagcagcgtggagcacacccaggagagcagcgtgcagggcagctgcagaagccccgagaacaagttccagatcatcaagcaggagcccatggagctggagagctacaccagagagcccagagacgacagaggcagctacaccgccagcatctaccagaactacatgggcaacagcttcagcggctacagccacagcccccccctgctgcaggtgaacagaagcagcagcaacagccccagaaccagcgagaccgacgacggcgtggtgggcaagagcagcgacggcgaggacgagcagcaggtgcccaagggccccatccacagccccgtggagctgaagcacgtgcacgccaccgtggtgaaggtgcccgaggtgaacagcagcgccctgccccacaagctgagaatcaaggccaaggccatgcagatcaaggtggaggccttcgacaacgagttcgaggccacccagaagctgagcagccccatcgacatgaccagcaagagacacttcgagctggagaagcacagcgcccccagcatggtgcacagcagcctgacccccttcagcgtgcaggtgaccaacatccaggactggagcctgaagagcgagcactggcaccagaaggagctgagcggcaagacccagaacagcttcaagaccggcgtggtggagatgaaggacagcggctacaaggtgagcgaccccgagaacctgtacctgaagcagggcatcgccaacctgagcgccgaggtggtgagcctgaagagactgatcgccacccagcccatcagcgccagcgacagcggctag

SEQ ID NO: 91449 - DNA, 1389 bp, Artificial Sequence; identical to SEQ ID NO: 91448
  Description of Artificial Sequence: Synthetic coding sequence

SEQ ID NO: 91450 - DNA, 1488 bp, Artificial Sequence
  Description of Artificial Sequence: Synthetic coding sequence
atggccgagcccaccagcgacttcgagacccccatcggctggcacgccagccccgagctgacccccaccctgggccccctgagcgacaccgccccccccagagacagctggatgttctgggccatgctgccccccccccccccccccctgaccagcagcctgcccgccgccggcagcaagcccagcagcgagagccagccccccatggaggcccagagcctgcccggcgcccccccccccttcgacgcccagatcctgcccggcgcccagccccccttcgacgcccagagccccctggacagccagccccagcccagcggccagccctggaacttccacgccagcaccagctggtactggagacagagcagcgacagattccccagacaccagaagagcttcaaccccgccgtgaagaacagctactaccccagaaagtacgacgccaagttcaccgacttcagcctgccccccagcagaaagcagaagaagaagaagagaaaggagcccgtgttccacttcttctgcgacacctgcgacagaggcttcaagaaccaggagaagtacgacaagcacatgagcgagcacaccaagtgccccgagctggactgcagcttcaccgcccacgagaagatcgtgcagttccactggagaaacatgcacgcccccggcatgaagaagatcaagctggacacccccgaggagatcgccagatggagagaggagagaagaaagaactaccccaccctggccaacatcgagagaaagaagaagctgaagctggagaaggagaagagaggcgccgtgctgaccaccacccagtacggcaagatgaagggcatgagcagacacagccagatggccaagatcagaagccccggcaagaaccacaagtggaagaacgacaacagcagacagagagccgtgaccggcagcggcagccacctgtgcgacctgaagctggagggcccccccgaggccaacgccgaccccctgggcgtgctgatcaacagcgacagcgagagcgacaaggaggagaagccccagcacagcgtgatccccaaggaggtgacccccgccctgtgcagcctgatgagcagctacggcagcctgagcggcagcgagagcgagcccgaggagacccccatcaagaccgaggccgacgtgctggccgagaaccaggtgctggacagcagcgcccccaagagccccagccaggacgtgaaggccaccgtgagaaacttcagcgaggccaagagcgagaacagaaagaagagcttcgagaagaccaaccccaagagaaagaaggactaccacaactaccagaccctgttcgagcccagaacccaccacccctacctgctggagatgctgctggcccccgacatcagacacgagagaaacgtgatcctgcagtgcgtgagatacatcatcaagaaggacttcttcggcctggacaccaacagcgccaagagcaaggacgtgtag

SEQ ID NO: 91451 - DNA, 648 bp, Artificial Sequence
  Description of Artificial Sequence: Synthetic coding sequence
atggagacccaggccgagcagcaggagctggagaccctgcccaccaccaagatggcccagaccaaccccacccccggcagcctgggcccctggaagatcaccatctacgaccaggagaacttccagggcaagagaatggagttcaccagcagctgccccaacgtgagcgagagaagcttcgacaacgtgagaagcctgaaggtggagagcggcgcctggatcggctacgagcacaccagcttctgcggccagcagttcatcctggagagaggcgagtaccccagatgggacgcctggagcggcagcaacgcctaccacatcgagagactgatgagcttcagacccatctgcagcgccaaccacaaggagagcaagatgaccatcttcgagaaggagaacttcatcggcagacagtgggagatcagcgacgactaccccagcctgcaggccatgggctggttcaacaacgaggtgggcagcatgaagatccagagcggcgcctgggtgtgctaccagtaccccggctacagaggctaccagtacatcctggagtgcgaccaccacggcggcgactacaagcactggagagagtggggcagccacgcccagaccagccagatccagagcatcagaagaatccagcagtag

SEQ ID NO: 91452 - DNA, 2940 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagaagcagctggccgacgagagaagcaacagagacgagctggagctggagctggccgagaacagaaagctgctgaccgagaaggacgcccagatcgccatgatgcagcagagaatcgacagactggccctgctgaacgagaagcaggccgccagccccctggagcccaaggagctggaggagctgagagacaagaacgagagcctgaccatgagactgcacgagaccctgaagcagtgccaggacctgaagaccgagaagagccagatggacagaaagatcaaccagctgagcgaggagaacggcgacctgagcttcaagctgagagagttcgccagccacctgcagcagctgcaggacgccctgaacgagctgaccgaggagcacagcaaggccacccaggagtggctggagaagcaggcccagctggagaaggagctgagcgccgccctgcaggacaagaagtgcctggaggagaagaacgagatcctgcagggcaagctgagccagctggaggagcacctgagccagctgcaggacaaccccccccaggagaagggcgaggtgctgggcgacgtgctgcaggtggaggagctgagcaagaagctggccgacagcgaccaggccagcaaggtgcagcagcagaagctgaaggccgtgcaggcccagggcggcgagagccagcaggaggcccagagactgcaggcccagctgaacgagctgcaggcccagctgagccagaaggagcaggccgccgagcactacaagctgcagatggagaaggccaagacccactacgacgccaagaagcagcagaaccaggagctgcaggagcagctgagaagcctggagcagctgcagaaggagaacaaggagctgagagccgaggccgagagactgggccacgagctgcagcaggccggcctgaagaccaaggaggccgagcagacctgcagacacctgaccgcccaggtgagaagcctggaggcccaggtggcccacgccgaccagcagctgagagacctgggcaagttccaggtggccaccgacgccctgaagagcagagagccccaggccaagccccagctggacctgagcatcgacagcctggacctgagctgcgaggagggcacccccctgagcatcaccagcaagctgcccagaacccagcccgacggcaccagcgtgcccggcgagcccgccagccccatcagccagagactgccccccaaggtggagagcctggagagcctgtacttcacccccatccccgccagaagccaggcccccctggagagcagcctggacagcctgggcgacgtgttcctggacagcggcagaaagaccagaagcgccagaagaagaaccacccagatcatcaacatcaccatgaccaagaagctggacgtggaggagcccgacagcgccaacagcagcttctacagcaccagaagcgcccccgccagccaggccagcctgagagccaccagcagcacccagagcctggccagactgggcagccccgactacggcaacagcgccctgctgagcctgcccggctacagacccaccaccagaagcagcgccagaagaagccaggccggcgtgagcagcggcgccccccccggcagaaacagcttctacatgggcacctgccaggacgagcccgagcagctggacgactggaacagaatcgccgagctgcagcagagaaacagagtgtgccccccccacctgaagacctgctaccccctggagagcagacccagcctgagcctgggcaccatcaccgacgaggagatgaagaccggcgacccccaggagaccctgagaagagccagcatgcagcccatccagatcgccgagggcaccggcatcaccaccagacagcagagaaagagagtgagcctggagccccaccagggccccggcacccccgagagcaagaaggccaccagctgcttccccagacccatgacccccagagacagacacgagggcagaaagcagagcaccaccgaggcccagaagaaggccgcccccgccagcaccaagcaggccgacagaagacagagcatggccttcagcatcctgaacacccccaagaagctgggcaacagcctgctgagaagaggcgccagcaagaaggccctgagcaaggccagccccaacaccagaagcggcaccagaagaagccccagaatcgccaccaccaccgccagcgccgccaccgccgccgccatcggcgccacccccagagccaagggcaaggccaagcactag

SEQ ID NO: 91453 - DNA, 6306 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagaagcagctggccgacgagagaagcaacagagacgagctggagctggagctggccgagaacagaaagctgctgaccgagaaggacgcccagatcgccatgatgcagcagagaatcgacagactggccctgctgaacgagaagcaggccgccagccccctggagcccaaggagctggaggagctgagagacaagaacgagagcctgaccatgagactgcacgagaccctgaagcagtgccaggacctgaagaccgagaagagccagatggacagaaagatcaaccagctgagcgaggagaacggcgacctgagcttcaagctgagagagttcgccagccacctgcagcagctgcaggacgccctgaacgagctgaccgaggagcacagcaaggccacccaggagtggctggagaagcaggcccagctggagaaggagctgagcgccgccctgcaggacaagaagtgcctggaggagaagaacgagatcctgcagggcaagctgagccagctggaggagcacctgagccagctgcaggacaaccccccccaggagaagggcgaggtgctgggcgacgtgctgcagctggagaccctgaagcaggaggccgccaccctggccgccaacaacacccagctgcaggccagagtggagatgctggagaccgagagaggccagcaggaggccaagctgctggccgagagaggccacttcgaggaggagaagcagcagctgagcagcctgatcaccgacctgcagagcagcatcagcaacctgagccaggccaaggaggagctggagcaggccagccaggcccacggcgccagactgaccgcccaggtggccagcctgaccagcgagctgaccaccctgaacgccaccatccagcagcaggaccaggagctggccggcctgaagcagcaggccaaggagaagcaggcccagctggcccagaccctgcagcagcaggagcaggccagccagggcctgagacaccaggtggagcagctgagcagcagcctgaagcagaaggagcagcagctgaaggaggtggccgagaagcaggaggccaccagacaggaccacgcccagcagctggccaccgccgccgaggagagagaggccagcctgagagagagagacgccgccctgaagcagctggaggccctggagaaggagaaggccgccaagctggagatcctgcagcagcagctgcaggtggccaacgaggccagagacagcgcccagaccagcgtgacccaggcccagagagagaaggccgagctgagcagaaaggtggaggagctgcaggcctgcgtggagaccgccagacaggagcagcacgaggcccaggcccaggtggccgagctggagctgcagctgagaagcgagcagcagaaggccaccgagaaggagagagtggcccaggagaaggaccagctgcaggagcagctgcaggccctgaaggagagcctgaaggtgaccaagggcagcctggaggaggagaagagaagagccgccgacgccctggaggagcagcagagatgcatcagcgagctgaaggccgagaccagaagcctggtggagcagcacaagagagagagaaaggagctggaggaggagagagccggcagaaagggcctggaggccagactgcagcagctgggcgaggcccaccaggccgagaccgaggtgctgagaagagagctggccgaggccatggccgcccagcacaccgccgagagcgagtgcgagcagctggtgaaggaggtggccgcctggagagagagatacgaggacagccagcaggaggaggcccagtacggcgccatgttccaggagcagctgatgaccctgaaggaggagtgcgagaaggccagacaggagctgcaggaggccaaggagaaggtggccggcatcgagagccacagcgagctgcagatcagcagacagcagaacgagctggccgagctgcacgccaacctggccagagccctgcagcaggtgcaggagaaggaggtgagagcccagaagctggccgacgacctgagcaccctgcaggagaagatggccgccaccagcaaggaggtggccagactggagaccctggtgagaaaggccggcgagcagcaggagaccgccagcagagagctggtgaaggagcccgccagagccggcgacagacagcccgagtggctggaggagcagcagggcagacagttctgcagcacccaggccgccctgcaggccatggagagagaggccgagcagatgggcaacgagctggagagactgagagccgccctgatggagagccagggccagcagcaggaggagagaggccagcaggagagagaggtggccagactgacccaggagagaggcagagcccaggccgacctggccctggagaaggccgccagagccgagctggagatgagactgcagaacgccctgaacgagcagagagtggagttcgccaccctgcaggaggccctggcccacgccctgaccgagaaggagggcaaggaccaggagctggccaagctgagaggcctggaggccgcccagatcaaggagctggaggagctgagacagaccgtgaagcagctgaaggagcagctggccaagaaggagaaggagcacgccagcggcagcggcgcccagagcgaggccgccggcagaaccgagcccaccggccccaagctggaggccctgagagccgaggtgagcaagctggagcagcagtgccagaagcagcaggagcaggccgacagcctggagagaagcctggaggccgagagagccagcagagccgagagagacagcgccctggagaccctgcagggccagctggaggagaaggcccaggagctgggccacagccagagcgccctggccagcgcccagagagagctggccgccttcagaaccaaggtgcaggaccacagcaaggccgaggacgagtggaaggcccaggtggccagaggcagacaggaggccgagagaaagaacagcctgatcagcagcctggaggaggaggtgagcatcctgaacagacaggtgctggagaaggagggcgagagcaaggagctgaagagactggtgatggccgagagcgagaagagccagaagctggaggagagactgagactgctgcaggccgagaccgccagcaacagcgccagagccgccgagagaagcagcgccctgagagaggaggtgcagagcctgagagaggaggccgagaagcagagagtggccagcgagaacctgagacaggagctgaccagccaggccgagagagccgaggagctgggccaggagctgaaggcctggcaggagaagttcttccagaaggagcaggccctgagcaccctgcagctggagcacaccagcacccaggccctggtgagcgagctgctgcccgccaagcacctgtgccagcagctgcaggccgagcaggccgccgccgagaagagacacagagaggagctggagcagagcaagcaggccgccggcggcctgagagccgagctgctgagagcccagagagagctgggcgagctgatccccctgagacagaaggtggccgagcaggagagaaccgcccagcagctgagagccgagaaggccagctacgccgagcagctgagcatgctgaagaaggcccacggcctgctggccgaggagaacagaggcctgggcgagagagccaacctgggcagacagttcctggaggtggagctggaccaggccagagagaagtacgtgcaggagctggccgccgtgagagccgacgccgagaccagactggccgaggtgcagagagaggcccagagcaccgccagagagctggaggtgatgaccgccaagtacgagggcgccaaggtgaaggtgctggaggagagacagagattccaggaggagagacagaagctgaccgcccaggtggaggagctgagcaagaagctggccgacagcgaccaggccagcaaggtgcagcagcagaagctgaaggccgtgcaggcccagggcggcgagagccagcaggaggcccagagactgcaggcccagctgaacgagctgcaggcccagctgagccagaaggagcaggccgccgagcactacaagctgcagatggagaaggccaagacccactacgacgccaagaagcagcagaaccaggagctgcaggagcagctgagaagcctggagcagctgcagaaggagaacaaggagctgagagccgaggccgagagactgggccacgagctgcagcaggccggcctgaagaccaaggaggccgagcagacctgcagacacctgaccgcccaggtgagaagcctggaggcccaggtggcccacgccgaccagcagctgagagacctgggcaagttccaggtggccaccgacgccctgaagagcagagagccccaggccaagccccagctggacctgagcatcgacagcctggacctgagctgcgaggagggcacccccctgagcatcaccagcaagctgcccagaacccagcccgacggcaccagcgtgcccggcgagcccgccagccccatcagccagagactgccccccaaggtggagagcctggagagcctgtacttcacccccatccccgccagaagccaggcccccctggagagcagcctggacagcctgggcgacgtgttcctggacagcggcagaaagaccagaagcgccagaagaagaaccacccagatcatcaacatcaccatgaccaagaagctggacgtggaggagcccgacagcgccaacagcagcttctacagcaccagaagcgcccccgccagccaggccagcctgagagccaccagcagcacccagagcctggccagactgggcagccccgactacggcaacagcgccctgctgagcctgcccggctacagacccaccaccagaagcagcgccagaagaagccaggccggcgtgagcagcggcgccccccccggcagaaacagcttctacatgggcacctgccaggacgagcccgagcagctggacgactggaacagaatcgccgagctgcagcagagaaacagagtgtgccccccccacctgaagacctgctaccccctggagagcagacccagcctgagcctgggcaccatcaccgacgaggagatgaagaccggcgacccccaggagaccctgagaagagccagcatgcagcccatccagatcgccgagggcaccggcatcaccaccagacagcagagaaagagagtgagcctggagccccaccagggccccggcacccccgagagcaagaaggccaccagctgcttccccagacccatgacccccagagacagacacgagggcagaaagcagagcaccaccgaggcccagaagaaggccgcccccgccagcaccaagcaggccgacagaagacagagcatggccttcagcatcctgaacacccccaagaagctgggcaacagcctgctgagaagaggcgccagcaagaaggccctgagcaaggccagccccaacaccagaagcggcaccagaagaagccccagaatcgccaccaccaccgccagcgccgccaccgccgccgccatcggcgccacccccagagccaagggcaaggccaagcactag

SEQ ID NO: 91454 - DNA, 4995 bp, Artificial Sequence
  Description of Artificial Sequence: Synthetic coding sequence
atgctggagaccgagagaggccagcaggaggccaagctgctggccgagagaggccacttcgaggaggagaagcagcagctgagcagcctgatcaccgacctgcagagcagcatcagcaacctgagccaggccaaggaggagctggagcaggccagccaggcccacggcgccagactgaccgcccaggtggccagcctgaccagcgagctgaccaccctgaacgccaccatccagcagcaggaccaggagctggccggcctgaagcagcaggccaaggagaagcaggcccagctggcccagaccctgcagcagcaggagcaggccagccagggcctgagacaccaggtggagcagctgagcagcagcctgaagcagaaggagcagcagctgaaggaggtggccgagaagcaggaggccaccagacaggaccacgcccagcagctggccaccgccgccgaggagagagaggccagcctgagagagagagacgccgccctgaagcagctggaggccctggagaaggagaaggccgccaagctggagatcctgcagcagcagctgcaggtggccaacgaggccagagacagcgcccagaccagcgtgacccaggcccagagagagaaggccgagctgagcagaaaggtggaggagctgcaggcctgcgtggagaccgccagacaggagcagcacgaggcccaggcccaggtggccgagctggagctgcagctgagaagcgagcagcagaaggccaccgagaaggagagagtggcccaggagaaggaccagctgcaggagcagctgcaggccctgaaggagagcctgaaggtgaccaagggcagcctggaggaggagaagagaagagccgccgacgccctggaggagcagcagagatgcatcagcgagctgaaggccgagaccagaagcctggtggagcagcacaagagagagagaaaggagctggaggaggagagagccggcagaaagggcctggaggccagactgcagcagctgggcgaggcccaccaggccgagaccgaggtgctgagaagagagctggccgaggccatggccgcccagcacaccgccgagagcgagtgcgagcagctggtgaaggaggtggccgcctggagagagagatacgaggacagccagcaggaggaggcccagtacggcgccatgttccaggagcagctgatgaccctgaaggaggagtgcgagaaggccagacaggagctgcaggaggccaaggagaaggtggccggcatcgagagccacagcgagctgcagatcagcagacagcagaacgagctggccgagctgcacgccaacctggccagagccctgcagcaggtgcaggagaaggaggtgagagcccagaagctggccgacgacctgagcaccctgcaggagaagatggccgccaccagcaaggaggtggccagactggagaccctggtgagaaaggccggcgagcagcaggagaccgccagcagagagctggtgaaggagcccgccagagccggcgacagacagcccgagtggctggaggagcagcagggcagacagttctgcagcacccaggccgccctgcaggccatggagagagaggccgagcagatgggcaacgagctggagagactgagagccgccctgatggagagccagggccagcagcaggaggagagaggccagcaggagagagaggtggccagactgacccaggagagaggcagagcccaggccgacctggccctggagaaggccgccagagccgagctggagatgagactgcagaacgccctgaacgagcagagagtggagttcgccaccctgcaggaggccctggcccacgccctgaccgagaaggagggcaaggaccaggagctggccaagctgagaggcctggaggccgcccagatcaaggagctggaggagctgagacagaccgtgaagcagctgaaggagcagctggccaagaaggagaaggagcacgccagcggcagcggcgcccagagcgaggccgccggcagaaccgagcccaccggccccaagctggaggccctgagagccgaggtgagcaagctggagcagcagtgccagaagcagcaggagcaggccgacagcctggagagaagcctggaggccgagagagccagcagagccgagagagacagcgccctggagaccctgcagggccagctggaggagaaggcccaggagctgggccacagccagagcgccctggccagcgcccagagagagctggccgccttcagaaccaaggtgcaggaccacagcaaggccgaggacgagtggaaggcccaggtggccagaggcagacaggaggccgagagaaagaacagcctgatcagcagcctggaggaggaggtgagcatcctgaacagacaggtgctggagaaggagggcgagagcaaggagctgaagagactggtgatggccgagagcgagaagagccagaagctggaggagagactgagactgctgcaggccgagaccgccagcaacagcgccagagccgccgagagaagcagcgccctgagagaggaggtgcagagcctgagagaggaggccgagaagcagagagtggccagcgagaacctgagacaggagctgaccagccaggccgagagagccgaggagctgggccaggagctgaaggcctggcaggagaagttcttccagaaggagcaggccctgagcaccctgcagctggagcacaccagcacccaggccctggtgagcgagctgctgcccgccaagcacctgtgccagcagctgcaggccgagcaggccgccgccgagaagagacacagagaggagctggagcagagcaagcaggccgccggcggcctgagagccgagctgctgagagcccagagagagctgggcgagctgatccccctgagacagaaggtggccgagcaggagagaaccgcccagcagctgagagccgagaaggccagctacgccgagcagctgagcatgctgaagaaggcccacggcctgctggccgaggagaacagaggcctgggcgagagagccaacctgggcagacagttcctggaggtggagctggaccaggccagagagaagtacgtgcaggagctggccgccgtgagagccgacgccgagaccagactggccgaggtgcagagagaggcccagagcaccgccagagagctggaggtgatgaccgccaagtacgagggcgccaaggtgaaggtgctggaggagagacagagattccaggaggagagacagaagctgaccgcccaggtggaggagctgagcaagaagctggccgacagcgaccaggccagcaaggtgcagcagcagaagctgaaggccgtgcaggcccagggcggcgagagccagcaggaggcccagagactgcaggcccagctgaacgagctgcaggcccagctgagccagaaggagcaggccgccgagcactacaagctgcagatggagaaggccaagacccactacgacgccaagaagcagcagaaccaggagctgcaggagcagctgagaagcctggagcagctgcagaaggagaacaaggagctgagagccgaggccgagagactgggccacgagctgcagcaggccggcctgaagaccaaggaggccgagcagacctgcagacacctgaccgcccaggtgagaagcctggaggcccaggtggcccacgccgaccagcagctgagagacctgggcaagttccaggtggccaccgacgccctgaagagcagagagccccaggccaagccccagctggacctgagcatcgacagcctggacctgagctgcgaggagggcacccccctgagcatcaccagcaagctgcccagaacccagcccgacggcaccagcgtgcccggcgagcccgccagccccatcagccagagactgccccccaaggtggagagcctggagagcctgtacttcacccccatccccgccagaagccaggcccccctggagagcagcctggacagcctgggcgacgtgttcctggacagcggcagaaagaccagaagcgccagaagaagaaccacccagatcatcaacatcaccatgaccaagaagctggacgtggaggagcccgacagcgccaacagcagcttctacagcaccagaagcgcccccgccagccaggccagcctgagagccaccagcagcacccagagcctggccagactgggcagccccgactacggcaacagcgccctgctgagcctgcccggctacagacccaccaccagaagcagcgccagaagaagccaggccggcgtgagcagcggcgccccccccggcagaaacagcttctacatgggcacctgccaggacgagcccgagcagctggacgactggaacagaatcgccgagctgcagcagagaaacagagtgtgccccccccacctgaagacctgctaccccctggagagcagacccagcctgagcctgggcaccatcaccgacgaggagatgaagaccggcgacccccaggagaccctgagaagagccagcatgcagcccatccagatcgccgagggcaccggcatcaccaccagacagcagagaaagagagtgagcctggagccccaccagggccccggcacccccgagagcaagaaggccaccagctgcttccccagacccatgacccccagagacagacacgagggcagaaagcagagcaccaccgaggcccagaagaaggccgcccccgccagcaccaagcaggccgacagaagacagagcatggccttcagcatcctgaacacccccaagaagctgggcaacagcctgctgagaagaggcgccagcaagaaggccctgagcaaggccagccccaacaccagaagcggcaccagaagaagccccagaatcgccaccaccaccgccagcgccgccaccgccgccgccatcggcgccacccccagagccaagggcaaggccaagcactag

SEQ ID NO: 91455 - DNA, 228 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcacccctag

SEQ ID NO: 91456 - DNA, 276 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagctag

SEQ ID NO: 91457 - DNA, 6348 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagaagcagctggccgacgagagaagcaacagagacgagctggagctggagctggccgagaacagaaagctgctgaccgagaaggacgcccagatcgccatgatgcagcagagaatcgacagactggccctgctgaacgagaagcaggccgccagccccctggagcccaaggagctggaggagctgagagacaagaacgagagcctgaccatgagactgcacgagaccctgaagcagtgccaggacctgaagaccgagaagagccagatggacagaaagatcaaccagctgagcgaggagaacggcgacctgagcttcaagctgagagagttcgccagccacctgcagcagctgcaggacgccctgaacgagctgaccgaggagcacagcaaggccacccaggagtggctggagaagcaggcccagctggagaaggagctgagcgccgccctgcaggacaagaagtgcctggaggagaagaacgagatcctgcagggcaagctgagccagctggaggagcacctgagccagctgcaggacaaccccccccaggagaagggcgaggtgctgggcgacgtgctgcagctggagaccctgaagcaggaggccgccaccctggccgccaacaacacccagctgcaggccagagtggagatgctggagaccgagagaggccagcaggaggccaagctgctggccgagagaggccacttcgaggaggagaagcagcagctgagcagcctgatcaccgacctgcagagcagcatcagcaacctgagccaggccaaggaggagctggagcaggccagccaggcccacggcgccagactgaccgcccaggtggccagcctgaccagcgagctgaccaccctgaacgccaccatccagcagcaggaccaggagctggccggcctgaagcagcaggccaaggagaagcaggcccagctggcccagaccctgcagcagcaggagcaggccagccagggcctgagacaccaggtggagcagctgagcagcagcctgaagcagaaggagcagcagctgaaggaggtggccgagaagcaggaggccaccagacaggaccacgcccagcagctggccaccgccgccgaggagagagaggccagcctgagagagagagacgccgccctgaagcagctggaggccctggagaaggagaaggccgccaagctggagatcctgcagcagcagctgcaggtggccaacgaggccagagacagcgcccagaccagcgtgacccaggcccagagagagaaggccgagctgagcagaaaggtggaggagctgcaggcctgcgtggagaccgccagacaggagcagcacgaggcccaggcccaggtggccgagctggagctgcagctgagaagcgagcagcagaaggccaccgagaaggagagagtggcccaggagaaggaccagctgcaggagcagctgcaggccctgaaggagagcctgaaggtgaccaagggcagcctggaggaggagaagagaagagccgccgacgccctggaggagcagcagagatgcatcagcgagctgaaggccgagaccagaagcctggtggagcagcacaagagagagagaaaggagctggaggaggagagagccggcagaaagggcctggaggccagactgcagcagctgggcgaggcccaccaggccgagaccgaggtgctgagaagagagctggccgaggccatggccgcccagcacaccgccgagagcgagtgcgagcagctggtgaaggaggtggccgcctggagagagagatacgaggacagccagcaggaggaggcccagtacggcgccatgttccaggagcagctgatgaccctgaaggaggagtgcgagaaggccagacaggagctgcaggaggccaaggagaaggtggccggcatcgagagccacagcgagctgcagatcagcagacagcagaacgagctggccgagctgcacgccaacctggccagagccctgcagcaggtgcaggagaaggaggtgagagcccagaagctggccgacgacctgagcaccctgcaggagaagatggccgccaccagcaaggaggtggccagactggagaccctggtgagaaaggccggcgagcagcaggagaccgccagcagagagctggtgaaggagcccgccagagccggcgacagacagcccgagtggctggaggagcagcagggcagacagttctgcagcacccaggccgccctgcaggccatggagagagaggccgagcagatgggcaacgagctggagagactgagagccgccctgatggagagccagggccagcagcaggaggagagaggccagcaggagagagaggtggccagactgacccaggagagaggcagagcccaggccgacctggccctggagaaggccgccagagccgagctggagatgagactgcagaacgccctgaacgagcagagagtggagttcgccaccctgcaggaggccctggcccacgccctgaccgagaaggagggcaaggaccaggagctggccaagctgagaggcctggaggccgcccagatcaaggagctggaggagctgagacagaccgtgaagcagctgaaggagcagctggccaagaaggagaaggagcacgccagcggcagcggcgcccagagcgaggccgccggcagaaccgagcccaccggccccaagctggaggccctgagagccgaggtgagcaagctggagcagcagtgccagaagcagcaggagcaggccgacagcctggagagaagcctggaggccgagagagccagcagagccgagagagacagcgccctggagaccctgcagggccagctggaggagaaggcccaggagctgggccacagccagagcgccctggccagcgcccagagagagctggccgccttcagaaccaaggtgcaggaccacagcaaggccgaggacgagtggaaggcccaggtggccagaggcagacaggaggccgagagaaagaacagcctgatcagcagcctggaggaggaggtgagcatcctgaacagacaggtgctggagaaggagggcgagagcaaggagctgaagagactggtgatggccgagagcgagaagagccagaagctggaggagagactgagactgctgcaggccgagaccgccagcaacagcgccagagccgccgagagaagcagcgccctgagagaggaggtgcagagcctgagagaggaggccgagaagcagagagtggccagcgagaacctgagacaggagctgaccagccaggccgagagagccgaggagctgggccaggagctgaaggcctggcaggagaagttcttccagaaggagcaggccctgagcaccctgcagctggagcacaccagcacccaggccctggtgagcgagctgctgcccgccaagcacctgtgccagcagctgcaggccgagcaggccgccgccgagaagagacacagagaggagctggagcagagcaagcaggccgccggcggcctgagagccgagctgctgagagcccagagagagctgggcgagctgatccccctgagacagaaggtggccgagcaggagagaaccgcccagcagctgagagccgagaaggccagctacgccgagcagctgagcatgctgaagaaggcccacggcctgctggccgaggagaacagaggcctgggcgagagagccaacctgggcagacagttcctggaggtggagctggaccaggccagagagaagtacgtgcaggagctggccgccgtgagagccgacgccgagaccagactggccgaggtgcagagagaggcccagagcaccgccagagagctggaggtgatgaccgccaagtacgagggcgccaaggtgaaggtgctggaggagagacagagattccaggaggagagacagaagctgaccgcccaggtggagcagctggaggtgttccagagagagcagaccaagcaggtggaggagctgagcaagaagctggccgacagcgaccaggccagcaaggtgcagcagcagaagctgaaggccgtgcaggcccagggcggcgagagccagcaggaggcccagagactgcaggcccagctgaacgagctgcaggcccagctgagccagaaggagcaggccgccgagcactacaagctgcagatggagaaggccaagacccactacgacgccaagaagcagcagaaccaggagctgcaggagcagctgagaagcctggagcagctgcagaaggagaacaaggagctgagagccgaggccgagagactgggccacgagctgcagcaggccggcctgaagaccaaggaggccgagcagacctgcagacacctgaccgcccaggtgagaagcctggaggcccaggtggcccacgccgaccagcagctgagagacctgggcaagttccaggtggccaccgacgccctgaagagcagagagccccaggccaagccccagctggacctgagcatcgacagcctggacctgagctgcgaggagggcacccccctgagcatcaccagcaagctgcccagaacccagcccgacggcaccagcgtgcccggcgagcccgccagccccatcagccagagactgccccccaaggtggagagcctggagagcctgtacttcacccccatccccgccagaagccaggcccccctggagagcagcctggacagcctgggcgacgtgttcctggacagcggcagaaagaccagaagcgccagaagaagaaccacccagatcatcaacatcaccatgaccaagaagctggacgtggaggagcccgacagcgccaacagcagcttctacagcaccagaagcgcccccgccagccaggccagcctgagagccaccagcagcacccagagcctggccagactgggcagccccgactacggcaacagcgccctgctgagcctgcccggctacagacccaccaccagaagcagcgccagaagaagccaggccggcgtgagcagcggcgccccccccggcagaaacagcttctacatgggcacctgccaggacgagcccgagcagctggacgactggaacagaatcgccgagctgcagcagagaaacagagtgtgccccccccacctgaagacctgctaccccctggagagcagacccagcctgagcctgggcaccatcaccgacgaggagatgaagaccggcgacccccaggagaccctgagaagagccagcatgcagcccatccagatcgccgagggcaccggcatcaccaccagacagcagagaaagagagtgagcctggagccccaccagggccccggcacccccgagagcaagaaggccaccagctgcttccccagacccatgacccccagagacagacacgagggcagaaagcagagcaccaccgaggcccagaagaaggccgcccccgccagcaccaagcaggccgacagaagacagagcatggccttcagcatcctgaacacccccaagaagctgggcaacagcctgctgagaagaggcgccagcaagaaggccctgagcaaggccagccccaacaccagaagcggcaccagaagaagccccagaatcgccaccaccaccgccagcgccgccaccgccgccgccatcggcgccacccccagagccaagggcaaggccaagcactag

SEQ ID NO: 91458 - DNA, 330 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagctag

SEQ ID NO: 91459 - DNA, 186 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactgtag

SEQ ID NO: 91460 - DNA, 180 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagtag

SEQ ID NO: 91461 - DNA, 441 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggactag

SEQ ID NO: 91462 - DNA, 3267 bp, Artificial Sequence
  Description of Artificial Sequence: Synthetic coding sequence
atgagactgcagaacgccctgaacgagcagagagtggagttcgccaccctgcaggaggccctggcccacgccctgaccgagaaggagggcaaggaccaggagctggccaagctgagaggcctggaggccgcccagatcaaggagctggaggagctgagacagaccgtgaagcagctgaaggagcagctggccaagaaggagaaggagcacgccagcggcagcggcgcccagagcgaggccgccggcagaaccgagcccaccggccccaagctggaggccctgagagccgaggtgagcaagctggagcagcagtgccagaagcagcaggagcaggccgacagcctggagagaagcctggaggccgagagagccagcagagccgagagagacagcgccctggagaccctgcagggccagctggaggagaaggcccaggagctgggccacagccagagcgccctggccagcgcccagagagagctggccgccttcagaaccaaggtgcaggaccacagcaaggccgaggacgagtggaaggcccaggtggccagaggcagacaggaggccgagagaaagaacagcctgatcagcagcctggaggaggaggtgagcatcctgaacagacaggtgctggagaaggagggcgagagcaaggagctgaagagactggtgatggccgagagcgagaagagccagaagctggaggagagactgagactgctgcaggccgagaccgccagcaacagcgccagagccgccgagagaagcagcgccctgagagaggaggtgcagagcctgagagaggaggccgagaagcagagagtggccagcgagaacctgagacaggagctgaccagccaggccgagagagccgaggagctgggccaggagctgaaggcctggcaggagaagttcttccagaaggagcaggccctgagcaccctgcagctggagcacaccagcacccaggccctggtgagcgagctgctgcccgccaagcacctgtgccagcagctgcaggccgagcaggccgccgccgagaagagacacagagaggagctggagcagagcaagcaggccgccggcggcctgagagccgagctgctgagagcccagagagagctgggcgagctgatccccctgagacagaaggtggccgagcaggagagaaccgcccagcagctgagagccgagaaggccagctacgccgagcagctgagcatgctgaagaaggcccacggcctgctggccgaggagaacagaggcctgggcgagagagccaacctgggcagacagttcctggaggtggagctggaccaggccagagagaagtacgtgcaggagctggccgccgtgagagccgacgccgagaccagactggccgaggtgcagagagaggcccagagcaccgccagagagctggaggtgatgaccgccaagtacgagggcgccaaggtgaaggtgctggaggagagacagagattccaggaggagagacagaagctgaccgcccaggtggaggagctgagcaagaagctggccgacagcgaccaggccagcaaggtgcagcagcagaagctgaaggccgtgcaggcccagggcggcgagagccagcaggaggcccagagactgcaggcccagctgaacgagctgcaggcccagctgagccagaaggagcaggccgccgagcactacaagctgcagatggagaaggccaagacccactacgacgccaagaagcagcagaaccaggagctgcaggagcagctgagaagcctggagcagctgcagaaggagaacaaggagctgagagccgaggccgagagactgggccacgagctgcagcaggccggcctgaagaccaaggaggccgagcagacctgcagacacctgaccgcccaggtgagaagcctggaggcccaggtggcccacgccgaccagcagctgagagacctgggcaagttccaggtggccaccgacgccctgaagagcagagagccccaggccaagccccagctggacctgagcatcgacagcctggacctgagctgcgaggagggcacccccctgagcatcaccagacacaaggccctgatgaccatcatccccgacctgagccccaacaaccccctgagcaagctgcccagaacccagcccgacggcaccagcgtgcccggcgagcccgccagccccatcagccagagactgccccccaaggtggagagcctggagagcctgtacttcacccccatccccgccagaagccaggcccccctggagagcagcctggacagcctgggcgacgtgttcctggacagcggcagaaagaccagaagcgccagaagaagaaccacccagatcatcaacatcaccatgaccaagaagctggacgtggaggagcccgacagcgccaacagcagcttctacagcaccagaagcgcccccgccagccaggccagcctgagagccaccagcagcacccagagcctggccagactgggcagccccgactacggcaacagcgccctgctgagcctgcccggctacagacccaccaccagaagcagcgccagaagaagccaggccggcgtgagcagcggcgccccccccggcagaaacagcttctacatgggcacctgccaggacgagcccgagcagctggacgactggaacagaatcgccgagctgcagcagagaaacagagtgtgccccccccacctgaagacctgctaccccctggagagcagacccagcctgagcctgggcaccatcaccgacgaggagatgaagaccggcgacccccaggagaccctgagaagagccagcatgcagcccatccagatcgccgagggcaccggcatcaccaccagacagcagagaaagagagtgagcctggagccccaccagggccccggcacccccgagagcaagaaggccaccagctgcttccccagacccatgacccccagagacagacacgagggcagaaagcagagcaccaccgaggcccagaagaaggccgcccccgccagcaccaagcaggccgacagaagacagagcatggccttcagcatcctgaacacccccaagaagctgggcaacagcctgctgagaagaggcgccagcaagaaggccctgagcaaggccagccccaacaccagaagcggcaccagaagaagccccagaatcgccaccaccaccgccagcgccgccaccgccgccgccatcggcgccacccccagagccaagggcaaggccaagcactag

SEQ ID NO: 91463 - DNA, 2076 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagaagcagctggccgacgagagaagcaacagagacgagctggagctggagctggccgagaacagaaagctgctgaccgagaaggacgcccagatcgccatgatgcagcagagaatcgacagactggccctgctgaacgagaagcaggccgccagccccctggagcccaaggagctggaggagctgagagacaagaacgagagcctgaccatgagactgcacgagaccctgaagcagtgccaggacctgaagaccgagaagagccagatggacagaaagatcaaccagctgagcgaggagaacggcgacctgagcttcaagctgagagagttcgccagccacctgcagcagctgcaggacgccctgaacgagctgaccgaggagcacagcaaggccacccaggagtggctggagaagcaggcccagctggagaaggagctgagcgccgccctgcaggacaagaagtgcctggaggagaagaacgagatcctgcagggcaagctgagccagctggaggagcacctgagccagctgcaggacaaccccccccaggagaagggcgaggtgctgggcgacgtgctgcagctggagaccctgaagcaggaggccgccaccctggccgccaacaacacccagctgcaggccagagtggagatgctggagaccgagagaggccagcaggaggccaagctgctggccgagagaggccacttcgaggaggagaagcagcagctgagcagcctgatcaccgacctgcagagcagcatcagcaacctgagccaggccaaggaggagctggagcaggccagccaggcccacggcgccagactgaccgcccaggtggccagcctgaccagcgagctgaccaccctgaacgccaccatccagcagcaggaccaggagctggccggcctgaagcagcaggccaaggagaagcaggcccagctggcccagaccctgcagcagcaggagcaggccagccagggcctgagacaccaggtggagcagctgagcagcagcctgaagcagaaggagcagcagctgaaggaggtggccgagaagcaggaggccaccagacaggaccacgcccagcagctggccaccgccgccgaggagagagaggccagcctgagagagagagacgccgccctgaagcagctggaggccctggagaaggagaaggccgccaagctggagatcctgcagcagcagctgcaggtggccaacgaggccagagacagcgcccagaccagcgtgacccaggcccagagagagaaggccgagctgagcagaaaggtggaggagctgcaggcctgcgtggagaccgccagacaggagcagcacgaggcccaggcccaggtggccgagctggagctgcagctgagaagcgagcagcagaaggccaccgagaaggagtag

SEQ ID NO: 91464 - DNA, 480 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctag

SEQ ID NO: 91465 - DNA, 219 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagatag

SEQ ID NO: 91466 - DNA, 252 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagctag

SEQ ID NO: 91467 - DNA, 2559 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagaagcagctggccgacgagagaagcaacagagacgagctggagctggagctggccgagaacagaaagctgctgaccgagaaggacgcccagatcgccatgatgcagcagagaatcgacagactggccctgctgaacgagaagcaggccgccagccccctggagcccaaggagctggaggagctgagagacaagaacgagagcctgaccatgagactgcacgagaccctgaagcagtgccaggacctgaagaccgagaagagccagatggacagaaagatcaaccagctgagcgaggagaacggcgacctgagcttcaagctgagagagttcgccagccacctgcagcagctgcaggacgccctgaacgagctgaccgaggagcacagcaaggccacccaggagtggctggagaagcaggcccagctggagaaggagctgagcgccgccctgcaggacaagaagtgcctggaggagaagaacgagatcctgcagggcaagctgagccagctggaggagcacctgagccagctgcaggacaaccccccccaggagaagggcgaggtgctgggcgacgtgctgcagctggagaccctgaagcaggaggccgccaccctggccgccaacaacacccagctgcaggccagagtggagatgctggagaccgagagaggccagcaggaggccaagctgctggccgagagaggccacttcgaggaggagaagcagcagctgagcagcctgatcaccgacctgcagagcagcatcagcaacctgagccaggccaaggaggagctggagcaggccagccaggcccacggcgccagactgaccgcccaggtggccagcctgaccagcgagctgaccaccctgaacgccaccatccagcagcaggaccaggagctggccggcctgaagcagcaggccaaggagaagcaggcccagctggcccagaccctgcagcagcaggagcaggccagccagggcctgagacaccaggtggagcagctgagcagcagcctgaagcagaaggagcagcagctgaaggaggtggccgagaagcaggaggccaccagacaggaccacgcccagcagctggccaccgccgccgaggagagagaggccagcctgagagagagagacgccgccctgaagcagctggaggccctggagaaggagaaggccgccaagctggagatcctgcagcagcagctgcaggtggccaacgaggccagagacagcgcccagaccagcgtgacccaggcccagagagagaaggccgagctgagcagaaaggtggaggagctgcaggcctgcgtggagaccgccagacaggagcagcacgaggcccaggcccaggtggccgagctggagctgcagctgagaagcgagcagcagaaggccaccgagaaggagagagtggcccaggagaaggaccagctgcaggagcagctgcaggccctgaaggagagcctgaaggtgaccaagggcagcctggaggaggagaagagaagagccgccgacgccctggaggagcagcagagatgcatcagcgagctgaaggccgagaccagaagcctggtggagcagcacaagagagagagaaaggagctggaggaggagagagccggcagaaagggcctggaggccagactgcagcagctgggcgaggcccaccaggccgagaccgaggtgctgagaagagagctggccgaggccatggccgcccagcacaccgccgagagcgagtgcgagcagctggtgaaggaggtggccgcctggagagagagatacgaggacagccagcaggaggaggcccagtacggcgccatgttccaggagcagctgatgaccctgaaggaggagtgcgagaaggccagacaggagctgcaggaggcctag

SEQ ID NO: 91468 - DNA, 525 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccagtag

SEQ ID NO: 91469 - DNA, 606 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagcccctag

SEQ ID NO: 91470 - DNA, 480 bp, Artificial Sequence; identical to SEQ ID NO: 91464
  Description of Artificial Sequence: Synthetic coding sequence

SEQ ID NO: 91471 - DNA, 663 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagcccgtgagcgagagactggacttcgtgtgcagcttcctgcagaagaacagaaagcaccccagcagccccgagtgcctggtgagcgcccagaaggtgctggagggcagcgagctggagctggccaagatgaccatgctgctgctgtaccacagcaccatgagcagcaagagccccagagactgggagcagttcgagtacaagatccaggccgagctggccgtgatcctgaagttcgtgctggaccacgaggacggcctgaacctgaacgaggacctggagaacttcctgcagaaggcccccgtgcccagcacctgcagcagcaccttccccgaggagctgagcccccccagccaccaggccaagagagagatcagattcctggagctgcagaaggtggccagcagcagcagcggcaacaacttcctgagcggcagccccgccagccccatgggcgacatcctgcagaccccccagttccagatgagaagactgaagtag

SEQ ID NO: 91472 - DNA, 171 bp, Artificial Sequence
  Description of Artificial Sequence: Synthetic coding sequence
atgaccctgcacgccaccagaggcgccgccctgctgagctgggtgaacagcctgcacgtggccgaccccgtggaggccgtgctgcagctgcaggactgcagcatcttcatcaagatcatcgacagaatccacggcaccgaggagggccagcagatcctgaagcagccctag

SEQ ID NO: 91473 - DNA, 1053 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaacagaagaagacaggagggcatcaagatcgtgctggaggacatcttcaccctgtggagacaggtggagaccaaggtgagagccaagatcagaaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatggagatgttccagagagcccaggccctgagaagaagagccgaggactactacagatgcaagatcacccccagcgccagaaagcccctgtgcaacagagtgagaatggccgccgtggagcacagacacagcagcggcctgccctactggccctacctgaccgccgagaccctgaagaacagaatgggccaccagccccccccccccacccagcagcacagcatcatcgacaacagcctgagcctgaagacccccagcgagtgcctgctgacccccctgccccccagcgccctgcccagcgccgacgacaacctgaagacccccgccgagtgcctgctgtaccccctgccccccagcgccgacgacaacctgaagaccccccccgagtgcctgctgacccccctgccccccagcgccccccccagcgtggacgacaacctgaagaccccccccgagtgcgtgtgcagcctgcccttccacccccagagaatgatcatcagcagaaactag

SEQ ID NO: 91474 - DNA, 1053 bp, Artificial Sequence; identical to SEQ ID NO: 91473
  Description of Artificial Sequence: Synthetic coding sequence

SEQ ID NO: 91475 - DNA, 1431 bp, Artificial Sequence
  Description of Artificial Sequence: Synthetic coding sequence
atggccagccccttcagcggcgccctgcagctgaccgacctggacgacttcatcggccccagccaggagtgcatcaagcccgtgaaggtggagaagagagccggcagcggcgtggccaagatcagaatcgaggacgacggcagctacttccagatcaaccaggacggcggcaccagaagactggagaaggccaaggtgagcctgaacgactgcctggcctgcagcggctgcatcaccagcgccgagaccgtgctgatcacccagcagagccacgaggagctgaagaaggtgctggacgccaacaagatggccgcccccagccagcagagactggtggtggtgagcgtgagcccccagagcagagccagcctggccgccagattccagctgaaccccaccgacaccgccagaaagctgaccagcttcttcaagaagatcggcgtgcacttcgtgttcgacaccgccttcagcagacacttcagcctgctggagagccagagagagttcgtgagaagattcagaggccaggccgactgcagacaggccctgcccctgctggccagcgcctgccccggctggatctgctacgccgagaagacccacggcagcttcatcctgccccacatcagcaccgccagaagcccccagcaggtgatgggcagcctggtgaaggacttcttcgcccagcagcagcacctgacccccgacaagatctaccacgtgaccgtgatgccctgctacgacaagaagctggaggccagcagacccgacttcttcaaccaggagcaccagaccagagacgtggactgcgtgctgaccaccggcgaggtgttcagactgctggaggaggagggcgtgagcctgcccgacctggagcccgcccccctggacagcctgtgcagcggcgccagcgccgaggagcccaccagccacagaggcggcggcagcggcggctacctggagcacgtgttcagacacgccgccagagagctgttcggcatccacgtggccgaggtgacctacaagcccctgagaaacaaggacttccaggaggtgaccctggagaaggagggccaggtgctgctgcacttcgccatggcctacggcttcagaaacatccagaacctggtgcagagactgaagagaggcagatgcccctaccactacgtggaggtgatggcctgccccagcggctgcctgaacggcggcggccagctgcaggcccccgacagacccagcagagagctgctgcagcacgtggagagactgtacggcatggtgagagccgaggcccccgaggacgcccccggcgtgcaggagctgtacacccactggctgcagggcaccgacagcgagtgcgccggcagactgctgcacacccagtaccacgccgtggagaaggccagcaccggcctgggcatcagatggtag

SEQ ID NO: 91476 - DNA, 567 bp, Artificial Sequence
  Description of Artificial Sequence: Synthetic coding sequence
atggccagccccttcagcggcgccctgcagctgaccgacctggacgacttcatcggccccagccaggagtgcatcaagcccgtgaaggtggagaagagagccggcagcggcgtggccaagatcagaatcgaggacgacggcagctacttccagatcaaccaggacggcggcaccagaagactggagaaggccaaggtgagcctgaacgactgcctggcctgcagcggctgcatcaccagcgccgagaccgtgctgatcacccagcagagccacgaggagctgaagaaggtgctggacgccaacaagggctgcaccagcagcagcaccccccccagccagggcaccagcgccagctggagagccagcgagagcctgtgcggcgacagcgaggacagacccaccgccgacagaagatgcccctgctggcccctgcccgcccaggccggcagcgccatgcccagaagactgaccgccgccagcagcagccccaccagcgccccccccggccccagaagcagaagctgggccccctggagcagaaccagcagccccagcagcagcacctag

SEQ ID NO: 91477 - DNA, 1125 bp, Artificial Sequence
  Description of Artificial Sequence: Synthetic coding sequence
atggccgcccccagccagcagagactggtggtggtgagcgtgagcccccagagcagagccagcctggccgccagattccagctgaaccccaccgacaccgccagaaagctgaccagcttcttcaagaagatcggcgtgcacttcgtgttcgacaccgccttcagcagacacttcagcctgctggagagccagagagagttcgtgagaagattcagaggccaggccgactgcagacaggccctgcccctgctggccagcgcctgccccggctggatctgctacgccgagaagacccacggcagcttcatcctgccccacatcagcaccgccagaagcccccagcaggtgatgggcagcctggtgaaggacttcttcgcccagcagcagcacctgacccccgacaagatctaccacgtgaccgtgatgccctgctacgacaagaagctggaggccagcagacccgacttcttcaaccaggagcaccagaccagagacgtggactgcgtgctgaccaccggcgaggtgttcagactgctggaggaggagggcgtgagcctgcccgacctggagcccgcccccctggacagcctgtgcagcggcgccagcgccgaggagcccaccagccacagaggcggcggcagcggcggctacctggagcacgtgttcagacacgccgccagagagctgttcggcatccacgtggccgaggtgacctacaagcccctgagaaacaaggacttccaggaggtgaccctggagaaggagggccaggtgctgctgcacttcgccatggcctacggcttcagaaacatccagaacctggtgcagagactgaagagaggcagatgcccctaccactacgtggaggtgatggcctgccccagcggctgcctgaacggcggcggccagctgcaggcccccgacagacccagcagagagctgctgcagcacgtggagagactgtacggcatggtgagagccgaggcccccgaggacgcccccggcgtgcaggagctgtacacccactggctgcagggcaccgacagcgagtgcgccggcagactgctgcacacccagtaccacgccgtggagaaggccagcaccggcctgggcatcagatggtag

SEQ ID NO: 91478 - DNA, 4284 bp, Artificial Sequence
  Description of Artificial Sequence: Synthetic coding sequence
atgctgctgcccagcgacgtggccagactggtgctgggctacctgcagcaggagaacctgatcagcacctgccagaccttcatcctggagagcagcgacctgaaggagtacgccgagcactgcaccgacgagggcttcatccccgcctgcctgctgagcctgttcggcaagaacctgaccaccatcctgaacgagtacgtggccatgaagaccaaggagaccagcaacaacgtgcccgccatcatgagcagcctgtggaagaagctggaccacaccctgagccagatcagaagcatgcagagcagccccagattcgccggcagccagagagccagaaccagaaccggcatcgccgagatcaagagacagagaaagctggccagccagaccgcccccgccagcgccgagctgctgaccctgccctacctgagcggccagttcaccaccccccccagcaccggcacccaggtgaccagacccagcggccagatcagcgaccccagcagaagctacttcgtggtggtgaaccacagccagagccaggacaccgtgaccaccggcgaggccctgaacgtgatccccggcgcccaggagaagaaggcccacgccagcctgatgagccccggcagaagaaagagcgagagccagagaaagagcaccaccctgagcggcccccacagcaccatcagaaacttccaggaccccaacgccttcgccgtggagaagcagatggtgatcgagaacgccagagagaagatcctgagcaacaagagcctgcaggagaagctggccgagaacatcaacaagttcctgaccagcgacaacaacatcgcccaggtgcccaagcagaccgacaacaaccccaccgagcccgagaccagcatcgacgagttcctgggcctgcccagcgagatccacatgagcgaggaggccatccaggacatcctggagcagaccgagagcgaccccgccttccaggccctgttcgacctgttcgactacggcaagaccaagaacaacaagaacatcagccagagcatcagcagccagcccatggagagcaaccccagcatcgtgctggccgacgagaccaacctggccgtgaagggcagcttcgagaccgaggagagcgacggccagagcggccagcccgccttctgcaccagctaccagaacgacgaccccctgaacgccctgaagaacagcaacaaccacgacgtgctgagacaggaggaccaggagaacttcagccagatcagcaccagcatccagaagaaggccttcaagaccgccgtgcccaccgagcagaagtgcgacatcgacatcaccttcgagagcgtgcccaacctgaacgacttcaaccagagaggcaacagcaacgccgagtgcaacccccactgcgccgagctgtacaccaaccagatgagcaccgagaccgagatggccatcggcatcgagaagaacagcctgagcagcaacgtgcccagcgagagccagctgcagcccgaccagcccgacatccccatcaccagcttcgtgagcctgggctgcgaggccaacaacgagaacctgatcctgagcggcaagagcagccagctgctgagccaggacaccagcctgaccggcaagcccagcaagaagagccagttctgcgagaacagcaacgacaccgtgaagctgaagatcaacttccacggcagcaagagcagcgacagcagcgaggtgcacaagagcaagatcgagatcaacgtgctggagcccgtgatgagccagctgagcaactgccaggacaacagctgcctgcagagcgagatcctgcccgtgagcgtggagagcagccacctgaacgtgagcggccaggtggagatccacctgggcgacagcctgagcagcaccaagcagcccagcaacgacagcgccagcgtggagctgaaccacaccgagaacgaggcccaggccagcaagagcgagaacagccaggagcccagcagcagcgtgaaggaggagaacaccatcttcctgagcctgggcggcaacgccaactgcgagaaggtggccctgaccccccccgagggcacccccgtggagaacagccacagcctgccccccgagagcgtgtgcagcagcgtgggcgacagccaccccgagagccagaacaccgacgacaagcccagcagcaacaacagcgccgagatcgacgccagcaacatcgtgagcctgaaggtgatcatcagcgacgaccccttcgtgagcagcgacaccgagctgaccagcgccgtgagcagcatcaacggcgagaacctgcccaccatcatcctgagcagccccaccaagagccccaccaagaacgccgagctggtgaagtgcctgagcagcgaggagaccgtgggcgccgtggtgtacgccgaggtgggcgacagcgccagcatggagcagagcctgctgaccttcaagagcgaggacagcgccgtgaacaacacccagaacgaggacggcatcgccttcagcgccaacgtgaccccctgcgtgagcaaggacggcggctacatccagctgatgcccgccaccagcaccgccttcggcaacagcaacaacatcctgatcgccacctgcgtgaccgaccccaccgccctgggcaccagcgtgagccagagcaacgtggtggtgctgcccggcaacagcgcccccatgaccgcccagcccctgcccccccagctgcagaccccccccagaagcaacagcgtgttcgccgtgaaccaggccgtgagccccaacttcagccagggcagcgccatcatcatcgccagccccgtgcagcccgtgctgcagggcatggtgggcatgatccccgtgagcgtggtgggccagaacggcaacaacttcagcaccccccccagacaggtgctgcacatgcccctgaccgcccccgtgtgcaacagaagcatcccccagttccccgtgccccccaagagccagaaggcccagggcctgagaaacaagccctgcatcggcaagcaggtgaacaacctggtggacagcagcggccacagcgtgggctgccacgcccagaagaccgaggtgagcgacaagagcatcgccaccgacctgggcaagaagagcgaggagaccaccgtgcccttccccgaggagagcatcgtgcccgccgccaagccctgccacagaagagtgctgtgcttcgacagcaccaccgcccccgtggccaacacccagggccccaaccacaagatggtgagccagaacaaggagagaaacgccgtgagcttccccaacctggacagccccaacgtgagcagcaccctgaagccccccagcaacaacgccatcaagagagagaaggagaagccccccctgcccaagatcctgagcaagagcgagagcgccatcagcagacacaccaccatcagagagacccagagcgagaagaaggtgagccccaccgagatcgtgctggagagcttccacaaggccaccgccaacaaggagaacgagctgtgcagcgacgtggagagacagaagaaccccgagaacagcaagctgagcatcggccagcagaacggcggcctgagaagcgagaagagcatcgccagcctgcaggagatgaccaagaagcagggcaccagcagcaacaacaagaacgtgctgagcgtgggcaccgccgtgaaggacctgaagcaggagcagaccaagagcgccagcagcctgatcaccaccgagatgctgcaggacatccagagacacagcagcgtgagcagactggccgacagcagcgacctgcccgtgcccagaacccccggcagcggcgccggcgagaagcacaaggaggagcccatcgacatcatcaaggcccccagcagcagaagattcagcgaggacagcagcaccagcaaggtgatggtgccccccgtgacccccgacctgcccgcctgcagccccgccagcgagaccggcagcgagaacagcgtgaacatggccgcccacaccctgatgatcctgagcagagccgccatcagcagaaccaccagcgccacccccctgaaggacaacacccagcagttcagagccagcagcagaagcaccaccaagaagagaaagatcgaggagctggacgagagagagagaaacagcagacccagcagcaagaacctgaccaacagcagcatccccatgaagaagaagaagatcaagaagaagaagctgcccagcagcttccccgccggcatggacgtggacaagttcctgctgagcctgcactacgacgagtag

SEQ ID NO: 91479 - DNA, 7284 bp, Artificial Sequence
  Description of Artificial Sequence: Synthetic coding sequence
atgcccctgaagaccagaaccgccctgagcgacgaccccgacagcagcaccagcaccctgggcaacatgctggagctgcccggcaccagcagcagcagcaccagccaggagctgcccttctgccagcccaagaagaagagcacccccctgaagtacgaggtgggcgacctgatctgggccaagttcaagagaagaccctggtggccctgcagaatctgcagcgaccccctgatcaacacccacagcaagatgaaggtgagcaacagaagaccctacagacagtactacgtggaggccttcggcgaccccagcgagagagcctgggtggccggcaaggccatcgtgatgttcgagggcagacaccagttcgaggagctgcccgtgctgagaagaagaggcaagcagaaggagaagggctacagacacaaggtgccccagaagatcctgagcaagtgggaggccagcgtgggcctggccgagcagtacgacgtgcccaagggcagcaagaacagaaagtgcatccccggcagcatcaagctggacagcgaggaggacatgcccttcgaggactgcaccaacgaccccgagagcgagcacgacctgctgctgaacggctgcctgaagagcctggccttcgacagcgagcacagcgccgacgagaaggagaagccctgcgccaagagcagagccagaaagagcagcgacaaccccaagagaaccagcgtgaagaagggccacatccagttcgaggcccacaaggacgagagaagaggcaagatccccgagaacctgggcctgaacttcatcagcggcgacatcagcgacacccaggccagcaacgagctgagcagaatcgccaacagcctgaccggcagcaacaccgcccccggcagcttcctgttcagcagctgcggcaagaacaccgccaagaaggagttcgagaccagcaacggcgacagcctgctgggcctgcccgagggcgccctgatcagcaagtgcagcagagagaagaacaagccccagagaagcctggtgtgcggcagcaaggtgaagctgtgctacatcggcgccggcgacgaggagaagagaagcgacagcatcagcatctgcaccaccagcgacgacggcagcagcgacctggaccccatcgagcacagcagcgagagcgacaacagcgtgctggagatccccgacgccttcgacagaaccgagaacatgctgagcatgcagaagaacgagaagatcaagtacagcagattcgccgccaccaacaccagagtgaaggccaagcagaagcccctgatcagcaacagccacaccgaccacctgatgggctgcaccaagagcgccgagcccggcaccgagaccagccaggtgaacctgagcgacctgaaggccagcaccctggtgcacaagccccagagcgacttcaccaacgacgccctgagccccaagttcaacctgagcagcagcatcagcagcgagaacagcctgatcaagggcggcgccgccaaccaggccctgctgcacagcaagagcaagcagcccaagttcagaagcatcaagtgcaagcacaaggagaaccccgtgatggccgagccccccgtgatcaacgaggagtgcagcctgaagtgctgcagcagcgacaccaagggcagccccctggccagcatcagcaagagcggcaaggtggacggcctgaagctgctgaacaacatgcacgagaagaccagagacagcagcgacatcgagaccgccgtggtgaagcacgtgctgagcgagctgaaggagctgagctacagaagcctgggcgaggacgtgagcgacagcggcaccagcaagcccagcaagcccctgctgttcagcagcgccagcagccagaaccacatccccatcgagcccgactacaagttcagcaccctgctgatgatgctgaaggacatgcacgacagcaagaccaaggagcagagactgatgaccgcccagaacctggtgagctacagaagccccggcagaggcgactgcagcaccaacagccccgtgggcgtgagcaaggtgctggtgagcggcggcagcacccacaacagcgagaagaagggcgacggcacccagaacagcgccaaccccagccccagcggcggcgacagcgccctgagcggcgagctgagcgccagcctgcccggcctgctgagcgacaagagagacctgcccgccagcggcaagagcagaagcgactgcgtgaccagaagaaactgcggcagaagcaagcccagcagcaagctgagagacgccttcagcgcccagatggtgaagaacaccgtgaacagaaaggccctgaagaccgagagaaagagaaagctgaaccagctgcccagcgtgaccctggacgccgtgctgcagggcgacagagagagaggcggcagcctgagaggcggcgccgaggaccccagcaaggaggaccccctgcagatcatgggccacctgaccagcgaggacggcgaccacttcagcgacgtgcacttcgacagcaaggtgaagcagagcgaccccggcaagatcagcgagaagggcctgagcttcgagaacggcaagggccccgagctggacagcgtgatgaacagcgagaacgacgagctgaacggcgtgaaccaggtggtgcccaagaagagatggcagagactgaaccagagaagaaccaagcccagaaagagaatgaacagattcaaggagaaggagaacagcgagtgcgccttcagagtgctgctgcccagcgaccccgtgcaggagggcagagacgagttccccgagcacagaacccccagcgccagcatcctggaggagcccctgaccgagcagaaccacgccgactgcctggacagcgccggccccagactgaacgtgtgcgacaagagcagcgccagcatcggcgacatggagaaggagcccggcatccccagcctgaccccccaggccgagctgcccgagcccgccgtgagaagcgagaagaagagactgagaaagcccagcaagtggctgctggagtacaccgaggagtacgaccagatcttcgcccccaagaagaagcagaagaaggtgcaggagcaggtgcacaaggtgagcagcagatgcgaggaggagagcctgctggccagaggcagaagcagcgcccagaacaagcaggtggacgagaacagcctgatcagcaccaaggaggagccccccgtgctggagagagaggcccccttcctggagggccccctggcccagagcgagctgggcggcggccacgccgagctgccccagctgaccctgagcgtgcccgtggcccccgaggtgagccccagacccgccctggagagcgaggagctgctggtgaagacccccggcaactacgagagcaagagacagagaaagcccaccaagaagctgctggagagcaacgacctggaccccggcttcatgcccaagaagggcgacctgggcctgagcaagaagtgctacgaggccggccacctggagaacggcatcaccgagagctgcgccaccagctacagcaaggacttcggcggcggcaccaccaagatcttcgacaagcccagaaagagaaagagacagagacacgccgccgccaagatgcagtgcaagaaggtgaagaacgacgacagcagcaaggagatccccggcagcgagggcgagctgatgccccacagaaccgccaccagccccaaggagaccgtggaggagggcgtggagcacgaccccggcatgcccgccagcaagaagatgcagggcgagagaggcggcggcgccgccctgaaggagaacgtgtgccagaactgcgagaagctgggcgagctgctgctgtgcgaggcccagtgctgcggcgccttccacctggagtgcctgggcctgaccgagatgcccagaggcaagttcatctgcaacgagtgcagaaccggcatccacacctgcttcgtgtgcaagcagagcggcgaggacgtgaagagatgcctgctgcccctgtgcggcaagttctaccacgaggagtgcgtgcagaagtacccccccaccgtgatgcagaacaagggcttcagatgcagcctgcacatctgcatcacctgccacgccgccaaccccgccaacgtgagcgccagcaagggcagactgatgagatgcgtgagatgccccgtggcctaccacgccaacgacttctgcctggccgccggcagcaagatcctggccagcaacagcatcatctgccccaaccacttcacccccagaagaggctgcagaaaccacgagcacgtgaacgtgagctggtgcttcgtgtgcagcgagggcggcagcctgctgtgctgcgacagctgccccgccgccttccacagagagtgcctgaacatcgacatccccgagggcaactggtactgcaacgactgcaaggccggcaagaagccccactacagagagatcgtgtgggtgaaggtgggcagatacagatggtggcccgccgagatctgccaccccagagccgtgcccagcaacatcgacaagatgagacacgacgtgggcgagttccccgtgctgttcttcggcagcaacgactacctgtggacccaccaggccagagtgttcccctacatggagggcgacgtgagcagcaaggacaagatgggcaagggcgtggacggcacctacaagaaggccctgcaggaggccgccgccagattcgaggagctgaaggcccagaaggagctgagacagctgcaggaggacagaaagaacgacaagaagccccccccctacaagcacatcaaggtgaacagacccatcggcagagtgcagatcttcaccgccgacctgagcgagatccccagatgcaactgcaaggccaccgacgagaacccctgcggcatcgacagcgagtgcatcaacagaatgctgctgtacgagtgccaccccaccgtgtgccccgccggcggcagatgccagaaccagtgcttcagcaagagacagtaccccgaggtggagatcttcagaaccctgcagagaggctggggcctgagaaccaagaccgacatcaagaagggcgagttcgtgaacgagtacgtgggcgagctgatcgacgaggaggagtgcagagccagaatcagatacgcccaggagcacgacatcaccaacttctacatgctgaccctggacaaggacagaatcatcgacgccggccccaagggcaactacgccagattcatgaaccactgctgccagcccaactgcgagacccagaagtggagcgtgaacggcgacaccagagtgggcctgttcgccctgagcgacatcaaggccggcaccgagctgaccttcaactacaacctggagtgcctgggcaacggcaagaccgtgtgcaagtgcggcgcccccaactgcagcggcttcctgggcgtgagacccaagaaccagcccatcgccaccgaggagaagagcaagaagttcaagaagaagcagcagggcaagagaagaacccagggcgagatcaccaaggagagagaggacgagtgcttcagctgcggcgacgccggccagctggtgagctgcaagaagcccggctgccccaaggtgtaccacgccgactgcctgaacctgaccaagagacccgccggcaagtgggagtgcccctggcaccagtgcgacatctgcggcaaggaggccgccagcttctgcgagatgtgccccagcagcttctgcaagcagcacagagagggcatgctgttcatcagcaagctggacggcagactgagctgcaccgagcacgacccctgcggccccaaccccctggagcccggcgagatcagagagtacgtgcccccccccgtgcccctgccccccggccccagcacccacctggccgagcagagcaccggcatggccgcccaggcccccaagatgagcgacaagccccccgccgacaccaaccagatgctgagcctgagcaagaaggccctggccggcacctgccagagacccctgctgcccgagagacccctggagagaaccgacagcagaccccagcccctggacaaggtgagagacctggccggcagcggcaccaagagccagagcctggtgagcagccagagacccctggacagaccccccgccgtggccggccccagaccccagctgagcgacaagcccagccccgtgaccagccccagcagcagccccagcgtgagaagccagcccctggagagacccctgggcaccgccgaccccagactggacaagagcatcggcgccgccagccccagaccccagagcctggagaagaccagcgtgcccaccggcctgagactgcccccccccgacagactgctgatcaccagcagccccaagccccagaccagcgacagacccaccgacaagccccacgccagcctgagccagagactgcccccccccgagaaggtgctgagcgccgtggtgcagaccctggtggccaaggagaaggccctgagacccgtggaccagaacacccagagcaagaacagagccgccctggtgatggacctgatcgacctgacccccagacagaaggagagagccgccagcccccaccaggtgaccccccaggccgacgagaagatgcccgtgctggagagcagcagctggcccgccagcaagggcctgggccacatgcccagagccgtggagaagggctgcgtgagcgaccccctgcagaccagcggcaaggccgccgcccccagcgaggacccctggcaggccgtgaagagcctgacccaggccagactgctgagccagccccccgccaaggccttcctgtacgagcccaccacccaggccagcggcagagccagcgccggcgccgagcagacccccggccccctgagccagagccccggcctggtgaagcaggccaagcagatggtgggcggccagcagctgcccgccctggccgccaagagcggccagagcttcagaagcctgggcaaggcccccgccagcctgcccaccgaggagaagaagctggtgaccaccgagcagagcccctgggccctgggcaaggccagcagcagagccggcctgtggcccatcgtggccggccagaccctggcccagagctgctggagcgccggcagcacccagaccctggcccagacctgctggagcctgggcagaggccaggaccccaagcccgagcagaacaccctgcccgccctgaaccaggcccccagcagccacaagtgcgccgagagcgagcagaagtag

SEQ ID NO: 91480 - DNA, 7284 bp, Artificial Sequence; identical to SEQ ID NO: 91479
  Description of Artificial Sequence: Synthetic coding sequence

SEQ ID NO: 91481 - DNA, 1692 bp, Artificial Sequence
  Description of Artificial Sequence: Synthetic coding sequence
atgcccctgaagaccagaaccgccctgagcgacgaccccgacagcagcaccagcaccctgggcaacatgctggagctgcccggcaccagcagcagcagcaccagccaggagctgcccttctgccagcccaagaagaagagcacccccctgaagtacgaggtgggcgacctgatctgggccaagttcaagagaagaccctggtggccctgcagaatctgcagcgaccccctgatcaacacccacagcaagatgaaggtgagcaacagaagaccctacagacagtactacgtggaggccttcggcgaccccagcgagagagcctgggtggccggcaaggccatcgtgatgttcgagggcagacaccagttcgaggagctgcccgtgctgagaagaagaggcaagcagaaggagaagggctacagacacaaggtgccccagaagatcctgagcaagtgggaggccagcgtgggcctggccgagcagtacgacgtgcccaagggcagcaagaacagaaagtgcatccccggcagcatcaagctggacagcgaggaggacatgcccttcgaggactgcaccaacgaccccgagagcgagcacgacctgctgctgaacggctgcctgaagagcctggccttcgacagcgagcacagcgccgacgagaaggagaagccctgcgccaagagcagagccagaaagagcagcgacaaccccaagagaaccagcgtgaagaagggccacatccagttcgaggcccacaaggacgagagaagaggcaagatccccgagaacctgggcctgaacttcatcagcggcgacatcagcgacacccaggccagcaacgagctgagcagaatcgccaacagcctgaccggcagcaacaccgcccccggcagcttcctgttcagcagctgcggcaagaacaccgccaagaaggagttcgagaccagcaacggcgacagcctgctgggcctgcccgagggcgccctgatcagcaagtgcagcagagagaagaacaagccccagagaagcctggtgtgcggcagcaaggtgaagctgtgctacatcggcgccggcgacgaggagaagagaagcgacagcatcagcatctgcaccaccagcgacgacggcagcagcgacctggaccccatcgagcacagcagcgagagcgacaacagcgtgctggagatccccgacgccttcgacagaaccgagaacatgctgagcatgcagaagaacgagaagatcaagtacagcagattcgccgccaccaacaccagagtgaaggccaagcagaagcccctgatcagcaacagccacaccgaccacctgatgggctgcaccaagagcgccgagcccggcaccgagaccagccaggtgaacctgagcgacctgaaggccagcaccctggtgcacaagccccagagcgacttcaccaacgacgccctgagccccaagttcaacctgagcagcagcatcagcagcgagaacagcctgatcaagggcggcgccgccaaccaggccctgctgcacagcaagagcaagcagcccaagttcagaagcatcaagtgcaagcacaaggagaaccccgtgatggccgagccccccgtgatcaacgaggagtgcagcctgaagtgctgcagcagcgacaccaagggcagccccctggccagcatcagcaagacccccccctag

SEQ ID NO: 91482 - DNA, 7782 bp, Artificial Sequence
  Description of Artificial Sequence: Synthetic coding sequence
atggaccagacctgcgagctgcccagaagaaactgcctgctgcccttcagcaaccccgtgaacctggacgcccccgaggacaaggacagccccttcggcaacggccagagcaacttcagcgagcccctgaacggctgcaccatgcagctgagcaccgtgagcggcaccagccagaacgcctacggccaggacagccccagctgctacatccccctgagaagactgcaggacctggccagcatgatcaacgtggagtacctgaacggcagcgccgacggcagcgagagcttccaggaccccgagaagagcgacagcagagcccagacccccatcgtgtgcaccagcctgagccccggcggccccaccgccctggccatgaagcaggagcccagctgcaacaacagccccgagctgcaggtgaaggtgaccaagaccatcaagaacggcttcctgcacttcgagaacttcacctgcgtggacgacgccgacgtggacagcgagatggaccccgagcagcccgtgaccgaggacgagagcatcgaggagatcttcgaggagacccagaccaacgccacctgcaactacgagaccaagagcgagaacggcgtgaaggtggccatgggcagcgagcaggacagcacccccgagagcagacacggcgccgtgaagagccccttcctgcccctggccccccagaccgagacccagaagaacaagcagagaaacgaggtggacggcagcaacgagaaggccgccctgctgcccgcccccttcagcctgggcgacaccaacatcaccatcgaggagcagctgaacagcatcaacctgagcttccaggacgaccccgacagcagcaccagcaccctgggcaacatgctggagctgcccggcaccagcagcagcagcaccagccaggagctgcccttcgtgccccagaagatcctgagcaagtgggaggccagcgtgggcctggccgagcagtacgacgtgcccaagggcagcaagaacagaaagtgcatccccggcagcatcaagctggacagcgaggaggacatgcccttcgaggactgcaccaacgaccccgagagcgagcacgacctgctgctgaacggctgcctgaagagcctggccttcgacagcgagcacagcgccgacgagaaggagaagccctgcgccaagagcagagccagaaagagcagcgacaaccccaagagaaccagcgtgaagaagggccacatccagttcgaggcccacaaggacgagagaagaggcaagatccccgagaacctgggcctgaacttcatcagcggcgacatcagcgacacccaggccagcaacgagctgagcagaatcgccaacagcctgaccggcagcaacaccgcccccggcagcttcctgttcagcagctgcggcaagaacaccgccaagaaggagttcgagaccagcaacggcgacagcctgctgggcctgcccgagggcgccctgatcagcaagtgcagcagagagaagaacaagccccagagaagcctggtgtgcggcagcaaggtgaagctgtgctacatcggcgccggcgacgaggagaagagaagcgacagcatcagcatctgcaccaccagcgacgacggcagcagcgacctggaccccatcgagcacagcagcgagagcgacaacagcgtgctggagatccccgacgccttcgacagaaccgagaacatgctgagcatgcagaagaacgagaagatcaagtacagcagattcgccgccaccaacaccagagtgaaggccaagcagaagcccctgatcagcaacagccacaccgaccacctgatgggctgcaccaagagcgccgagcccggcaccgagaccagccaggtgaacctgagcgacctgaaggccagcaccctggtgcacaagccccagagcgacttcaccaacgacgccctgagccccaagttcaacctgagcagcagcatcagcagcgagaacagcctgatcaagggcggcgccgccaaccaggccctgctgcacagcaagagcaagcagcccaagttcagaagcatcaagtgcaagcacaaggagaaccccgtgatggccgagccccccgtgatcaacgaggagtgcagcctgaagtgctgcagcagcgacaccaagggcagccccctggccagcatcagcaagagcggcaaggtggacggcctgaagctgctgaacaacatgcacgagaagaccagagacagcagcgacatcgagaccgccgtggtgaagcacgtgctgagcgagctgaaggagctgagctacagaagcctgggcgaggacgtgagcgacagcggcaccagcaagcccagcaagcccctgctgttcagcagcgccagcagccagaaccacatccccatcgagcccgactacaagttcagcaccctgctgatgatgctgaaggacatgcacgacagcaagaccaaggagcagagactgatgaccgcccagaacctggtgagctacagaagccccggcagaggcgactgcagcaccaacagccccgtgggcgtgagcaaggtgctggtgagcggcggcagcacccacaacagcgagaagaagggcgacggcacccagaacagcgccaaccccagccccagcggcggcgacagcgccctgagcggcgagctgagcgccagcctgcccggcctgctgagcgacaagagagacctgcccgccagcggcaagagcagaagcgactgcgtgaccagaagaaactgcggcagaagcaagcccagcagcaagctgagagacgccttcagcgcccagatggtgaagaacaccgtgaacagaaaggccctgaagaccgagagaaagagaaagctgaaccagctgcccagcgtgaccctggacgccgtgctgcagggcgacagagagagaggcggcagcctgagaggcggcgccgaggaccccagcaaggaggaccccctgcagatcatgggccacctgaccagcgaggacggcgaccacttcagcgacgtgcacttcgacagcaaggtgaagcagagcgaccccggcaagatcagcgagaagggcctgagcttcgagaacggcaagggccccgagctggacagcgtgatgaacagcgagaacgacgagctgaacggcgtgaaccaggtggtgcccaagaagagatggcagagactgaaccagagaagaaccaagcccagaaagagaatgaacagattcaaggagaaggagaacagcgagtgcgccttcagagtgctgctgcccagcgaccccgtgcaggagggcagagacgagttccccgagcacagaacccccagcgccagcatcctggaggagcccctgaccgagcagaaccacgccgactgcctggacagcgccggccccagactgaacgtgtgcgacaagagcagcgccagcatcggcgacatggagaaggagcccggcatccccagcctgaccccccaggccgagctgcccgagcccgccgtgagaagcgagaagaagagactgagaaagcccagcaagtggctgctggagtacaccgaggagtacgaccagatcttcgcccccaagaagaagcagaagaaggtgcaggagcaggtgcacaaggtgagcagcagatgcgaggaggagagcctgctggccagaggcagaagcagcgcccagaacaagcaggtggacgagaacagcctgatcagcaccaaggaggagccccccgtgctggagagagaggcccccttcctggagggccccctggcccagagcgagctgggcggcggccacgccgagctgccccagctgaccctgagcgtgcccgtggcccccgaggtgagccccagacccgccctggagagcgaggagctgctggtgaagacccccggcaactacgagagcaagagacagagaaagcccaccaagaagctgctggagagcaacgacctggaccccggcttcatgcccaagaagggcgacctgggcctgagcaagaagtgctacgaggccggccacctggagaacggcatcaccgagagctgcgccaccagctacagcaaggacttcggcggcggcaccaccaagatcttcgacaagcccagaaagagaaagagacagagacacgccgccgccaagatgcagtgcaagaaggtgaagaacgacgacagcagcaaggagatccccggcagcgagggcgagctgatgccccacagaaccgccaccagccccaaggagaccgtggaggagggcgtggagcacgaccccggcatgcccgccagcaagaagatgcagggcgagagaggcggcggcgccgccctgaaggagaacgtgtgccagaactgcgagaagctgggcgagctgctgctgtgcgaggcccagtgctgcggcgccttccacctggagtgcctgggcctgaccgagatgcccagaggcaagttcatctgcaacgagtgcagaaccggcatccacacctgcttcgtgtgcaagcagagcggcgaggacgtgaagagatgcctgctgcccctgtgcggcaagttctaccacgaggagtgcgtgcagaagtacccccccaccgtgatgcagaacaagggcttcagatgcagcctgcacatctgcatcacctgccacgccgccaaccccgccaacgtgagcgccagcaagggcagactgatgagatgcgtgagatgccccgtggcctaccacgccaacgacttctgcctggccgccggcagcaagatcctggccagcaacagcatcatctgccccaaccacttcacccccagaagaggctgcagaaaccacgagcacgtgaacgtgagctggtgcttcgtgtgcagcgagggcggcagcctgctgtgctgcgacagctgccccgccgccttccacagagagtgcctgaacatcgacatccccgagggcaactggtactgcaacgactgcaaggccggcaagaagccccactacagagagatcgtgtgggtgaaggtgggcagatacagatggtggcccgccgagatctgccaccccagagccgtgcccagcaacatcgacaagatgagacacgacgtgggcgagttccccgtgctgttcttcggcagcaacgactacctgtggacccaccaggccagagtgttcccctacatggagggcgacgtgagcagcaaggacaagatgggcaagggcgtggacggcacctacaagaaggccctgcaggaggccgccgccagattcgaggagctgaaggcccagaaggagctgagacagctgcaggaggacagaaagaacgacaagaagccccccccctacaagcacatcaaggtgaacagacccatcggcagagtgcagatcttcaccgccgacctgagcgagatccccagatgcaactgcaaggccaccgacgagaacccctgcggcatcgacagcgagtgcatcaacagaatgctgctgtacgagtgccaccccaccgtgtgccccgccggcggcagatgccagaaccagtgcttcagcaagagacagtaccccgaggtggagatcttcagaaccctgcagagaggctggggcctgagaaccaagaccgacatcaagaagggcgagttcgtgaacgagtacgtgggcgagctgatcgacgaggaggagtgcagagccagaatcagatacgcccaggagcacgacatcaccaacttctacatgctgaccctggacaaggacagaatcatcgacgccggccccaagggcaactacgccagattcatgaaccactgctgccagcccaactgcgagacccagaagtggagcgtgaacggcgacaccagagtgggcctgttcgccctgagcgacatcaaggccggcaccgagctgaccttcaactacaacctggagtgcctgggcaacggcaagaccgtgtgcaagtgcggcgcccccaactgcagcggcttcctgggcgtgagacccaagaaccagcccatcgccaccgaggagaagagcaagaagttcaagaagaagcagcagggcaagagaagaacccagggcgagatcaccaaggagagagaggacgagtgcttcagctgcggcgacgccggccagctggtgagctgcaagaagcccggctgccccaaggtgtaccacgccgactgcctgaacctgaccaagagacccgccggcaagtgggagtgcccctggcaccagtgcgacatctgcggcaaggaggccgccagcttctgcgagatgtgccccagcagcttctgcaagcagcacagagagggcatgctgttcatcagcaagctggacggcagactgagctgcaccgagcacgacccctgcggccccaaccccctggagcccggcgagatcagagagtacgtgcccccccccgtgcccctgccccccggccccagcacccacctggccgagcagagcaccggcatggccgcccaggcccccaagatgagcgacaagccccccgccgacaccaaccagatgctgagcctgagcaagaaggccctggccggcacctgccagagacccctgctgcccgagagacccctggagagaaccgacagcagaccccagcccctggacaaggtgagagacctggccggcagcggcaccaagagccagagcctggtgagcagccagagacccctggacagaccccccgccgtggccggccccagaccccagctgagcgacaagcccagccccgtgaccagccccagcagcagccccagcgtgagaagccagcccctggagagacccctgggcaccgccgaccccagactggacaagagcatcggcgccgccagccccagaccccagagcctggagaagaccagcgtgcccaccggcctgagactgcccccccccgacagactgctgatcaccagcagccccaagccccagaccagcgacagacccaccgacaagccccacgccagcctgagccagagactgcccccccccgagaaggtgctgagcgccgtggtgcagaccctggtggccaaggagaaggccctgagacccgtggaccagaacacccagagcaagaacagagccgccctggtgatggacctgatcgacctgacccccagacagaaggagagagccgccagcccccaccaggtgaccccccaggccgacgagaagatgcccgtgctggagagcagcagctggcccgccagcaagggcctgggccacatgcccagagccgtggagaagggctgcgtgagcgaccccctgcagaccagcggcaaggccgccgcccccagcgaggacccctggcaggccgtgaagagcctgacccaggccagactgctgagccagccccccgccaaggccttcctgtacgagcccaccacccaggccagcggcagagccagcgccggcgccgagcagacccccggccccctgagccagagccccggcctggtgaagcaggccaagcagatggtgggcggccagcagctgcccgccctggccgccaagagcggccagagcttcagaagcctgggcaaggcccccgccagcctgcccaccgaggagaagaagctggtgaccaccgagcagagcccctgggccctgggcaaggccagcagcagagccggcctgtggcccatcgtggccggccagaccctggcccagagctgctggagcgccggcagcacccagaccctggcccagacctgctggagcctgggcagaggccaggaccccaagcccgagcagaacaccctgcccgccctgaaccaggcccccagcagccacaagtgcgccgagagcgagcagaagtag

SEQ ID NO: 91483 - DNA, 8091 bp, Artificial Sequence
  Description of Artificial Sequence: Synthetic coding sequence
atggaccagacctgcgagctgcccagaagaaactgcctgctgcccttcagcaaccccgtgaacctggacgcccccgaggacaaggacagccccttcggcaacggccagagcaacttcagcgagcccctgaacggctgcaccatgcagctgagcaccgtgagcggcaccagccagaacgcctacggccaggacagccccagctgctacatccccctgagaagactgcaggacctggccagcatgatcaacgtggagtacctgaacggcagcgccgacggcagcgagagcttccaggaccccgagaagagcgacagcagagcccagacccccatcgtgtgcaccagcctgagccccggcggccccaccgccctggccatgaagcaggagcccagctgcaacaacagccccgagctgcaggtgaaggtgaccaagaccatcaagaacggcttcctgcacttcgagaacttcacctgcgtggacgacgccgacgtggacagcgagatggaccccgagcagcccgtgaccgaggacgagagcatcgaggagatcttcgaggagacccagaccaacgccacctgcaactacgagaccaagagcgagaacggcgtgaaggtggccatgggcagcgagcaggacagcacccccgagagcagacacggcgccgtgaagagccccttcctgcccctggccccccagaccgagacccagaagaacaagcagagaaacgaggtggacggcagcaacgagaaggccgccctgctgcccgcccccttcagcctgggcgacaccaacatcaccatcgaggagcagctgaacagcatcaacctgagcttccaggacgaccccgacagcagcaccagcaccctgggcaacatgctggagctgcccggcaccagcagcagcagcaccagccaggagctgcccttctgccagcccaagaagaagagcacccccctgaagtacgaggtgggcgacctgatctgggccaagttcaagagaagaccctggtggccctgcagaatctgcagcgaccccctgatcaacacccacagcaagatgaaggtgagcaacagaagaccctacagacagtactacgtggaggccttcggcgaccccagcgagagagcctgggtggccggcaaggccatcgtgatgttcgagggcagacaccagttcgaggagctgcccgtgctgagaagaagaggcaagcagaaggagaagggctacagacacaaggtgccccagaagatcctgagcaagtgggaggccagcgtgggcctggccgagcagtacgacgtgcccaagggcagcaagaacagaaagtgcatccccggcagcatcaagctggacagcgaggaggacatgcccttcgaggactgcaccaacgaccccgagagcgagcacgacctgctgctgaacggctgcctgaagagcctggccttcgacagcgagcacagcgccgacgagaaggagaagccctgcgccaagagcagagccagaaagagcagcgacaaccccaagagaaccagcgtgaagaagggccacatccagttcgaggcccacaaggacgagagaagaggcaagatccccgagaacctgggcctgaacttcatcagcggcgacatcagcgacacccaggccagcaacgagctgagcagaatcgccaacagcctgaccggcagcaacaccgcccccggcagcttcctgttcagcagctgcggcaagaacaccgccaagaaggagttcgagaccagcaacggcgacagcctgctgggcctgcccgagggcgccctgatcagcaagtgcagcagagagaagaacaagccccagagaagcctggtgtgcggcagcaaggtgaagctgtgctacatcggcgccggcgacgaggagaagagaagcgacagcatcagcatctgcaccaccagcgacgacggcagcagcgacctggaccccatcgagcacagcagcgagagcgacaacagcgtgctggagatccccgacgccttcgacagaaccgagaacatgctgagcatgcagaagaacgagaagatcaagtacagcagattcgccgccaccaacaccagagtgaaggccaagcagaagcccctgatcagcaacagccacaccgaccacctgatgggctgcaccaagagcgccgagcccggcaccgagaccagccaggtgaacctgagcgacctgaaggccagcaccctggtgcacaagccccagagcgacttcaccaacgacgccctgagccccaagttcaacctgagcagcagcatcagcagcgagaacagcctgatcaagggcggcgccgccaaccaggccctgctgcacagcaagagcaagcagcccaagttcagaagcatcaagtgcaagcacaaggagaaccccgtgatggccgagccccccgtgatcaacgaggagtgcagcctgaagtgctgcagcagcgacaccaagggcagccccctggccagcatcagcaagagcggcaaggtggacggcctgaagctgctgaacaacatgcacgagaagaccagagacagcagcgacatcgagaccgccgtggtgaagcacgtgctgagcgagctgaaggagctgagctacagaagcctgggcgaggacgtgagcgacagcggcaccagcaagcccagcaagcccctgctgttcagcagcgccagcagccagaaccacatccccatcgagcccgactacaagttcagcaccctgctgatgatgctgaaggacatgcacgacagcaagaccaaggagcagagactgatgaccgcccagaacctggtgagctacagaagccccggcagaggcgactgcagcaccaacagccccgtgggcgtgagcaaggtgctggtgagcggcggcagcacccacaacagcgagaagaagggcgacggcacccagaacagcgccaaccccagccccagcggcggcgacagcgccctgagcggcgagctgagcgccagcctgcccggcctgctgagcgacaagagagacctgcccgccagcggcaagagcagaagcgactgcgtgaccagaagaaactgcggcagaagcaagcccagcagcaagctgagagacgccttcagcgcccagatggtgaagaacaccgtgaacagaaaggccctgaagaccgagagaaagagaaagctgaaccagctgcccagcgtgaccctggacgccgtgctgcagggcgacagagagagaggcggcagcctgagaggcggcgccgaggaccccagcaaggaggaccccctgcagatcatgggccacctgaccagcgaggacggcgaccacttcagcgacgtgcacttcgacagcaaggtgaagcagagcgaccccggcaagatcagcgagaagggcctgagcttcgagaacggcaagggccccgagctggacagcgtgatgaacagcgagaacgacgagctgaacggcgtgaaccaggtggtgcccaagaagagatggcagagactgaaccagagaagaaccaagcccagaaagagaatgaacagattcaaggagaaggagaacagcgagtgcgccttcagagtgctgctgcccagcgaccccgtgcaggagggcagagacgagttccccgagcacagaacccccagcgccagcatcctggaggagcccctgaccgagcagaaccacgccgactgcctggacagcgccggccccagactgaacgtgtgcgacaagagcagcgccagcatcggcgacatggagaaggagcccggcatccccagcctgaccccccaggccgagctgcccgagcccgccgtgagaagcgagaagaagagactgagaaagcccagcaagtggctgctggagtacaccgaggagtacgaccagatcttcgcccccaagaagaagcagaagaaggtgcaggagcaggtgcacaaggtgagcagcagatgcgaggaggagagcctgctggccagaggcagaagcagcgcccagaacaagcaggtggacgagaacagcctgatcagcaccaaggaggagccccccgtgctggagagagaggcccccttcctggagggccccctggcccagagcgagctgggcggcggccacgccgagctgccccagctgaccctgagcgtgcccgtggcccccgaggtgagccccagacccgccctggagagcgaggagctgctggtgaagacccccggcaactacgagagcaagagacagagaaagcccaccaagaagctgctggagagcaacgacctggaccccggcttcatgcccaagaagggcgacctgggcctgagcaagaagtgctacgaggccggccacctggagaacggcatcaccgagagctgcgccaccagctacagcaaggacttcggcggcggcaccaccaagatcttcgacaagcccagaaagagaaagagacagagacacgccgccgccaagatgcagtgcaagaaggtgaagaacgacgacagcagcaaggagatccccggcagcgagggcgagctgatgccccacagaaccgccaccagccccaaggagaccgtggaggagggcgtggagcacgaccccggcatgcccgccagcaagaagatgcagggcgagagaggcggcggcgccgccctgaaggagaacgtgtgccagaactgcgagaagctgggcgagctgctgctgtgcgaggcccagtgctgcggcgccttccacctggagtgcctgggcctgaccgagatgcccagaggcaagttcatctgcaacgagtgcagaaccggcatccacacctgcttcgtgtgcaagcagagcggcgaggacgtgaagagatgcctgctgcccctgtgcggcaagttctaccacgaggagtgcgtgcagaagtacccccccaccgtgatgcagaacaagggcttcagatgcagcctgcacatctgcatcacctgccacgccgccaaccccgccaacgtgagcgccagcaagggcagactgatgagatgcgtgagatgccccgtggcctaccacgccaacgacttctgcctggccgccggcagcaagatcctggccagcaacagcatcatctgccccaaccacttcacccccagaagaggctgcagaaaccacgagcacgtgaacgtgagctggtgcttcgtgtgcagcgagggcggcagcctgctgtgctgcgacagctgccccgccgccttccacagagagtgcctgaacatcgacatccccgagggcaactggtactgcaacgactgcaaggccggcaagaagccccactacagagagatcgtgtgggtgaaggtgggcagatacagatggtggcccgccgagatctgccaccccagagccgtgcccagcaacatcgacaagatgagacacgacgtgggcgagttccccgtgctgttcttcggcagcaacgactacctgtggacccaccaggccagagtgttcccctacatggagggcgacgtgagcagcaaggacaagatgggcaagggcgtggacggcacctacaagaaggccctgcaggaggccgccgccagattcgaggagctgaaggcccagaaggagctgagacagctgcaggaggacagaaagaacgacaagaagccccccccctacaagcacatcaaggtgaacagacccatcggcagagtgcagatcttcaccgccgacctgagcgagatccccagatgcaactgcaaggccaccgacgagaacccctgcggcatcgacagcgagtgcatcaacagaatgctgctgtacgagtgccaccccaccgtgtgccccgccggcggcagatgccagaaccagtgcttcagcaagagacagtaccccgaggtggagatcttcagaaccctgcagagaggctggggcctgagaaccaagaccgacatcaagaagggcgagttcgtgaacgagtacgtgggcgagctgatcgacgaggaggagtgcagagccagaatcagatacgcccaggagcacgacatcaccaacttctacatgctgaccctggacaaggacagaatcatcgacgccggccccaagggcaactacgccagattcatgaaccactgctgccagcccaactgcgagacccagaagtggagcgtgaacggcgacaccagagtgggcctgttcgccctgagcgacatcaaggccggcaccgagctgaccttcaactacaacctggagtgcctgggcaacggcaagaccgtgtgcaagtgcggcgcccccaactgcagcggcttcctgggcgtgagacccaagaaccagcccatcgccaccgaggagaagagcaagaagttcaagaagaagcagcagggcaagagaagaacccagggcgagatcaccaaggagagagaggacgagtgcttcagctgcggcgacgccggccagctggtgagctgcaagaagcccggctgccccaaggtgtaccacgccgactgcctgaacctgaccaagagacccgccggcaagtgggagtgcccctggcaccagtgcgacatctgcggcaaggaggccgccagcttctgcgagatgtgccccagcagcttctgcaagcagcacagagagggcatgctgttcatcagcaagctggacggcagactgagctgcaccgagcacgacccctgcggccccaaccccctggagcccggcgagatcagagagtacgtgcccccccccgtgcccctgccccccggccccagcacccacctggccgagcagagcaccggcatggccgcccaggcccccaagatgagcgacaagccccccgccgacaccaaccagatgctgagcctgagcaagaaggccctggccggcacctgccagagacccctgctgcccgagagacccctggagagaaccgacagcagaccccagcccctggacaaggtgagagacctggccggcagcggcaccaagagccagagcctggtgagcagccagagacccctggacagaccccccgccgtggccggccccagaccccagctgagcgacaagcccagccccgtgaccagccccagcagcagccccagcgtgagaagccagcccctggagagacccctgggcaccgccgaccccagactggacaagagcatcggcgccgccagccccagaccccagagcctggagaagaccagcgtgcccaccggcctgagactgcccccccccgacagactgctgatcaccagcagccccaagccccagaccagcgacagacccaccgacaagccccacgccagcctgagccagagactgcccccccccgagaaggtgctgagcgccgtggtgcagaccctggtggccaaggagaaggccctgagacccgtggaccagaacacccagagcaagaacagagccgccctggtgatggacctgatcgacctgacccccagacagaaggagagagccgccagcccccaccaggtgaccccccaggccgacgagaagatgcccgtgctggagagcagcagctggcccgccagcaagggcctgggccacatgcccagagccgtggagaagggctgcgtgagcgaccccctgcagaccagcggcaaggccgccgcccccagcgaggacccctggcaggccgtgaagagcctgacccaggccagactgctgagccagccccccgccaaggccttcctgtacgagcccaccacccaggccagcggcagagccagcgccggcgccgagcagacccccggccccctgagccagagccccggcctggtgaagcaggccaagcagatggtgggcggccagcagctgcccgccctggccgccaagagcggccagagcttcagaagcctgggcaaggcccccgccagcctgcccaccgaggagaagaagctggtgaccaccgagcagagcccctgggccctgggcaaggccagcagcagagccggcctgtggcccatcgtggccggccagaccctggcccagagctgctggagcgccggcagcacccagaccctggcccagacctgctggagcctgggcagaggccaggaccccaagcccgagcagaacaccctgcccgccctgaaccaggcccccagcagccacaagtgcgccgagagcgagcagaagtag

SEQ ID NO: 91484 - DNA, 468 bp, Artificial Sequence
  Description of Artificial Sequence: Synthetic coding sequence
atgcccctgaagaccagaaccgccctgagcgacgaccccgacagcagcaccagcaccctgggcaacatgctggagctgcccggcaccagcagcagcagcaccagccaggagctgcccttctgccagcccaagaagaagagcacccccctgaagtacgaggtgggcgacctgatctgggccaagttcaagagaagaccctggtggccctgcagaatctgcagcgaccccctgatcaacacccacagcaagatgaaggtgagcaacagaagaccctacagacagtactacgtggaggccttcggcgaccccagcgagagagcctgggtggccggcaaggccatcgtgatgttcgagggcagacaccagttcgaggagctgcccgtgctgagaagaagaggcaagcagaaggagaagggctacagacacaaggtgccccagaagatcctgagcaagtgggaggccagctag

SEQ ID NO: 91485 - DNA, 375 bp, Artificial Sequence
  Description of Artificial Sequence: Synthetic coding sequence
atgcccctgaagaccagaaccgccctgagcgacgaccccgacagcagcaccagcaccctgggcaacatgctggagctgcccggcaccagcagcagcagcaccagccaggagctgcccttctgccagcccaagaagaagagcacccccctgaagtacgaggtgggcgacctgatctgggccaagttcaagagaagaccctggtggccctgcagaatctgcagcgaccccctgatcaacacccacagcaagatgaaggtgagcaacagaagaccctacagacagtactacgtggaggccttcggcgaccccagcgagagagcctgggtggccggcaaggccatcgtgatgttcgagggcagacaccagttcgagtag

SEQ ID NO: 91486 - DNA, 4200 bp, Artificial Sequence
  Description of Artificial Sequence: Synthetic coding sequence
atgagcggcctgggcgacagcagcagcgaccccgccaaccccgacagccacaagagaaagggcagcccctgcgacaccctggccagcagcaccgagaagagaagaagagagcaggagaacaagtacctggaggagctggccgagctgctgagcgccaacatcagcgacatcgacagcctgagcgtgaagcccgacaagtgcaagatcctgaagaagaccgtggaccagatccagctgatgaagagaatggagcaggagaagagcaccaccgacgacgacgtgcagaagagcgacatcagcagcagcagccagggcgtgatcgagaaggagagcctgggccccctgctgctggaggccctggacggcttcttcttcgtggtgaactgcgagggcagaatcgtgttcgtgagcgagaacgtgaccagctacctgggctacaaccaggaggagctgatgaacaccagcgtgtacagcatcctgcacgtgggcgaccacgccgagttcgtgaagaacctgctgcccaagagcctggtgaacggcgtgccctggccccaggaggccaccagaagaaacagccacaccttcaactgcagaatgctgatccacccccccgacgagcccggcaccgagaaccaggaggcctgccagagatacgaggtgatgcagtgcttcaccgtgagccagcccaagagcatccaggaggacggcgaggacttccagagctgcctgatctgcatcgccagaagactgcccagaccccccgccatcaccggcgtggagagcttcatgaccaagcaggacaccaccggcaagatcatcagcatcgacaccagcagcctgagagccgccggcagaaccggctgggaggacctggtgagaaagtgcatctacgccttcttccagccccagggcagagagcccagctacgccagacagctgttccaggaggtgatgaccagaggcaccgccagcagccccagctacagattcatcctgaacgacggcaccatgctgagcgcccacaccaagtgcaagctgtgctacccccagagccccgacatgcagcccttcatcatgggcatccacatcatcgacagagagcacagcggcctgagcccccaggacgacaccaacagcggcatgagcatccccagagtgaaccccagcgtgaaccccagcatcagccccgcccacggcgtggccagaagcagcaccctgccccccagcaacagcaacatggtgagcaccagaatcaacagacagcagagcagcgacctgcacagcagcagccacagcaacagcagcaacagccagggcagcttcggctgcagccccggcagccagatcgtggccaacgtggccctgaaccagggccaggccagcagccagagcagcaaccccagcctgaacctgaacaacagccccatggagggcaccggcatcagcctggcccagttcatgagccccagaagacaggtgaccagcggcctggccaccagacccagaatgcccaacaacagcttcccccccaacatcagcaccctgagcagccccgtgggcatgaccagcagcgcctgcaacaacaacaacagaagctacagcaacatccccgtgaccagcctgcagggcatgaacgagggccccaacaacagcgtgggcttcagcgccagcagccccgtgctgagacagatgagcagccagaacagccccagcagactgaacatccagcccgccaaggccgagagcaaggacaacaaggagatcgccagcatcctgaacgagatgatccagagcgacaacagcagcagcgacggcaagcccctggacagcggcctgctgcacaacaacgacagactgagcgacggcgacagcaagtacagccagaccagccacaagctggtgcagctgctgaccaccaccgccgagcagcagctgagacacgccgacatcgacaccagctgcaaggacgtgctgagctgcaccggcaccagcaacagcgccagcgccaacagcagcggcggcagctgccccagcagccacagcagcctgaccgagagacacaagatcctgcacagactgctgcaggagggcagccccagcgacatcaccaccctgagcgtggagcccgacaagaaggacagcgccagcaccagcgtgagcgtgaccggccaggtgcagggcaacagcagcatcaagctggagctggacgccagcaagaagaaggagagcaaggaccaccagctgctgagatacctgctggacaaggacgagaaggacctgagaagcacccccaacctgagcctggacgacgtgaaggtgaaggtggagaagaaggagcagatggacccctgcaacaccaaccccacccccatgaccaagcccacccccgaggagatcaagctggaggcccagagccagttcaccgccgacctggaccagttcgaccagctgctgcccaccctggagaaggccgcccagctgcccggcctgtgcgagaccgacagaatggacggcgccgtgaccagcgtgaccatcaagagcgagatcctgcccgccagcctgcagagcgccaccgccagacccaccagcagactgaacagactgcccgagctggagctggaggccatcgacaaccagttcggccagcccggcaccggcgaccagatcccctggaccaacaacaccgtgaccgccatcaaccagagcaagagcgaggaccagtgcatcagcagccagctggacgagctgctgtgcccccccaccaccgtggagggcagaaacgacgagaaggccctgctggagcagctggtgagcttcctgagcggcaaggacgagaccgagctggccgagctggacagagccctgggcatcgacaagctggtgcagggcggcggcctggacgtgctgagcgagagattccccccccagcaggccaccccccccctgatcatggaggagagacccaacctgtacagccagccctacagcagccccagccccaccgccaacctgcccagccccttccagggcatggtgagacagaagcccagcctgggcaccatgcccgtgcaggtgaccccccccagaggcgccttcagccccggcatgggcatgcagcccagacagaccctgaacagaccccccgccgcccccaaccagctgagactgcagctgcagcagagactgcagggccagcagcagctgatccaccagaacagacaggccatcctgaaccagttcgccgccaccgcccccgtgggcatcaacatgagaagcggcatgcagcagcagatcaccccccagccccccctgaacgcccagatgctggcccagagacagagagagctgtacagccagcagcacagacagagacagctgatccagcagcagagagccatgctgatgagacagcagagcttcggcaacaacctgccccccagcagcggcctgcccgtgcagatgggcaaccccagactgccccagggcgccccccagcagttcccctacccccccaactacggcaccaaccccggcaccccccccgccagcaccagccccttcagccagctggccgccaaccccgaggccagcctggccaacagaaacagcatggtgagcagaggcatgaccggcaacatcggcggccagttcggcaccggcatcaacccccagatgcagcagaacgtgttccagtaccccggcgccggcatggtgccccagggcgaggccaacttcgcccccagcctgagccccggcagcagcatggtgcccatgcccatcccccccccccagagcagcctgctgcagcagaccccccccgccagcggctaccagagccccgacatgaaggcctggcagcagggcgccatcggcaacaacaacgtgttcagccaggccgtgcagaaccagcccacccccgcccagcccggcgtgtacaacaacatgagcatcaccgtgagcatggccggcggcaacaccaacgtgcagaacatgaaccccatgatggcccagatgcagatgagcagcctgcagatgcccggcatgaacaccgtgtgccccgagcagatcaacgaccccgccctgagacacaccggcctgtactgcaaccagctgagcagcaccgacctgctgaagaccgaggccgacggcacccaggacaagaagaccgaggagttcttcagcgtggtgaccaccgactag

SEQ ID NO: 91487 - DNA, 4326 bp, Artificial Sequence
  Description of Artificial Sequence: Synthetic coding sequence
atgagcggcctgggcgacagcagcagcgaccccgccaaccccgacagccacaagagaaagggcagcccctgcgacaccctggccagcagcaccgagaagagaagaagagagcaggagaacaagtacctggaggagctggccgagctgctgagcgccaacatcagcgacatcgacagcctgagcgtgaagcccgacaagtgcaagatcctgaagaagaccgtggaccagatccagctgatgaagagaatggagcaggagaagagcaccaccgacgacgacgtgcagaagagcgacatcagcagcagcagccagggcgtgatcgagaaggagagcctgggccccctgctgctggaggccctggacggcttcttcttcgtggtgaactgcgagggcagaatcgtgttcgtgagcgagaacgtgaccagctacctgggctacaaccaggaggagctgatgaacaccagcgtgtacagcatcctgcacgtgggcgaccacgccgagttcgtgaagaacctgctgcccaagagcctggtgaacggcgtgccctggccccaggaggccaccagaagaaacagccacaccttcaactgcagaatgctgatccacccccccgacgagcccggcaccgagaaccaggaggcctgccagagatacgaggtgatgcagtgcttcaccgtgagccagcccaagagcatccaggaggacggcgaggacttccagagctgcctgatctgcatcgccagaagactgcccagaccccccgccatcaccggcgtggagagcttcatgaccaagcaggacaccaccggcaagatcatcagcatcgacaccagcagcctgagagccgccggcagaaccggctgggaggacctggtgagaaagtgcatctacgccttcttccagccccagggcagagagcccagctacgccagacagctgttccaggaggtgatgaccagaggcaccgccagcagccccagctacagattcatcctgaacgacggcaccatgctgagcgcccacaccaagtgcaagctgtgctacccccagagccccgacatgcagcccttcatcatgggcatccacatcatcgacagagagcacagcggcctgagcccccaggacgacaccaacagcggcatgagcatccccagagtgaaccccagcgtgaaccccagcatcagccccgcccacggcgtggccagaagcagcaccctgccccccagcaacagcaacatggtgagcaccagaatcaacagacagcagagcagcgacctgcacagcagcagccacagcaacagcagcaacagccagggcagcttcggctgcagccccggcagccagatcgtggccaacgtggccctgaaccagggccaggccagcagccagagcagcaaccccagcctgaacctgaacaacagccccatggagggcaccggcatcagcctggcccagttcatgagccccagaagacaggtgaccagcggcctggccaccagacccagaatgcccaacaacagcttcccccccaacatcagcaccctgagcagccccgtgggcatgaccagcagcgcctgcaacaacaacaacagaagctacagcaacatccccgtgaccagcctgcagggcatgaacgagggccccaacaacagcgtgggcttcagcgccagcagccccgtgctgagacagatgagcagccagaacagccccagcagactgaacatccagcccgccaaggccgagagcaaggacaacaaggagatcgccagcatcctgaacgagatgatccagagcgacaacagcagcagcgacggcaagcccctggacagcggcctgctgcacaacaacgacagactgagcgacggcgacagcaagtacagccagaccagccacaagctggtgcagctgctgaccaccaccgccgagcagcagctgagacacgccgacatcgacaccagctgcaaggacgtgctgagctgcaccggcaccagcaacagcgccagcgccaacagcagcggcggcagctgccccagcagccacagcagcctgaccgagagacacaagatcctgcacagactgctgcaggagggcagccccagcgacatcaccaccctgagcgtggagcccgacaagaaggacagcgccagcaccagcgtgagcgtgaccggccaggtgcagggcaacagcagcatcaagctggagctggacgccagcaagaagaaggagagcaaggaccaccagctgctgagatacctgctggacaaggacgagaaggacctgagaagcacccccaacctgagcctggacgacgtgaaggtgaaggtggagaagaaggagcagatggacccctgcaacaccaaccccacccccatgaccaagcccacccccgaggagatcaagctggaggcccagagccagttcaccgccgacctggaccagttcgaccagctgctgcccaccctggagaaggccgcccagctgcccggcctgtgcgagaccgacagaatggacggcgccgtgaccagcgtgaccatcaagagcgagatcctgcccgccagcctgcagagcgccaccgccagacccaccagcagactgaacagactgcccgagctggagctggaggccatcgacaaccagttcggccagcccggcaccggcgaccagatcccctggaccaacaacaccgtgaccgccatcaaccagagcaagagcgaggaccagtgcatcagcagccagctggacgagctgctgtgcccccccaccaccgtggagggcagaaacgacgagaaggccctgctggagcagctggtgagcttcctgagcggcaaggacgagaccgagctggccgagctggacagagccctgggcatcgacaagctggtgcagggcggcggcctggacgtgctgagcgagagattccccccccagcaggccaccccccccctgatcatggaggagagacccaacctgtacagccagccctacagcagccccagccccaccgccaacctgcccagccccttccagggcatggtgagacagaagcccagcctgggcaccatgcccgtgcaggtgaccccccccagaggcgccttcagccccggcatgggcatgcagcccagacagaccctgaacagaccccccgccgcccccaaccagctgagactgcagctgcagcagagactgcagggccagcagcagctgatccaccagaacagacaggccatcctgaaccagttcgccgccaccgcccccgtgggcatcaacatgagaagcggcatgcagcagcagatcaccccccagccccccctgaacgcccagatgctggcccagagacagagagagctgtacagccagcagcacagacagagacagctgatccagcagcagagagccatgctgatgagacagcagagcttcggcaacaacctgccccccagcagcggcctgcccgtgcagatgggcaaccccagactgccccagggcgccccccagcagttcccctacccccccaactacggcaccaaccccggcaccccccccgccagcaccagccccttcagccagctggccgccaaccccgaggccagcctggccaacagaaacagcatggtgagcagaggcatgaccggcaacatcggcggccagttcggcaccggcatcaacccccagatgcagcagaacgtgttccagtaccccggcgccggcatggtgccccagggcgaggccaacttcgcccccagcctgagccccggcagcagcatggtgcccatgcccatcccccccccccagagcagcctgctgcagcagaccccccccgccagcggctaccagagccccgacatgaaggcctggcagcagggcgccatcggcaacaacaacgtgttcagccaggccgtgcagaaccagcccacccccgcccagcccggcgtgtacaacaacatgagcatcaccgtgagcatggccggcggcaacaccaacgtgcagaacatgaaccccatgatggcccagatgcagatgagcagcctgcagatgcccggcatgaacaccgtgtgccccgagcagatcaacgaccccgccctgagacacaccggcctgtactgcaaccagctgagcagcaccgacctgctgaagaccgaggccgacggcacccagcaggtgcagcaggtgcaggtgttcgccgacgtgcagtgcaccgtgaacctggtgggcggcgacccctacctgaaccagcccggccccctgggcacccagaagcccaccagcggcccccagaccccccaggcccagcagaagagcctgctgcagcagctgctgaccgagtag

SEQ ID NO: 91488 - DNA, 4323 bp, Artificial Sequence
  Description of Artificial Sequence: Synthetic coding sequence
atgagcggcctgggcgacagcagcagcgaccccgccaaccccgacagccacaagagaaagggcagcccctgcgacaccctggccagcagcaccgagaagagaagaagagagcaggagaacaagtacctggaggagctggccgagctgctgagcgccaacatcagcgacatcgacagcctgagcgtgaagcccgacaagtgcaagatcctgaagaagaccgtggaccagatccagctgatgaagagaatggagcaggagaagagcaccaccgacgacgacgtgcagaagagcgacatcagcagcagcagccagggcgtgatcgagaaggagagcctgggccccctgctgctggaggccctggacggcttcttcttcgtggtgaactgcgagggcagaatcgtgttcgtgagcgagaacgtgaccagctacctgggctacaaccaggaggagctgatgaacaccagcgtgtacagcatcctgcacgtgggcgaccacgccgagttcgtgaagaacctgctgcccaagagcctggtgaacggcgtgccctggccccaggaggccaccagaagaaacagccacaccttcaactgcagaatgctgatccacccccccgacgagcccggcaccgagaaccaggaggcctgccagagatacgaggtgatgcagtgcttcaccgtgagccagcccaagagcatccaggaggacggcgaggacttccagagctgcctgatctgcatcgccagaagactgcccagaccccccgccatcaccggcgtggagagcttcatgaccaagcaggacaccaccggcaagatcatcagcatcgacaccagcagcctgagagccgccggcagaaccggctgggaggacctggtgagaaagtgcatctacgccttcttccagccccagggcagagagcccagctacgccagacagctgttccaggaggtgatgaccagaggcaccgccagcagccccagctacagattcatcctgaacgacggcaccatgctgagcgcccacaccaagtgcaagctgtgctacccccagagccccgacatgcagcccttcatcatgggcatccacatcatcgacagagagcacagcggcctgagcccccaggacgacaccaacagcggcatgagcatccccagagtgaaccccagcgtgaaccccagcatcagccccgcccacggcgtggccagaagcagcaccctgccccccagcaacagcaacatggtgagcaccagaatcaacagacagcagagcagcgacctgcacagcagcagccacagcaacagcagcaacagccagggcagcttcggctgcagccccggcagccagatcgtggccaacgtggccctgaaccagggccaggccagcagccagagcagcaaccccagcctgaacctgaacaacagccccatggagggcaccggcatcagcctggcccagttcatgagccccagaagacaggtgaccagcggcctggccaccagacccagaatgcccaacaacagcttcccccccaacatcagcaccctgagcagccccgtgggcatgaccagcagcgcctgcaacaacaacaacagaagctacagcaacatccccgtgaccagcctgcagggcatgaacgagggccccaacaacagcgtgggcttcagcgccagcagccccgtgctgagacagatgagcagccagaacagccccagcagactgaacatccagcccgccaaggccgagagcaaggacaacaaggagatcgccagcatcctgaacgagatgatccagagcgacaacagcagcagcgacggcaagcccctggacagcggcctgctgcacaacaacgacagactgagcgacggcgacagcaagtacagccagaccagccacaagctggtgcagctgctgaccaccaccgccgagcagcagctgagacacgccgacatcgacaccagctgcaaggacgtgctgagctgcaccggcaccagcaacagcgccagcgccaacagcagcggcggcagctgccccagcagccacagcagcctgaccgagagacacaagatcctgcacagactgctgcaggagggcagccccagcgacatcaccaccctgagcgtggagcccgacaagaaggacagcgccagcaccagcgtgagcgtgaccggccaggtgcagggcaacagcagcatcaagctggagctggacgccagcaagaagaaggagagcaaggaccaccagctgctgagatacctgctggacaaggacgagaaggacctgagaagcacccccaacctgagcctggacgacgtgaaggtgaaggtggagaagaaggagcagatggacccctgcaacaccaaccccacccccatgaccaagcccacccccgaggagatcaagctggaggcccagagccagttcaccgccgacctggaccagttcgaccagctgctgcccaccctggagaaggccgcccagctgcccggcctgtgcgagaccgacagaatggacggcgccgtgaccagcgtgaccatcaagagcgagatcctgcccgccagcctgcagagcgccaccgccagacccaccagcagactgaacagactgcccgagctggagctggaggccatcgacaaccagttcggccagcccggcaccggcgaccagatcccctggaccaacaacaccgtgaccgccatcaaccagagcaagagcgaggaccagtgcatcagcagccagctggacgagctgctgtgcccccccaccaccgtggagggcagaaacgacgagaaggccctgctggagcagctggtgagcttcctgagcggcaaggacgagaccgagctggccgagctggacagagccctgggcatcgacaagctggtgcagggcggcggcctggacgtgctgagcgagagattccccccccagcaggccaccccccccctgatcatggaggagagacccaacctgtacagccagccctacagcagccccagccccaccgccaacctgcccagccccttccagggcatggtgagacagaagcccagcctgggcaccatgcccgtgcaggtgaccccccccagaggcgccttcagccccggcatgggcatgcagcccagacagaccctgaacagaccccccgccgcccccaaccagctgagactgcagctgcagcagagactgcagggccagcagcagctgatccaccagaacagacaggccatcctgaaccagttcgccgccaccgcccccgtgggcatcaacatgagaagcggcatgcagcagcagatcaccccccagccccccctgaacgcccagatgctggcccagagacagagagagctgtacagccagcagcacagacagagacagctgatccagcagcagagagccatgctgatgagacagcagagcttcggcaacaacctgccccccagcagcggcctgcccgtgcagatgggcaaccccagactgccccagggcgccccccagcagttcccctacccccccaactacggcaccaaccccggcaccccccccgccagcaccagccccttcagccagctggccgccaaccccgaggccagcctggccaacagaaacagcatggtgagcagaggcatgaccggcaacatcggcggccagttcggcaccggcatcaacccccagatgcagcagaacgtgttccagtaccccggcgccggcatggtgccccagggcgaggccaacttcgcccccagcctgagccccggcagcagcatggtgcccatgcccatcccccccccccagagcagcctgctgcagcagaccccccccgccagcggctaccagagccccgacatgaaggcctggcagcagggcgccatcggcaacaacaacgtgttcagccaggccgtgcagaaccagcccacccccgcccagcccggcgtgtacaacaacatgagcatcaccgtgagcatggccggcggcaacaccaacgtgcagaacatgaaccccatgatggcccagatgcagatgagcagcctgcagatgcccggcatgaacaccgtgtgccccgagcagatcaacgaccccgccctgagacacaccggcctgtactgcaaccagctgagcagcaccgacctgctgaagaccgaggccgacggcacccaggtgcagcaggtgcaggtgttcgccgacgtgcagtgcaccgtgaacctggtgggcggcgacccctacctgaaccagcccggccccctgggcacccagaagcccaccagcggcccccagaccccccaggcccagcagaagagcctgctgcagcagctgctgaccgagtag

SEQ ID NO: 91489 - DNA, 4200 bp, Artificial Sequence; identical to SEQ ID NO: 91486
  Description of Artificial Sequence: Synthetic coding sequence

SEQ ID NO: 91490 - DNA, 4326 bp, Artificial Sequence; identical to SEQ ID NO: 91487
  Description of Artificial Sequence: Synthetic coding sequence

SEQ ID NO: 91491 - DNA, 4200 bp, Artificial Sequence; identical to SEQ ID NO: 91486
  Description of Artificial Sequence: Synthetic coding sequence

SEQ ID NO: 91492 - DNA, 1659 bp, Artificial Sequence
  Description of Artificial Sequence: Synthetic coding sequence
atgcagctgaccgccgagaacagccccgtgacccccgtgggcgcccagaagaccgccctgagaatcagccagagcagaatgatcggcaacagcgccagcagacccaccatgcccagcggcgagtgggccccccagagcagcgccgtgagagtgacctgcgccgccaccaccagcgccatgaacagacccgtgcagggcggcatgatcagaaaccccgccgccagcatccccatgagacccagcagccagcccggccagagacagaccctgcagagccaggtgatgaacatcggccccagcgagctggagatgaacatgggcggcccccagtacagccagcagcaggccccccccaaccagaccgccccctggcccgagagcatcctgcccatcgaccaggccagcttcgccagccagaacagacagcccttcggcagcagccccgacgacctgctgtgcccccaccccgccgccgagagccccagcgacgagggcgccctgctggaccagctgtacctggccctgagaaacttcgacggcctggaggagatcgacagagccctgggcatccccgagctggtgagccagagccaggccgtggaccccgagcagttcagcagccaggacagcaacatcatgctggagcagaaggcccccgtgttcccccagcagtacgccagccaggcccagatggcccagggcagctacagccccatgcaggaccccaacttccacaccatgggccagagacccagctacgccaccctgagaatgcagcccagacccggcctgagacccaccggcctggtgcagaaccagcccaaccagctgagactgcagctgcagcacagactgcaggcccagcagaacagacagcccctgatgaaccagatcagcaacgtgagcaacgtgaacctgaccctgagacccggcgtgcccacccaggcccccatcaacgcccagatgctggcccagagacagagagagatcctgaaccagcacctgagacagagacagatgcaccagcagcagcaggtgcagcagagaaccctgatgatgagaggccagggcctgaacatgacccccagcatggtggcccccagcggcatgcccgccaccatgagcaaccccagaatcccccaggccaacgcccagcagttccccttcccccccaactacggcatcagccagcagcccgaccccggcttcaccggcgccaccaccccccagagccccctgatgagccccagaatggcccacacccagagccccatgatgcagcagagccaggccaaccccgcctaccaggcccccagcgacatcaacggctgggcccagggcaacatgggcggcaacagcatgttcagccagcagagccccccccacttcggccagcaggccaacaccagcatgtacagcaacaacatgaacatcaacgtgagcatggccaccaacaccggcggcatgagcagcatgaaccagatgaccggccagatcagcatgaccagcgtgaccagcgtgcccaccagcggcctgagcagcatgggccccgagcaggtgaacgaccccgccctgagaggcggcaacctgttccccaaccagctgcccggcatggacatgatcaagcaggagggcgacaccaccagaaagtactgctag

SEQ ID NO: 91493 - DNA, 4395 bp, Artificial Sequence
  Description of Artificial Sequence: Synthetic coding sequence
atgagcggcatgggcgagaacaccagcgaccccagcagagccgagaccagaaagagaaaggagtgccccgaccagctgggccccagccccaagagaaacaccgagaagagaaacagagagcaggagaacaagtacatcgaggagctggccgagctgatcttcgccaacttcaacgacatcgacaacttcaacttcaagcccgacaagtgcgccatcctgaaggagaccgtgaagcagatcagacagatcaaggagcaggagaaggccgccgccgccaacatcgacgaggtgcagaagagcgacgtgagcagcaccggccagggcgtgatcgacaaggacgccctgggccccatgatgctggaggccctggacggcttcttcttcgtggtgaacctggagggcaacgtggtgttcgtgagcgagaacgtgacccagtacctgagatacaaccaggaggagctgatgaacaagagcgtgtacagcatcctgcacgtgggcgaccacaccgagttcgtgaagaacctgctgcccaagagcatcgtgaacggcggcagctggagcggcgagccccccagaagaaacagccacaccttcaactgcagaatgctggtgaagcccctgcccgacagcgaggaggagggccacgacaaccaggaggcccaccagaagtacgagaccatgcagtgcttcgccgtgagccagcccaagagcatcaaggaggagggcgaggacctgcagagctgcctgatctgcgtggccagaagagtgcccatgaaggagagacccgtgctgcccagcagcgagagcttcaccaccagacaggacctgcagggcaagatcaccagcctggacaccagcaccatgagagccgccatgaagcccggctgggaggacctggtgagaagatgcatccagaagttccacgcccagcacgagggcgagagcgtgagctacgccaagagacaccaccacgaggtgctgagacagggcctggccttcagccagatctacagattcagcctgagcgacggcaccctggtggccgcccagaccaagagcaagctgatcagaagccagaccaccaacgagccccagctggtgatcagcctgcacatgctgcacagagagcagaacgtgtgcgtgatgaaccccgacctgaccggccagaccatgggcaagcccctgaaccccatcagcagcaacagccccgcccaccaggccctgtgcagcggcaaccccggccaggacatgaccctgagcagcaacatcaacttccccatcaacggccccaaggagcagatgggcatgcccatgggcagattcggcggcagcggcggcatgaaccacgtgagcggcatgcaggccaccaccccccagggcagcaactacgccctgaagatgaacagccccagccagagcagccccggcatgaaccccggccagcccaccagcatgctgagccccagacacagaatgagccccggcgtggccggcagccccagaatcccccccagccagttcagccccgccggcagcctgcacagccccgtgggcgtgtgcagcagcaccggcaacagccacagctacaccaacagcagcctgaacgccctgcaggccctgagcgagggccacggcgtgagcctgggcagcagcctggccagccccgacctgaagatgggcaacctgcagaacagccccgtgaacatgaaccccccccccctgagcaagatgggcagcctggacagcaaggactgcttcggcctgtacggcgagcccagcgagggcaccaccggccaggccgagagcagctgccaccccggcgagcagaaggagaccaacgaccccaacctgccccccgccgtgagcagcgagagagccgacggccagagcagactgcacgacagcaagggccagaccaagctgctgcagctgctgaccaccaagagcgaccagatggagcccagccccctggccagcagcctgagcgacaccaacaaggacagcaccggcagcctgcccggcagcggcagcacccacggcaccagcctgaaggagaagcacaagatcctgcacagactgctgcaggacagcagcagccccgtggacctggccaagctgaccgccgaggccaccggcaaggacctgagccaggagagcagcagcaccgcccccggcagcgaggtgaccatcaagcaggagcccgtgagccccaagaagaaggagaacgccctgctgagatacctgctggacaaggacgacaccaaggacatcggcctgcccgagatcacccccaagctggagagactggacagcaagaccgaccccgccagcaacaccaagctgatcgccatgaagaccgagaaggaggagatgagcttcgagcccggcgaccagcccggcagcgagctggacaacctggaggagatcctggacgacctgcagaacagccagctgccccagctgttccccgacaccagacccggcgcccccgccggcagcgtggacaagcaggccatcatcaacgacctgatgcagctgaccgccgagaacagccccgtgacccccgtgggcgcccagaagaccgccctgagaatcagccagagcaccttcaacaaccccagacccggccagctgggcagactgctgcccaaccagaacctgcccctggacatcaccctgcagagccccaccggcgccggccccttcccccccatcagaaacagcagcccctacagcgtgatcccccagcccggcatgatgggcaaccagggcatgatcggcaaccagggcaacctgggcaacagcagcaccggcatgatcggcaacagcgccagcagacccaccatgcccagcggcgagtgggccccccagagcagcgccgtgagagtgacctgcgccgccaccaccagcgccatgaacagacccgtgcagggcggcatgatcagaaaccccgccgccagcatccccatgagacccagcagccagcccggccagagacagaccctgcagagccaggtgatgaacatcggccccagcgagctggagatgaacatgggcggcccccagtacagccagcagcaggccccccccaaccagaccgccccctggcccgagagcatcctgcccatcgaccaggccagcttcgccagccagaacagacagcccttcggcagcagccccgacgacctgctgtgcccccaccccgccgccgagagccccagcgacgagggcgccctgctggaccagctgtacctggccctgagaaacttcgacggcctggaggagatcgacagagccctgggcatccccgagctggtgagccagagccaggccgtggaccccgagcagttcagcagccaggacagcaacatcatgctggagcagaaggcccccgtgttcccccagcagtacgccagccaggcccagatggcccagggcagctacagccccatgcaggaccccaacttccacaccatgggccagagacccagctacgccaccctgagaatgcagcccagacccggcctgagacccaccggcctggtgcagaaccagcccaaccagctgagactgcagctgcagcacagactgcaggcccagcagaacagacagcccctgatgaaccagatcagcaacgtgagcaacgtgaacctgaccctgagacccggcgtgcccacccaggcccccatcaacgcccagatgctggcccagagacagagagagatcctgaaccagcacctgagacagagacagatgcaccagcagcagcaggtgcagcagagaaccctgatgatgagaggccagggcctgaacatgacccccagcatggtggcccccagcggcatgcccgccaccatgagcaaccccagaatcccccaggccaacgcccagcagttccccttcccccccaactacggcatcagccagcagcccgaccccggcttcaccggcgccaccaccccccagagccccctgatgagccccagaatggcccacacccagagccccatgatgcagcagagccaggccaaccccgcctaccaggcccccagcgacatcaacggctgggcccagggcaacatgggcggcaacagcatgttcagccagcagagccccccccacttcggccagcaggccaacaccagcatgtacagcaacaacatgaacatcaacgtgagcatggccaccaacaccggcggcatgagcagcatgaaccagatgaccggccagatcagcatgaccagcgtgaccagcgtgcccaccagcggcctgagcagcatgggccccgagcaggtgaacgaccccgccctgagaggcggcaacctgttccccaaccagctgcccggcatggacatgatcaagcaggagggcgacaccaccagaaagtactgctag

SEQ ID NO: 91494 - DNA, 51 bp, Artificial Sequence
  Description of Artificial Sequence: Synthetic coding sequence
atgagcggcatgggcgagaacaccagcgaccccagcagagccgagacctag

SEQ ID NO: 91495 - DNA, 27 bp, Artificial Sequence
  Description of Artificial Sequence: Synthetic coding sequence
atgagcggcatgggcgagaacacctag

SEQ ID NO: 91496 - DNA, 4263 bp, Artificial Sequence
  Description of Artificial Sequence: Synthetic coding sequence
atgagcggcctgggcgagaacctggaccccctggccagcgacagcagaaagagaaagctgccctgcgacacccccggccagggcctgacctgcagcggcgagaagagaagaagagagcaggagagcaagtacatcgaggagctggccgagctgatcagcgccaacctgagcgacatcgacaacttcaacgtgaagcccgacaagtgcgccatcctgaaggagaccgtgagacagatcagacagatcaaggagcagggcaagaccatcagcaacgacgacgacgtgcagaaggccgacgtgagcagcaccggccagggcgtgatcgacaaggacagcctgggccccctgctgctgcaggccctggacggcttcctgttcgtggtgaacagagacggcaacatcgtgttcgtgagcgagaacgtgacccagtacctgcagtacaagcaggaggacctggtgaacaccagcgtgtacaacatcctgcacgaggaggacagaaaggacttcctgaagaacctgcccaagagcaccgtgaacggcgtgagctggaccaacgagacccagagacagaagagccacaccttcaactgcagaatgctgatgaagaccccccacgacatcctggaggacatcaacgccagccccgagatgagacagagatacgagaccatgcagtgcttcgccctgagccagcccagagccatgatggaggagggcgaggacctgcagagctgcatgatctgcgtggccagaagaatcaccaccggcgagagaaccttccccagcaaccccgagagcttcatcaccagacacgacctgagcggcaaggtggtgaacatcgacaccaacagcctgagaagcagcatgagacccggcttcgaggacatcatcagaagatgcatccagagattcttcagcctgaacgacggccagagctggagccagaagagacactaccaggaggcctacctgaacggccacgccgagacccccgtgtacagattcagcctggccgacggcaccatcgtgaccgcccagaccaagagcaagctgttcagaaaccccgtgaccaacgacagacacggcttcgtgagcacccacttcctgcagagagagcagaacggctacagacccaaccccaaccccgtgggccagggcatcagaccccccatggccggctgcaacagcagcgtgggcggcatgagcatgagccccaaccagggcctgcagatgcccagcagcagagcctacggcctggccgaccccagcaccaccggccagatgagcggcgccagatacggcggcagcagcaacatcgccagcctgacccccggccccggcatgcagagccccagcagctaccagaacaacaactacggcctgaacatgagcagccccccccacggcagccccggcctggcccccaaccagcagaacatcatgatcagccccagaaacagaggcagccccaagatcgccagccaccagttcagccccgtggccggcgtgcacagccccatggccagcagcggcaacaccggcaaccacagcttcagcagcagcagcctgagcgccctgcaggccatcagcgagggcgtgggcaccagcctgctgagcaccctgagcagccccggccccaagctggacaacagccccaacatgaacatcacccagcccagcaaggtgagcaaccaggacagcaagagccccctgggcttctactgcgaccagaaccccgtggagagcagcatgtgccagagcaacagcagagaccacctgagcgacaaggagagcaaggagagcagcgtggagggcgccgagaaccagagaggccccctggagagcaagggccacaagaagctgctgcagctgctgacctgcagcagcgacgacagaggccacagcagcctgaccaacagccccctggacagcagctgcaaggagagcagcgtgagcgtgaccagccccagcggcgtgagcagcagcaccagcggcggcgtgagcagcaccagcaacatgcacggcagcctgctgcaggagaagcacagaatcctgcacaagctgctgcagaacggcaacagccccgccgaggtggccaagatcaccgccgaggccaccggcaaggacaccagcagcatcaccagctgcggcgacggcaacgtggtgaagcaggagcagctgagccccaagaagaaggagaacaacgccctgctgagatacctgctggacagagacgaccccagcgacgccctgagcaaggagctgcagccccaggtggagggcgtggacaacaagatgagccagtgcaccagcagcaccatccccagcagcagccaggagaaggaccccaagatcaagaccgagaccagcgaggagggcagcggcgacctggacaacctggacgccatcctgggcgacctgaccagcagcgacttctacaacaacagcatcagcagcaacggcagccacctgggcaccaagcagcaggtgttccagggcaccaacagcctgggcctgaagagcagccagagcgtgcagagcatcagacccccctacaacagagccgtgagcctggacagccccgtgagcgtgggcagcagcccccccgtgaagaacatcagcgccttccccatgctgcccaagcagcccatgctgggcggcaaccccagaatgatggacagccaggagaactacggcagcagcatgggcggccccaacagaaacgtgaccgtgacccagacccccagcagcggcgactggggcctgcccaacagcaaggccggcagaatggagcccatgaacagcaacagcatgggcagacccggcggcgactacaacaccagcctgcccagacccgccctgggcggcagcatccccaccctgcccctgagaagcaacagcatccccggcgccagacccgtgctgcagcagcagcagcagatgctgcagatgagacccggcgagatccccatgggcatgggcgccaacccctacggccaggccgccgccagcaaccagctgggcagctggcccgacggcatgctgagcatggagcaggtgagccacggcacccagaacagacccctgctgagaaacagcctggacgacctggtgggcccccccagcaacctggagggccagagcgacgagagagccctgctggaccagctgcacaccctgctgagcaacaccgacgccaccggcctggaggagatcgacagagccctgggcatccccgagctggtgaaccagggccaggccctggagcccaagcaggacgccttccagggccaggaggccgccgtgatgatggaccagaaggccggcctgtacggccagacctaccccgcccagggcccccccatgcagggcggcttccacctgcagggccagagccccagcttcaacagcatgatgaaccagatgaaccagcagggcaacttccccctgcagggcatgcaccccagagccaacatcatgagacccagaaccaacacccccaagcagctgagaatgcagctgcagcagagactgcagggccagcagttcctgaaccagagcagacaggccctggagctgaagatggagaaccccaccgccggcggcgccgccgtgatgagacccatgatgcagccccagcagggcttcctgaacgcccagatggtggcccagagaagcagagagctgctgagccaccacttcagacagcagagagtggccatgatgatgcagcagcagcagcagcagcagcagcagcagcagcagcagcagcagcagcagcagcagcagcagcagcagcagcagcagcagcagcagacccaggccttcagccccccccccaacgtgaccgccagccccagcatggacggcctgctggccggccccaccatgccccaggcccccccccagcagttcccctaccagcccaactacggcatgggccagcagcccgaccccgccttcggcagagtgagcagcccccccaacgccatgatgagcagcagaatgggccccagccagaaccccatgatgcagcacccccaggccgccagcatctaccagagcagcgagatgaagggctggcccagcggcaacctggccagaaacagcagcttcagccagcagcagttcgcccaccagggcaaccccgccgtgtacagcatggtgcacatgaacggcagcagcggccacatgggccagatgaacatgaaccccatgcccatgagcggcatgcccatgggccccgaccagaagtactgctag

SEQ ID NO: 91497 - DNA, 4053 bp, Artificial Sequence
  Description of Artificial Sequence: Synthetic coding sequence
atgagcggcctgggcgagaacctggaccccctggccagcgacagcagaaagagaaagctgccctgcgacacccccggccagggcctgacctgcagcggcgagaagagaagaagagagcaggagagcaagtacatcgaggagctggccgagctgatcagcgccaacctgagcgacatcgacaacttcaacgtgaagcccgacaagtgcgccatcctgaaggagaccgtgagacagatcagacagatcaaggagcagggcaagaccatcagcaacgacgacgacgtgcagaaggccgacgtgagcagcaccggccagggcgtgatcgacaaggacagcctgggccccctgctgctgcaggccctggacggcttcctgttcgtggtgaacagagacggcaacatcgtgttcgtgagcgagaacgtgacccagtacctgcagtacaagcaggaggacctggtgaacaccagcgtgtacaacatcctgcacgaggaggacagaaaggacttcctgaagaacctgcccaagagcaccgtgaacggcgtgagctggaccaacgagacccagagacagaagagccacaccttcaactgcagaatgctgatgaagaccccccacgacatcctggaggacatcaacgccagccccgagatgagacagagatacgagaccatgcagtgcttcgccctgagccagcccagagccatgatggaggagggcgaggacctgcagagctgcatgatctgcgtggccagaagaatcaccaccggcgagagaaccttccccagcaaccccgagagcttcatcaccagacacgacctgagcggcaaggtggtgaacatcgacaccaacagcctgagaagcagcatgagacccggcttcgaggacatcatcagaagatgcatccagagattcttcagcctgaacgacggccagagctggagccagaagagacactaccaggaggtgaccagcgacggcatcttcagccccaccgcctacctgaacggccacgccgagacccccgtgtacagattcagcctggccgacggcaccatcgtgaccgcccagaccaagagcaagctgttcagaaaccccgtgaccaacgacagacacggcttcgtgagcacccacttcctgcagagagagcagaacggctacagacccaaccccaaccccgtgggccagggcatcagaccccccatggccggctgcaacagcagcgtgggcggcatgagcatgagccccaaccagggcctgcagatgcccagcagcagagcctacggcctggccgaccccagcaccaccggccagatgagcggcgccagatacggcggcagcagcaacatcgccagcctgacccccggccccggcatgcagagccccagcagctaccagaacaacaactacggcctgaacatgagcagccccccccacggcagccccggcctggcccccaaccagcagaacatcatgatcagccccagaaacagaggcagccccaagatcgccagccaccagttcagccccgtggccggcgtgcacagccccatggccagcagcggcaacaccggcaaccacagcttcagcagcagcagcctgagcgccctgcaggccatcagcgagggcgtgggcaccagcctgctgagcaccctgagcagccccggccccaagctggacaacagccccaacatgaacatcacccagcccagcaaggtgagcaaccaggacagcaagagccccctgggcttctactgcgaccagaaccccgtggagagcagcatgtgccagagcaacagcagagaccacctgagcgacaaggagagcaaggagagcagcgtggagggcgccgagaaccagagaggccccctggagagcaagggccacaagaagctgctgcagctgctgacctgcagcagcgacgacagaggccacagcagcctgaccaacagccccctggacagcagctgcaaggagagcagcgtgagcgtgaccagccccagcggcgtgagcagcagcaccagcggcggcgtgagcagcaccagcaacatgcacggcagcctgctgcaggagaagcacagaatcctgcacaagctgctgcagaacggcaacagccccgccgaggtggccaagatcaccgccgaggccaccggcaaggacaccagcagcatcaccagctgcggcgacggcaacgtggtgaagcaggagcagctgagccccaagaagaaggagaacaacgccctgctgagatacctgctggacagagacgaccccagcgacgccctgagcaaggagctgcagccccaggtggagggcgtggacaacaagatgagccagtgcaccagcagcaccatccccagcagcagccaggagaaggaccccaagatcaagaccgagaccagcgaggagggcagcggcgacctggacaacctggacgccatcctgggcgacctgaccagcagcgacttctacaacaacagcatcagcagcaacggcagccacctgggcaccaagcagcaggtgttccagggcaccaacagcctgggcgactggggcctgcccaacagcaaggccggcagaatggagcccatgaacagcaacagcatgggcagacccggcggcgactacaacaccagcctgcccagacccgccctgggcggcagcatccccaccctgcccctgagaagcaacagcatccccggcgccagacccgtgctgcagcagcagcagcagatgctgcagatgagacccggcgagatccccatgggcatgggcgccaacccctacggccaggccgccgccagcaaccagctgggcagctggcccgacggcatgctgagcatggagcaggtgagccacggcacccagaacagacccctgctgagaaacagcctggacgacctggtgggcccccccagcaacctggagggccagagcgacgagagagccctgctggaccagctgcacaccctgctgagcaacaccgacgccaccggcctggaggagatcgacagagccctgggcatccccgagctggtgaaccagggccaggccctggagcccaagcaggacgccttccagggccaggaggccgccgtgatgatggaccagaaggccggcctgtacggccagacctaccccgcccagggcccccccatgcagggcggcttccacctgcagggccagagccccagcttcaacagcatgatgaaccagatgaaccagcagggcaacttccccctgcagggcatgcaccccagagccaacatcatgagacccagaaccaacacccccaagcagctgagaatgcagctgcagcagagactgcagggccagcagttcctgaaccagagcagacaggccctggagctgaagatggagaaccccaccgccggcggcgccgccgtgatgagacccatgatgcagccccagcagggcttcctgaacgcccagatggtggcccagagaagcagagagctgctgagccaccacttcagacagcagagagtggccatgatgatgcagcagcagcagcagcagcagcagcagcagcagcagcagcagcagcagcagcagcagcagcagcagcagcagcagcagcagcagcagacccaggccttcagccccccccccaacgtgaccgccagccccagcatggacggcctgctggccggccccaccatgccccaggcccccccccagcagttcccctaccagcccaactacggcatgggccagcagcccgaccccgccttcggcagagtgagcagcccccccaacgccatgatgagcagcagaatgggccccagccagaaccccatgatgcagcacccccaggccgccagcatctaccagagcagcgagatgaagggctggcccagcggcaacctggccagaaacagcagcttcagccagcagcagttcgcccaccagggcaaccccgccgtgtacagcatggtgcacatgaacggcagcagcggccacatgggccagatgaacatgaaccccatgcccatgagcggcatgcccatgggccccgaccagaagtactgctag

SEQ ID NO: 91498 - DNA, 4248 bp, Artificial Sequence
  Description of Artificial Sequence: Synthetic coding sequence
atgagcggcctgggcgagaacctggaccccctggccagcgacagcagaaagagaaagctgccctgcgacacccccggccagggcctgacctgcagcggcgagaagagaagaagagagcaggagagcaagtacatcgaggagctggccgagctgatcagcgccaacctgagcgacatcgacaacttcaacgtgaagcccgacaagtgcgccatcctgaaggagaccgtgagacagatcagacagatcaaggagcagggcaagaccatcagcaacgacgacgacgtgcagaaggccgacgtgagcagcaccggccagggcgtgatcgacaaggacagcctgggccccctgctgctgcaggccctggacggcttcctgttcgtggtgaacagagacggcaacatcgtgttcgtgagcgagaacgtgacccagtacctgcagtacaagcaggaggacctggtgaacaccagcgtgtacaacatcctgcacgaggaggacagaaaggacttcctgaagaacctgcccaagagcaccgtgaacggcgtgagctggaccaacgagacccagagacagaagagccacaccttcaactgcagaatgctgatgaagaccccccacgacatcctggaggacatcaacgccagccccgagatgagacagagatacgagaccatgcagtgcttcgccctgagccagcccagagccatgatggaggagggcgaggacctgcagagctgcatgatctgcgtggccagaagaatcaccaccggcgagagaaccttccccagcaaccccgagagcttcatcaccagacacgacctgagcggcaaggtggtgaacatcgacaccaacagcctgagaagcagcatgagacccggcttcgaggacatcatcagaagatgcatccagagattcttcagcctgaacgacggccagagctggagccagaagagacactaccaggaggtgaccagcgacggcatcttcagccccaccgcctacctgaacggccacgccgagacccccgtgtacagattcagcctggccgacggcaccatcgtgaccgcccagaccaagagcaagctgttcagaaaccccgtgaccaacgacagacacggcttcgtgagcacccacttcctgcagagagagcagaacggctacagacccaaccccaaccccgtgggccagggcatcagaccccccatggccggctgcaacagcagcgtgggcggcatgagcatgagccccaaccagggcctgcagatgcccagcagcagagcctacggcctggccgaccccagcaccaccggccagatgagcggcgccagatacggcggcagcagcaacatcgccagcctgacccccggccccggcatgcagagccccagcagctaccagaacaacaactacggcctgaacatgagcagccccccccacggcagccccggcctggcccccaaccagcagaacatcatgatcagccccagaaacagaggcagccccaagatcgccagccaccagttcagccccgtggccggcgtgcacagccccatggccagcagcggcaacaccggcaaccacagcttcagcagcagcagcctgagcgccctgcaggccatcagcgagggcgtgggcaccagcctgctgagcaccctgagcagccccggccccaagctggacaacagccccaacatgaacatcacccagcccagcaaggtgagcaaccaggacagcaagagccccctgggcttctactgcgaccagaaccccgtggagagcagcatgtgccagagcaacagcagagaccacctgagcgacaaggagagcaaggagagcagcgtggagggcgccgagaaccagagaggccccctggagagcaagggccacaagaagctgctgcagctgctgacctgcagcagcgacgacagaggccacagcagcctgaccaacagccccctggacagcagctgcaaggagagcagcgtgagcgtgaccagccccagcggcgtgagcagcagcaccagcggcggcgtgagcagcaccagcaacatgcacggcagcctgctgcaggagaagcacagaatcctgcacaagctgctgcagaacggcaacagccccgccgaggtggccaagatcaccgccgaggccaccggcaaggacaccagcagcatcaccagctgcggcgacggcaacgtggtgaagcaggagcagctgagccccaagaagaaggagaacaacgccctgctgagatacctgctggacagagacgaccccagcgacgccctgagcaaggagctgcagccccaggtggagggcgtggacaacaagatgagccagtgcaccagcagcaccatccccagcagcagccaggagaaggaccccaagatcaagaccgagaccagcgaggagggcagcggcgacctggacaacctggacgccatcctgggcgacctgaccagcagcgacttctacaacaacagcatcagcagcaacggcagccacctgggcaccaagcagcaggtgttccagggcaccaacagcctgggcctgaagagcagccagagcgtgcagagcatcagacccccctacaacagagccgtgagcctggacagccccgtgagcgtgggcagcagcccccccgtgaagaacatcagcgccttccccatgctgcccaagcagcccatgctgggcggcaaccccagaatgatggacagccaggagaactacggcagcagcatgggcgactggggcctgcccaacagcaaggccggcagaatggagcccatgaacagcaacagcatgggcagacccggcggcgactacaacaccagcctgcccagacccgccctgggcggcagcatccccaccctgcccctgagaagcaacagcatccccggcgccagacccgtgctgcagcagcagcagcagatgctgcagatgagacccggcgagatccccatgggcatgggcgccaacccctacggccaggccgccgccagcaaccagctgggcagctggcccgacggcatgctgagcatggagcaggtgagccacggcacccagaacagacccctgctgagaaacagcctggacgacctggtgggcccccccagcaacctggagggccagagcgacgagagagccctgctggaccagctgcacaccctgctgagcaacaccgacgccaccggcctggaggagatcgacagagccctgggcatccccgagctggtgaaccagggccaggccctggagcccaagcaggacgccttccagggccaggaggccgccgtgatgatggaccagaaggccggcctgtacggccagacctaccccgcccagggcccccccatgcagggcggcttccacctgcagggccagagccccagcttcaacagcatgatgaaccagatgaaccagcagggcaacttccccctgcagggcatgcaccccagagccaacatcatgagacccagaaccaacacccccaagcagctgagaatgcagctgcagcagagactgcagggccagcagttcctgaaccagagcagacaggccctggagctgaagatggagaaccccaccgccggcggcgccgccgtgatgagacccatgatgcagccccagcagggcttcctgaacgcccagatggtggcccagagaagcagagagctgctgagccaccacttcagacagcagagagtggccatgatgatgcagcagcagcagcagcagcagcagcagcagcagcagcagcagcagcagcagcagcagcagcagcagcagcagcagcagcagcagcagacccaggccttcagccccccccccaacgtgaccgccagccccagcatggacggcctgctggccggccccaccatgccccaggcccccccccagcagttcccctaccagcccaactacggcatgggccagcagcccgaccccgccttcggcagagtgagcagcccccccaacgccatgatgagcagcagaatgggccccagccagaaccccatgatgcagcacccccaggccgccagcatctaccagagcagcgagatgaagggctggcccagcggcaacctggccagaaacagcagcttcagccagcagcagttcgcccaccagggcaaccccgccgtgtacagcatggtgcacatgaacggcagcagcggccacatgggccagatgaacatgaaccccatgcccatgagcggcatgcccatgggccccgaccagaagtactgctag

SEQ ID NO: 91499 - DNA, 4275 bp, Artificial Sequence
  Description of Artificial Sequence: Synthetic coding sequence
atgagcggcctgggcgagaacctggaccccctggccagcgacagcagaaagagaaagctgccctgcgacacccccggccagggcctgacctgcagcggcgagaagagaagaagagagcaggagagcaagtacatcgaggagctggccgagctgatcagcgccaacctgagcgacatcgacaacttcaacgtgaagcccgacaagtgcgccatcctgaaggagaccgtgagacagatcagacagatcaaggagcagggcaagaccatcagcaacgacgacgacgtgcagaaggccgacgtgagcagcaccggccagggcgtgatcgacaaggacagcctgggccccctgctgctgcaggccctggacggcttcctgttcgtggtgaacagagacggcaacatcgtgttcgtgagcgagaacgtgacccagtacctgcagtacaagcaggaggacctggtgaacaccagcgtgtacaacatcctgcacgaggaggacagaaaggacttcctgaagaacctgcccaagagcaccgtgaacggcgtgagctggaccaacgagacccagagacagaagagccacaccttcaactgcagaatgctgatgaagaccccccacgacatcctggaggacatcaacgccagccccgagatgagacagagatacgagaccatgcagtgcttcgccctgagccagcccagagccatgatggaggagggcgaggacctgcagagctgcatgatctgcgtggccagaagaatcaccaccggcgagagaaccttccccagcaaccccgagagcttcatcaccagacacgacctgagcggcaaggtggtgaacatcgacaccaacagcctgagaagcagcatgagacccggcttcgaggacatcatcagaagatgcatccagagattcttcagcctgaacgacggccagagctggagccagaagagacactaccaggaggcctacctgaacggccacgccgagacccccgtgtacagattcagcctggccgacggcaccatcgtgaccgcccagaccaagagcaagctgttcagaaaccccgtgaccaacgacagacacggcttcgtgagcacccacttcctgcagagagagcagaacggctacagacccaaccccaaccccgtgggccagggcatcagaccccccatggccggctgcaacagcagcgtgggcggcatgagcatgagccccaaccagggcctgcagatgcccagcagcagagcctacggcctggccgaccccagcaccaccggccagatgagcggcgccagatacggcggcagcagcaacatcgccagcctgacccccggccccggcatgcagagccccagcagctaccagaacaacaactacggcctgaacatgagcagccccccccacggcagccccggcctggcccccaaccagcagaacatcatgatcagccccagaaacagaggcagccccaagatcgccagccaccagttcagccccgtggccggcgtgcacagccccatggccagcagcggcaacaccggcaaccacagcttcagcagcagcagcctgagcgccctgcaggccatcagcgagggcgtgggcaccagcctgctgagcaccctgagcagccccggccccaagctggacaacagccccaacatgaacatcacccagcccagcaaggtgagcaaccaggacagcaagagccccctgggcttctactgcgaccagaaccccgtggagagcagcatgtgccagagcaacagcagagaccacctgagcgacaaggagagcaaggagagcagcgtggagggcgccgagaaccagagaggccccctggagagcaagggccacaagaagctgctgcagctgctgacctgcagcagcgacgacagaggccacagcagcctgaccaacagccccctggacagcagctgcaaggagagcagcgtgagcgtgaccagccccagcggcgtgagcagcagcaccagcggcggcgtgagcagcaccagcaacatgcacggcagcctgctgcaggagaagcacagaatcctgcacaagctgctgcagaacggcaacagccccgccgaggtggccaagatcaccgccgaggccaccggcaaggacaccagcagcatcaccagctgcggcgacggcaacgtggtgaagcaggagcagctgagccccaagaagaaggagaacaacgccctgctgagatacctgctggacagagacgaccccagcgacgccctgagcaaggagctgcagccccaggtggagggcgtggacaacaagatgagccagtgcaccagcagcaccatccccagcagcagccaggagaaggaccccaagatcaagaccgagaccagcgaggagggcagcggcgacctggacaacctggacgccatcctgggcgacctgaccagcagcgacttctacaacaacagcatcagcagcaacggcagccacctgggcaccaagcagcaggtgttccagggcaccaacagcctgggcctgaagagcagccagagcgtgcagagcatcagacccccctacaacagagccgtgagcctggacagccccgtgagcgtgggcagcagcccccccgtgaagaacatcagcgccttccccatgctgcccaagcagcccatgctgggcggcaaccccagaatgatggacagccaggagaactacggcagcagcatgggcggccccaacagaaacgtgaccgtgacccagacccccagcagcggcgactggggcctgcccaacagcaaggccggcagaatggagcccatgaacagcaacagcatgggcagacccggcggcgactacaacaccagcctgcccagacccgccctgggcggcagcatccccaccctgcccctgagaagcaacagcatccccggcgccagacccgtgctgcagcagcagcagcagatgctgcagatgagacccggcgagatccccatgggcatgggcgccaacccctacggccaggccgccgccagcaaccagctgggcagctggcccgacggcatgctgagcatggagcaggtgagccacggcacccagaacagacccctgctgagaaacagcctggacgacctggtgggcccccccagcaacctggagggccagagcgacgagagagccctgctggaccagctgcacaccctgctgagcaacaccgacgccaccggcctggaggagatcgacagagccctgggcatccccgagctggtgaaccagggccaggccctggagcccaagcaggacgccttccagggccaggaggccgccgtgatgatggaccagaaggccggcctgtacggccagacctaccccgcccagggcccccccatgcagggcggcttccacctgcagggccagagccccagcttcaacagcatgatgaaccagatgaaccagcagggcaacttccccctgcagggcatgcaccccagagccaacatcatgagacccagaaccaacacccccaagcagctgagaatgcagctgcagcagagactgcagggccagcagttcctgaaccagagcagacaggccctggagctgaagatggagaaccccaccgccggcggcgccgccgtgatgagacccatgatgcagccccaggtgagcagccagcagggcttcctgaacgcccagatggtggcccagagaagcagagagctgctgagccaccacttcagacagcagagagtggccatgatgatgcagcagcagcagcagcagcagcagcagcagcagcagcagcagcagcagcagcagcagcagcagcagcagcagcagcagcagcagcagacccaggccttcagccccccccccaacgtgaccgccagccccagcatggacggcctgctggccggccccaccatgccccaggcccccccccagcagttcccctaccagcccaactacggcatgggccagcagcccgaccccgccttcggcagagtgagcagcccccccaacgccatgatgagcagcagaatgggccccagccagaaccccatgatgcagcacccccaggccgccagcatctaccagagcagcgagatgaagggctggcccagcggcaacctggccagaaacagcagcttcagccagcagcagttcgcccaccagggcaaccccgccgtgtacagcatggtgcacatgaacggcagcagcggccacatgggccagatgaacatgaaccccatgcccatgagcggcatgcccatgggccccgaccagaagtactgctag

SEQ ID NO: 91500 - DNA, 4263 bp, Artificial Sequence; identical to SEQ ID NO: 91496
  Description of Artificial Sequence: Synthetic coding sequence

SEQ ID NO: 91501 - DNA, 774 bp, Artificial Sequence
  Description of Artificial Sequence: Synthetic coding sequence
atgatggaggagggcgaggacctgcagagctgcatgatctgcgtggccagaagaatcaccaccggcgagagaaccttccccagcaaccccgagagcttcatcaccagacacgacctgagcggcaaggtggtgaacatcgacaccaacagcctgagaagcagcatgagacccggcttcgaggacatcatcagaagatgcatccagagattcttcagcctgaacgacggccagagctggagccagaagagacactaccaggaggcctacctgaacggccacgccgagacccccgtgtacagattcagcctggccgacggcaccatcgtgaccgcccagaccaagagcaagctgttcagaaaccccgtgaccaacgacagacacggcttcgtgagcacccacttcctgcagagagagcagaacggctacagacccaaccccaaccccgtgggccagggcatcagaccccccatggccggctgcaacagcagcgtgggcggcatgagcatgagccccaaccagggcctgcagatgcccagcagcagagcctacggcctggccgaccccagcaccaccggccagatgagcggcgccagatacggcggcagcagcaacatcgccagcctgacccccggccccggcatgcagagccccagcagctaccagaacaacaactacggcctgaacatgagcagccccccccacggcagccccggcctggcccccaaccagcagaacatcatgatcctgctggtgatcgtgggcgtgcagagatag

SEQ ID NO: 91502 - DNA, 864 bp, Artificial Sequence
  Description of Artificial Sequence: Synthetic coding sequence
atgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagcaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcaggtgtag

SEQ ID NO: 91503 - DNA, 1845 bp, Artificial Sequence
  Description of Artificial Sequence: Synthetic coding sequence
atgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcagatgtag

SEQ ID NO: 91504 - DNA, 1728 bp, Artificial Sequence
  Description of Artificial Sequence: Synthetic coding sequence
atgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagtactacctgatccacctgtacagaagaaacatcaccagcccccagaccatcatggccagcctgcagttcgtgatcagcctgcccgtgtgcagcctgaagctgatcaagagaagcggctacatcgagctgctgtacagatgcgagggcatggacaagagctag

SEQ ID NO: 91505 - DNA, 1845 bp, Artificial Sequence; identical to SEQ ID NO: 91503
  Description of Artificial Sequence: Synthetic coding sequence

SEQ ID NO: 91506 - DNA, 1347 bp, Artificial Sequence
  Description of Artificial Sequence: Synthetic coding sequence
atggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcagatgtag

SEQ ID NO: 91507 - DNA, 1545 bp, Artificial Sequence
  Description of Artificial Sequence: Synthetic coding sequence
atgaacagatggaccctgttcatcagcctgaagagaagacacttcaacagcagactgagcagcagcaccagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcagatgtag

SEQ ID NO: 91508 - DNA, 795 bp, Artificial Sequence
  Description of Artificial Sequence: Synthetic coding sequence
tgatgcacccccgcctgggccgccgagctggacagcgtgagcaagcagaagaagaaccccaagcccaccttcaagaagaagaccgaggagagaacctgcgaggtgaagaaggtgagcagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcacctag

SEQ ID NO: 91509 - DNA, 1893 bp, Artificial Sequence
  Description of Artificial Sequence: Synthetic coding sequence
atgggcgcccagctgaccaccttcgccctggccggcgccgtgagaagaatgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcagatgtag

SEQ ID NO: 91510 - DNA, 1845 bp, Artificial Sequence; identical to SEQ ID NO: 91503
  Description of Artificial Sequence: Synthetic coding sequence

SEQ ID NO: 91511 - DNA, 1953 bp, Artificial Sequence
  Description of Artificial Sequence: Synthetic coding sequence
atgggcgcccagctgaccaccttcgccctggccggcgccgtgagaagaatgaacaccttccaggaccagagcggcagcagcagcaacagagagcccctgctgagatgcagcgacgccagaagagacctggagctggccatcggcggcgtgctgagagccgagcagcagatcaaggacaacctgagagaggtgaaggcccagatccacagctgcatcagcagacacctggagtgcctgagaagcagagaggtgtggctgtacgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgagcgtgtgcctggagagactgggcagcctgaccctgaagcccgaggacagcaccgtgctgctgttcgaggccgacaccatcaccctgagacagaccatcaccaccttcggcagcctgaagaccatccagatccccgagcacctgatggcccacgccagcagcgccaacatcggccccttcctggagaagagaggctgcatcagcatgcccgagcagaagagcgccagcggcatcgtggccgtgcccttcagcgagtggctgctgggcagcaagcccgccagcggctaccaggccccctacatccccagcaccgacccccaggactggctgacccagaagcagaccctggagaacagccagaccagcagcagagcctgcaacttcttcaacaacgtgggcggcaacctgaagggcctggagaactggctgctgaagagcgagaagagcagctaccagaagtgcaacagccacagcaccaccagcagcttcagcatcgagatggagaaggtgggcgaccaggagctgcccgaccaggacgagatggacctgagcgactggctggtgaccccccaggagagccacaagctgagaaagcccgagaacggcagcagagagaccagcgagaagttcaagctgctgttccagagctacaacgtgaacgactggctggtgaagaccgacagctgcaccaactgccagggcaaccagcccaagggcgtggagatcgagaacctgggcaacctgaagtgcctgaacgaccacctggaggccaagaagcccctgagcacccccagcatggtgaccgaggactggctggtgcagaaccaccaggacccctgcaaggtggaggaggtgtgcagagccaacgagccctgcaccagcttcgccgagtgcgtgtgcgacgagaactgcgagaaggaggccctgtacaagtggctgctgaagaaggagggcaaggacaagaacggcatgcccgtggagcccaagcccgagcccgagaagcacaaggacagcctgaacatgtggctgtgccccagaaaggaggtgatcgagcagaccaaggcccccaaggccatgacccccagcagaatcgccgacagcttccaggtgatcaagaacagccccctgagcgagtggctgatcagacccccctacaaggagggcagccccaaggaggtgcccggcaccgaggacagagccggcaagcagaagttcaagagccccatgaacaccagctggtgcagcttcaacaccgccgactgggtgctgcccggcaagaagatgggcaacctgagccagctgagcagcggcgaggacaagtggctgctgagaaagaaggcccaggaggtgctgctgaacagccccctgcaggaggagcacaacttcccccccgaccactacggcctgcccgccgtgtgcgacctgttcgcctgcatgcagctgaaggtggacaaggagaagtggctgtacagaacccccctgcaggcctacttcaagatgaacttccaggacgtgaccgtgggcaacttccagatcccctgcggcttctag

SEQ ID NO: 91512 - DNA, 6192 bp, Artificial Sequence
  Description of Artificial Sequence: Synthetic coding sequence
atggtgctggacgacctgcccaacctggaggacatctacaccagcctgtgcagcagcaccatggaggacagcgagatggacttcgacagcggcctggaggacgacgacaccaagagcgacagcatcctggaggacagcaccatcttcgtggccttcaagggcaacatcgacgacaaggacttcaagtggaagctggacgccatcctgaagaacgtgcccaacctgctgcacatggagagcagcaagctgaaggtgcagaaggtggagccctggaacagcgtgagagtgaccttcaacatccccagagaggccgccgagagactgagaatcctggcccagagcaacaaccagcagctgagagacctgggcatcctgagcgtgcagatcgagggcgagggcgccatcaacctggccctggcccagaacagaagccaggacgtgagaatgaacggccccatgggcgccggcaacagcgtgagaatggaggccggcttccccatggccagcggccccggcatcatcagaatgaacaaccccgccaccgtgatgatcccccccggcggcaacgtgagcagcagcatgatggcccccggccccaaccccgagctgcagcccagaacccccagacccgccagccagagcgacgccatggaccccctgctgagcggcctgcacatccagcagcagagccaccccagcggcagcctggcccccccccaccaccccatgcagcccgtgagcgtgaacagacagatgaaccccgccaacttcccccagctgcagcagcagcagcagcagcagcagcagcagcagcagcagcagcagcagcagcagcagcagcagcagcagcagcagctgcaggccagacccccccagcagcaccagcagcagcagccccagggcatcagaccccagttcaccgcccccacccaggtgcccgtgccccccggctggaaccagctgcccagcggcgccctgcagcccccccccgcccagggcagcctgggcaccatgaccgccaaccagggctggaagaaggcccccctgcccggccccatgcagcagcagctgcaggccagacccagcctggccaccgtgcagacccccagccaccccccccccccctaccccttcggcagccagcaggccagccaggcccacaccaacttcccccagatgagcaaccccggccagttcaccgccccccagatgaagagcctgcagggcggccccagcagagtgcccacccccctgcagcagccccacctgaccaacaagagccccgccagcagccccagcagcttccagcagggcagccccgccagcagccccaccgtgaaccagacccagcagcagatgggccccagacccccccagaacaaccccctgccccagggcttccagcagcccgtgagcagccccggcagaaaccccatggtgcagcagggcaacgtgccccccaacttcatggtgatgcagcagcagccccccaaccagggcccccagagcctgcaccccggcctgggcggcatgcccaagagactgccccccggcttcagcgccggccaggccaaccccaacttcatgcagggccaggtgcccagcaccaccgccaccacccccggcaacagcggcgccccccagctgcaggccaaccagaacgtgcagcacgccggcggccagggcgccggccccccccagaaccagatgcaggtgagccacggcccccccaacatgatgcagcccagcctgatgggcatccacggcaacatgaacaaccagcaggccggcaccagcggcgtgccccaggtgaacctgagcaacatgcagggccagccccagcagggcccccccagccagctgatgggcatgcaccagcagatcgtgcccagccagggccagatggtgcagcagcagggcaccctgaacccccagaaccccatgatcctgagcagagcccagctgatgccccagggccagatgatggtgaacccccccagccagaacctgggccccagcccccagagaatgaccccccccaagcagatgctgagccagcagggcccccagatgatggccccccacaaccagatgatgggcccccagggccaggtgctgctgcagcagaaccccatgatcgagcagatcatgaccaaccagatgcagggcaacaagcagcagttcaacacccagaaccagagcaacgtgatgcccggccccgcccagatcatgagaggccccacccccaacatgcagggcaacatggtgcagttcaccggccagatgagcggccagatgctgccccagcagggccccgtgaacaacagccccagccaggtgatgggcatccagggccaggtgctgagaccccccggccccagcccccacatggcccagcagcacggcgaccccgccaccaccgccaacaacgacgtgagcctgagccagatgatgcccgacgtgagcatccagcagaccaacatggtgcccccccacgtgcaggccatgcagggcaacagcgccagcggcaaccacttcagcggccacggcatgagcttcaacgcccccttcagcggcgcccccaacggcaaccagatgagctgcggccagaaccccggcttccccgtgaacaaggacgtgaccctgaccagccccctgctggtgaacctgctgcagagcgacatcagcgccggccacttcggcgtgaacaacaagcagaacaacaccaacgccaacaagcccaagaagaagaagccccccagaaagaagaagaacagccagcaggacctgaacacccccgacaccagacccgccggcctggaggaggccgaccagccccccctgcccggcgagcagggcatcaacctggacaacagcggccccaagctgcccgagttcagcaacagaccccccggctaccccagccagcccgtggagcagagacccctgcagcagatgcccccccagctgatgcagcacgtggccccccccccccagcccccccagcagcagccccagccccagctgccccagcagcagcagccccccccccccagccagccccagagccagcagcagcagcagcagcagcagcagatgatgatgatgctgatgatgcagcaggaccccaagagcgtgagactgcccgtgagccagaacgtgcacccccccagaggccccctgaaccccgacagccagagaatgcccatgcagcagagcggcagcgtgcccgtgatggtgagcctgcagggccccgccagcgtgccccccagccccgacaagcagagaatgcccatgcccgtgaacacccccctgggcagcaacagcagaaagatggtgtaccaggagagcccccagaaccccagcagcagccccctggccgagatggccagcctgcccgaggccagcggcagcgaggcccccagcgtgcccggcggccccaacaacatgcccagccacgtggtgctgccccagaaccagctgatgatgaccggccccaagcccggccccagccccctgagcgccacccagggcgccaccccccagcagccccccgtgaacagcctgcccagcagccacggccaccacttccccaacgtggccgcccccacccagaccagcagacccaagacccccaacagagccagccccagaccctactacccccagacccccaacaacagaccccccagcaccgagcccagcgagatcagcctgagccccgagagactgaacgccagcatcgccggcctgttccccccccagatcaacatccccctgccccccagacccaacctgaacagaggcttcgaccagcagggcctgaaccccaccaccctgaaggccatcggccaggcccccagcaacctgaccatgaaccccagcaacttcgccaccccccagacccacaagctggacagcgtggtggtgaacagcggcaagcagagcaacagcggcgccaccaagagagccagccccagcaacagcagaagaagcagccccggcagcagcagaaagaccacccccagccccggcagacagaacagcaaggcccccaagctgaccctggccagccagaccaacgccgccctgctgcagaacgtggagctgcccagaaacgtgctggtgagccccacccccctggccaacccccccgtgcccggcagcttccccaacaacagcggcctgaacccccagaacagcaccgtgagcgtggccgccgtgggcggcgtggtggaggacaacaaggagagcctgaacgtgccccaggacagcgactgccagaacagccagagcagaaaggagcaggtgaacatcgagctgaaggccgtgcccgcccaggaggtgaagatggtggtgcccgaggaccagagcaagaaggacggccagcccagcgaccccaacaagctgcccagcgtggaggagaacaagaacctggtgagccccgccatgagagaggcccccaccagcctgagccagctgctggacaacagcggcgcccccaacgtgaccatcaagccccccggcctgaccgacctggaggtgaccccccccgtggtgagcggcgaggacctgaagaaggccagcgtgatccccaccctgcaggacctgagcagcagcaaggagcccagcaacagcctgaacctgccccacagcaacgagctgtgcagcagcctggtgcaccccgagctgagcgaggtgagcagcaacgtggcccccagcatcccccccgtgatgagcagacccgtgagcagcagcagcatcagcacccccctgccccccaaccagatcaccgtgttcgtgaccagcaaccccatcaccaccagcgccaacaccagcgccgccctgcccacccacctgcagagcgccctgatgagcaccgtggtgaccatgcccaacgccggcagcaaggtgatggtgagcgagggccagagcgccgcccagagcaacgccagaccccagttcatcacccccgtgttcatcaacagcagcagcatcatccaggtgatgaagggcagccagcccagcaccatccccgccgcccccctgaccaccaacagcggcctgatgccccccagcgtggccgtggtgggccccctgcacatcccccagaacatcaagttcagcagcgcccccgtgccccccaacgccctgagcagcagccccgcccccaacatccagaccggcagacccctggtgctgagcagcagagccacccccgtgcagctgcccagccccccctgcaccagcagccccgtggtgcccagccacccccccgtgcagcaggtgaaggagctgaaccccgacgaggccagcccccaggtgaacaccagcgccgaccagaacaccctgcccagcagccagagcaccaccatggtgagccccctgctgaccaacagccccggcagcagcggcaacagaagaagccccgtgagcagcagcaagggcaagggcaaggtggacaagatcggccagatcctgctgaccaaggcctgcaagaaggtgaccggcagcctggagaagggcgaggagcagtacggcgccgacggcgagaccgagggccagggcctggacaccaccgcccccggcctgatgggcaccgagcagctgagcaccgagctggacagcaagacccccaccccccccgcccccaccctgctgaagatgaccagcagccccgtgggccccggcaccgccagcgccggccccagcctgcccggcggcgccctgcccaccagcgtgagaagcatcgtgaccaccctggtgcccagcgagctgatcagcgccgtgcccaccaccaagagcaaccacggcggcatcgccagcgagagcctggccggcggcctggtggaggagaaggtgggcagccaccccgagctgctgcccagcatcgcccccagccagaacctggtgagcaaggagaccagcaccaccgccctgcaggccagcgtggccagacccgagctggaggtgaacgccgccatcgtgagcggccagagcagcgagcccaaggagatcgtggagaagagcaagatccccggcagaagaaacagcagaaccgaggagcccaccgtggccagcgagagcgtggagaacggccacagaaagagaagcagcagacccgccagcgccagcagcagcaccaaggacatcaccagcgccgtgcagagcaagagaagaaagagcaagtag

SEQ ID NO: 91513 - DNA, 6192 bp, Artificial Sequence; identical to SEQ ID NO: 91512
  Description of Artificial Sequence: Synthetic coding sequence

SEQ ID NO: 91514 - DNA, 1086 bp, Artificial Sequence
  Description of Artificial Sequence: Synthetic coding sequence
atggtgctggacgacctgcccaacctggaggacatctacaccagcctgtgcagcagcaccatggaggacagcgagatggacttcgacagcggcctggaggacgacgacaccaagagcgacagcatcctggaggacagcaccatcttcgtggccttcaagggcaacatcgacgacaaggacttcaagtggaagctggacgccatcctgaagaacgtgcccaacctgctgcacatggagagcagcaagctgaaggtgcagaaggtggagccctggaacagcgtgagagtgaccttcaacatccccagagaggccgccgagagactgagaatcctggcccagagcaacaaccagcagctgagagacctgggcatcctgagcgtgcagatcgagggcgagggcgccatcaacctggccctggcccagaacagaagccaggacgtgagaatgaacggccccatgggcgccggcaacagcgtgagaatggaggccggcttccccatggccagcggccccgacgccatggaccccctgctgagcggcctgcacatccagcagcagagccaccccagcggcagcctggcccccccccaccaccccatgcagcccgtgagcgtgaacagacagatgaaccccgccaacttcccccagctgcagcagcagcagcagcagcagcagcagcagcagcagcagcagcagcagcagcagcagcagcagcagcagcagcagctgcaggccagacccccccagcagcaccagcagcagcagccccagggcatcagaccccagttcaccgcccccacccaggtgcccgtgccccccggctggaaccagctgcccagcggcgccctgcagcccccccccgcccagggcagcctgggcaccatgaccgccaaccagggctggaagaaggcccccctgcccggccccatgcagcagcagctgcaggccagacccagcctggccaccgtgcagacccccagccaccccccccccccctaccccttcggcagccagcaggccagccaggcccacaccaacttcccccagatgagcaaccccggccagttcaccgccccccagatgtag

SEQ ID NO: 91515 - DNA, 549 bp, Artificial Sequence
  Description of Artificial Sequence: Synthetic coding sequence
atggccgaggagcaggtgaacagaagcgccggcctggcccccgactgcgaggccagcgccaccgccgagaccaccgtgagcagcgtgggcacctgcgaggccgccggcaagagccccgagcccaaggactacgacagcacctgcgtgttctgcagaatcgccggcagacaggaccccggcaccgagctgctgcactgcgagaacgaggacctgatctgcttcaaggacatcaagcccgccgccacccaccactacctggtggtgcccaagaagcacatcggcaactgcagaaccctgagaaaggaccaggtggagctggtggagaacatggtgaccgtgggcaagaccatcctggagagaaacaacttcaccgacttcaccaacgtgagaatgggcttccacatgccccccttctgcagcatcagccacctgcacctgcacgtgctggcccccgtggaccagctgggcttcctgagcaagctggtgtacagagtgaacagctactggttcatcaccgccgaccacctgatcgagaagctgagaacctag

SEQ ID NO: 91516 - DNA, 552 bp, Artificial Sequence
  Description of Artificial Sequence: Synthetic coding sequence
atgggcgccgcccacagcgtgtgggaggtggaccacctgtacaccttcttcgtgcagtggagccccgacgtgtacggcaaggacgccaaggagcagggcttcgtggtggtggagaaggaggagctgaacatgatcgacaacttcttcagcgagcccaccaccaagagctgggagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaagtag

SEQ ID NO: 91517 - DNA, 2829 bp, Artificial Sequence
  Description of Artificial Sequence: Synthetic coding sequence
atggacaccaaggaggagaagaaggagagaaagcagagctacttcgccagactgaagaagaagaagcaggccaagcagaacgccgagaccgccagcgccgtggccaccagaacccacaccggcaaggaggacaacaacaccgtggtgctggagcccgacaagtgcaacatcgccgtggaggaggagtacatgaccgacgagaagaagaagagaaagagcaaccagctgaaggagatcagaagaaccgagctgaagagatactacagcatcgacgacaaccagaacaagacccacgacaagaaggagaagaagatggtggtgcagaagccccacggcaccatggagtacaccgccggcaaccaggacaccctgaacagcatcgccctgaagttcaacatcacccccaacaagctggtggagctgaacaagctgttcacccacaccatcgtgcccggccaggtgctgttcgtgcccgacgccaacagccccagcagcaccctgagactgagcagcagcagccccggcgccaccgtgagccccagcagcagcgacgccgagtacgacaagctgcccgacgccgacctggccagaaaggccctgaagcccatcgagagagtgctgagcagcaccagcgaggaggacgagcccggcgtggtgaagttcctgaagatgaactgcagatacttcaccgacggcaagggcgtggtgggcggcgtgatgatcgtgacccccaacaacatcatgttcgacccccacaagagcgaccccctggtgatcgagaacggctgcgaggagtacggcctgatctgccccatggaggaggtggtgagcatcgccctgtacaacgacatcagccacatgaagatcaaggacgccctgcccagcgacctgccccaggacctgtgccccctgtacagacccggcgagtgggaggacctggccagcgagaaggacatcaaccccttcagcaagttcaagagcatcaacaaggagaagagacagcagaacggcgagaagatcatgaccagcgacagcagacccatcgtgcccctggagaagagcaccggccacacccccaccaagcccagcggcagcagcgtgagcgagaagctgaagaagctggacagcagcagagagaccagccacggcagccccaccgtgaccaagctgagcaaggagcccagcgacaccagcagcgccttcgagagcaccgccaaggagaacttcctgggcgaggacgacgacttcgtggacctggaggagctgagcagccagaccggcggcggcatgcacaagaaggacaccctgaaggagtgcctgagcctggaccccgaggagagaaagaaggccgagagccagatcaacaacagcgccgtggagatgcaggtgcagagcgccctggccttcctgggcaccgagaacgacgtggagctgaagggcgccctggacctggagacctgcgagaagcaggacatcatgcccgaggtggacaagcagagcggcagccccgagagcagagtggagaacaccctgaacatccacgaggacctggacaaggtgaagctgatcgagtactacctgaccaagaacaaggagggcccccaggtgagcgagaacctgcagaagaccgagctgagcgacggcaagagcatcgagcccggcggcatcgacatcaccctgagcagcagcctgagccaggccggcgaccccatcaccgagggcaacaaggagcccgacaagacctgggtgaagaagggcgagcccctgcccgtgaagctgaacagcagcaccgaggccaacgtgatcaaggaggccctggacagcagcctggagagcaccctggacaacagctgccagggcgcccagatggacaacaagagcgaggtgcagctgtggctgctgaagagaatccaggtgcccatcgaggacatcctgcccagcaaggaggagaagagcaagaccccccccatgttcctgtgcatcaaggtgggcaagcccatgagaaagagcttcgccacccacaccgccgccatggtgcagcagtacggcaagagaagaaagcagcccgagtactggttcgccgtgcccagagagagagtggaccacctgtacaccttcttcgtgcagtggagccccgacgtgtacggcaaggacgccaaggagcagggcttcgtggtggtggagaaggaggagctgaacatgatcgacaacttcttcagcgagcccaccaccaagagctgggagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaaggtgttcaagtggagcggcgagaacagctacttcatcaacggcgacatcagcagcctggagctgggcggcggcggcggcagattcggcctgtggctggacgccgacctgtaccacggcagaagcaacagctgcagcaccttcaacaacgacatcctgagcaagaaggaggacttcatcgtgcaggacctggaggtgtgggccttcgactag

SEQ ID NO: 91518 - DNA, 2829 bp, Artificial Sequence; identical to SEQ ID NO: 91517
  Description of Artificial Sequence: Synthetic coding sequence

SEQ ID NO: 91519 - DNA, 1323 bp, Artificial Sequence
  Description of Artificial Sequence: Synthetic coding sequence
gacgccgacctggccagaaaggccctgaagcccatcgagagagtgctgagcagcaccagcgaggaggacgagcccggcgtggtgaagttcctgaagatgaactgcagatacttcaccgacggcaagggcgtggtgggcggcgtgatgatcgtgacccccaacaacatcatgttcgacccccacaagagcgaccccctggtgatcgagaacggctgcgaggagtacggcctgatctgccccatggaggaggtggtgagcatcgccctgtacaacgacatcagccacatgaagatcaaggacgccctgcccagccccggcgagtgggaggacctggccagcgagaaggacatcaaccccttcagcaagttcaagagcatcaacaaggagaagagacagcagaacggcgagaagatcatgaccagcgacagcagacccatcgtgcccctggagaagagcaccggccacacccccaccaagcccagcggcagcagcgtgagcgagaagctgaagaagctggacagcagcagagagaccagccacggcagccccaccgtgaccaagctgagcaaggagcccagcgacaccagcagcgccttcgagagcaccgccaaggagaacttcctgggcgaggacgacgacttcgtggacctggaggagctgagcagccagaccggcggcggcatgcacaagaaggacaccctgaaggagtgcctgagcctggaccccgaggagagaaagaaggccgagagccagatcaacaacagcgccgtggagatgcaggtgcagagcgccctggccttcctgggcaccgagaacgacgtggagctgaagggcgccctggacctggagacctgcgagaagcaggacatcatgcccgaggtggacaagcagagcggcagccccgagagcagagtggagaacaccctgaacatccacgaggacctggacaaggtgaagctgatcgagtactacctgaccaagaacaaggagggcccccaggtgagcgagaacctgcagaagaccgagctgagcgacggcaagagcatcgagcccggcggcatcgacatcaccctgagcagcagcctgagccaggccggcgaccccatcaccgagggcaacaaggagcccgacaagacctgggtgaagaagggcgagcccctgcccgtgaagctgaacagcagcaccgaggccaacgtgatcaaggaggccctggacagcagcctggagagcaccctggacaacagctgccagggcgcccagatggacaacaagagcgaggtgcagctgtggctgctgaagagaatccaggtgcccatcgagtag

SEQ ID NO: 91520 - DNA, 576 bp, Artificial Sequence
  Description of Artificial Sequence: Synthetic coding sequence
atggacaccaaggaggagaagaaggagagaaagcagagctacttcgccagactgaagaagaagaagcaggccaagcagaacgccgagaccgccagcgccgtggccaccagaacccacaccggcaaggaggacaacaacaccgtggtgctggagcccgacaagtgcaacatcgccgtggaggaggagtacatgaccgacgagaagaagaagagaaagagcaaccagctgaaggagatcagaagaaccgagctgaagagatactacagcatcgacgacaaccagaacaagacccacgacaagaaggagaagaagatggtggtgcagaagccccacggcaccatggagtacaccgccggcaaccaggacaccctgaacagcatcgccctgaagttcaacatcacccccaacaagctggtggagctgaacaagctgttcacccacaccatcgtgcccggccaggtgctgttcgtgcccgacgccaacagccccagcagcaccctgagactgagcagcagcagccccggcgccaccgtgagccccagcagcagcgacgccgagtacgacaagctgccctag

SEQ ID NO: 91521 - DNA, 354 bp, Artificial Sequence
  Description of Artificial Sequence: Synthetic coding sequence
atggacaccaaggaggagaagaaggagagaaagcagagctacttcgccagactgaagaagaagaagcaggccaagcagaacgccgagaccgccagcgccgtggccaccagaacccacaccggcaaggaggacaacaacaccgtggtgctggagcccgacaagtgcaacatcgccgtggaggaggagtacatgaccgacgagaagaagaagagaaagagcaaccagctgaaggagatcagaagaaccgagctgaagagatactacagcatcgacgacaaccagaacaagacccacgacaagaaggagaagaagatggtggtgcagaagccccacggcaccatggagtacacctag

SEQ ID NO: 91522 - DNA, 273 bp, Artificial Sequence
  Description of Artificial Sequence: Synthetic coding sequence
atggacaccaaggaggagaagaaggagagaaagcagagctacttcgccagactgaagaagaagaagcaggccaagcagaacgccgagaccgccagcgccgtggccaccagaacccacaccggcaaggaggacaacaacaccgtggtgctggagcccgacaagtgcaacatcgccgtggaggaggagtacatgaccgacgagaagaagaagagaaagagcaaccagctgaaggagatcagaagaaccgagctgaagagatactacagcatctag

SEQ ID NO: 91523 - DNA, 273 bp, Artificial Sequence; identical to SEQ ID NO: 91522
  Description of Artificial Sequence: Synthetic coding sequence

SEQ ID NO: 91524 - DNA, 552 bp, Artificial Sequence; identical to SEQ ID NO: 91516
  Description of Artificial Sequence: Synthetic coding sequence

SEQ ID NO: 91525 - DNA, 714 bp, Artificial Sequence
  Description of Artificial Sequence: Synthetic coding sequence
tgagagaagacctgcagcagcctggagagagagccccacttcagcctgctgaccatgagaggccagagactgcccctggacatccagatcttctactgcgccagacccgacgaggagcccttcgtgaagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaaggtgttcaagtggagcggcgagaacagctacttcatcaacggcgacatcagcagcctggagctgggcggcggcggcggcagattcggcctgtggctggacgccgacctgtaccacggcagaagcaacagctgcagcaccttcaacaacgacatcctgagcaagaaggaggacttcatcgtgcaggacctggaggtgtgggccttcgactag

SEQ ID NO: 91526 - DNA, 534 bp, Artificial Sequence
  Description of Artificial Sequence: Synthetic coding sequence
tgagagaagacctgcagcagcctggagagagagccccacttcagcctgctgaccatgagaggccagagactgcccctggacatccagatcttctactgcgccagacccgacgaggagcccttcgtgaagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaagggcaccatctggttcatggccagatgctag

SEQ ID NO: 91527 - DNA, 573 bp, Artificial Sequence
  Description of Artificial Sequence: Synthetic coding sequence
tgagagaagacctgcagcagcctggagagagagccccacttcagcctgctgaccatgagaggccagagactgcccctggacatccagatcttctactgcgccagacccgacgaggagcccttcgtgaagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaagtggagcggcgagaacagctacttcatcaacggcgacatcagcagcctggagctgggcggcggcggctag

SEQ ID NO: 91528 - DNA, 273 bp, Artificial Sequence; identical to SEQ ID NO: 91522
  Description of Artificial Sequence: Synthetic coding sequence

SEQ ID NO: 91529 - DNA, 7566 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagcagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccctgcacgccagcggcaacgaggtgcccagaggcgagtgcagcggccccgccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatcgtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccgagaagcccgtgttcttccccgccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91530 - DNA, 7380 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagcagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccgagaagcccgtgttcttccccgccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91531 - DNA, 6228 bp, Artificial Sequence
  Description of Artificial Sequence: Synthetic coding sequence
atgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccgagaagcccgtgttcttccccgccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91532 - DNA, 7377 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccgagaagcccgtgttcttccccgccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91533 - DNA, 7545 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagcagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccctgcacgccagcggcaacgaggtgcccagaggcgagtgcagcggccccgccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91534 - DNA, 7515 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccaccgtgaacaacagcagcgacaccgagagcatccccagcccccacaccgaggccgccaaggacaccggccagaacggccccaagccccccgccaccctgggcgccgacggccccccccccggcccccccacccccccccccgaggacatccccgcccccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccgagaagcccgtgttcttccccgccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91535 - DNA, 7542 bp, Artificial Sequence
  Description of Artificial Sequence: Synthetic coding sequence
atgagcggcagcacccagcccgtggcccagacctggagagccaccgagcccagataccccccccacagcctgagctaccccgtgcagatcgccagaacccacaccgacgtgggcctgctggagtaccagcaccacagcagagactacgccagccacctgagccccggcagcatcatccagccccagagaagaagacccagcctgctgagcgagttccagcccggcaacgagagaagccaggagctgcacctgagacccgagagccacagctacctgcccgagctgggcaagagcgagatggagttcatcgagagcaagagacccagactggagctgctgcccgaccccctgctgagacccagccccctgctggccaccggccagcccgccggcagcgaggacctgaccaaggacagaagcctgaccggcaagctggagcccgtgagcccccccagccccccccacaccgaccccgagctggagctggtgccccccagactgagcaaggaggagctgatccagaacatggacagagtggacagagagatcaccatggtggagcagcagatcagcaagctgaagaagaagcagcagcagctggaggaggaggccgccaagccccccgagcccgagaagcccgtgagccccccccccatcgagagcaagcacagaagcctggtgcagatcatctacgacgagaacagaaagaaggccgaggccgcccacagaatcctggagggcctgggcccccaggtggagctgcccctgtacaaccagcccagcgacaccagacagtaccacgagaacatcaagatcaaccaggccatgagaaagaagctgatcctgtacttcaagagaagaaaccacgccagaaagcagtgggagcagaagttctgccagagatacgaccagctgatggaggcctgggagaagaaggtggagagaatcgagaacaaccccagaagaagagccaaggagagcaaggtgagagagtactacgagaagcagttccccgagatcagaaagcagagagagctgcaggagagaatgcagagcagagtgggccagagaggcagcggcctgagcatgagcgccgccagaagcgagcacgaggtgagcgagatcatcgacggcctgagcgagcaggagaacctggagaagcagatgagacagctggccgtgatcccccccatgctgtacgacgccgaccagcagagaatcaagttcatcaacatgaacggcctgatggccgaccccatgaaggtgtacaaggacagacaggtgatgaacatgtggagcgagcaggagaaggagaccttcagagagaagttcatgcagcaccccaagaacttcggcctgatcgccagcttcctggagagaaagaccgtggccgagtgcgtgctgtactactacctgaccaagaagaacgagaactacaagagcctggtgagaagaagctacagaagaagaggcaagagccagcagcagcagcagcagcagcagcagcagcagcagcagcagcagcagcagcccatgcccagaagcagccaggaggagaaggacgagaaggagaaggagaaggaggccgagaaggaggaggagaagcccgaggtggagaacgacaaggaggacctgctgaaggagaagaccgacgacaccagcggcgaggacaacgacgagaaggaggccgtggccagcaagggcagaaagaccgccaacagccagggcagaagaaagggcagaatcaccagaagcatggccaacgaggccaacagcgaggaggccatcaccccccagcagagcgccgagctggccagcatggagctgaacgagagcagcagatggaccgaggaggagatggagaccgccaagaagggcctgctggagcacggcagaaactggagcgccatcgccagaatggtgggcagcaagaccgtgagccagtgcaagaacttctacttcaactacaagaagagacagaacctggacgagatcctgcagcagcacaagctgaagatggagaaggagagaaacgccagaagaaagaagaagaaggcccccgccgccgccagcgaggaggccgccttcccccccgtggtggaggacgaggagatggaggccagcggcgtgagcggcaacgaggaggagatggtggaggaggccgaggccctgcacgccagcggcaacgaggtgcccagaggcgagtgcagcggccccgccaccgtgaacaacagcagcgacaccgagagcatccccagcccccacaccgaggccgccaaggacaccggccagaacggccccaagccccccgccaccctgggcgccgacggccccccccccggcccccccaccccccccagaagaaccagcagacccaccgagcccacccccgccagcgaggccaccggcgcccccacccccccccccgccccccccagccccagcgcccccccccccgtggtgcccaaggaggagaaggaggaggagaccgccgccgccccccccgtggaggagggcgaggagcagaagccccccgccgccgaggagctggccgtggacaccggcaaggccgaggagcccgtgaagagcgagtgcaccgaggaggccgaggagggccccgccaagggcaaggacgccgaggccgccgaggccaccgccgagggcgccctgaaggccgagaagaaggagggcggcagcggcagagccaccaccgccaagagcagcggcgccccccaggacagcgacagcagcgccacctgcagcgccgacgaggtggacgaggccgagggcggcgacaagaacagactgctgagccccagacccagcctgctgacccccaccggcgaccccagagccaacgccagcccccagaagcccctggacctgaagcagctgaagcagagagccgccgccatcccccccatccaggtgaccaaggtgcacgagccccccagagaggacgccgcccccaccaagcccgccccccccgcccccccccccccccagaacctgcagcccgagagcgacgccccccagcagcccggcagcagccccagaggcaagagcagaagccccgccccccccgccgacaaggaggccttcgccgccgaggcccagaagctgcccggcgaccccccctgctggaccagcggcctgcccttccccgtgccccccagagaggtgatcaaggccagcccccacgcccccgaccccagcgccttcagctacgccccccccggccaccccctgcccctgggcctgcacgacaccgccagacccgtgctgcccagaccccccaccatcagcaaccccccccccctgatcagcagcgccaagcaccccagcgtgctggagagacagatcggcgccatcagccagggcatgagcgtgcagctgcacgtgccctacagcgagcacgccaaggcccccgtgggccccgtgaccatgggcctgcccctgcccatggaccccaagaagctggcccccttcagcggcgtgaagcaggagcagctgagccccagaggccaggccggcccccccgagagcctgggcgtgcccaccgcccaggaggccagcgtgctgagaggcaccgccctgggcagcgtgcccggcggcagcatcaccaagggcatccccagcaccagagtgcccagcgacagcgccatcacctacagaggcagcatcacccacggcacccccgccgacgtgctgtacaagggcaccatcaccagaatcatcggcgaggacagccccagcagactggacagaggcagagaggacagcctgcccaagggccacgtgatctacgagggcaagaagggccacgtgctgagctacgagggcggcatgagcgtgacccagtgcagcaaggaggacggcagaagcagcagcggccccccccacgagaccgccgcccccaagagaacctacgacatgatggagggcagagtgggcagagccatcagcagcgccagcatcgagggcctgatgggcagagccatcccccccgagagacacagcccccaccacctgaaggagcagcaccacatcagaggcagcatcacccagggcatccccagaagctacgtggaggcccaggaggactacctgagaagagaggccaagctgctgaagagagagggcaccccccccccccccccccccagcagagacctgaccgaggcctacaagacccaggccctgggccccctgaagctgaagcccgcccacgagggcctggtggccaccgtgaaggaggccggcagaagcatccacgagatccccagagaggagctgagacacacccccgagctgcccctggcccccagacccctgaaggagggcagcatcacccagggcacccccctgaagtacgacaccggcgccagcaccaccggcagcaagaagcacgacgtgagaagcctgatcggcagccccggcagaaccttcccccccgtgcaccccctggacgtgatggccgacgccagagccctggagagagcctgctacgaggagagcctgaagagcagacccggcaccgccagcagcagcggcggcagcatcgccagaggcgcccccgtgatcgtgcccgagctgggcaagcccagacagagccccctgacctacgaggaccacggcgcccccttcgccggccacctgcccagaggcagccccgtgaccaccagagagcccacccccagactgcaggagggcagcctgagcagcagcaaggccagccaggacagaaagctgaccagcacccccagagagatcgccaagagcccccacagcaccgtgcccgagcaccacccccaccccatcagcccctacgagcacctgctgagaggcgtgagcggcgtggacctgtacagaagccacatccccctggccttcgaccccaccagcatccccagaggcatccccctggacgccgccgccgcctactacctgcccagacacctggcccccaaccccacctacccccacctgtaccccccctacctgatcagaggctaccccgacaccgccgccctggagaacagacagaccatcatcaacgactacatcaccagccagcagatgcaccacaacgccgccaccgccatggcccagagagccgacatgctgagaggcctgagccccagagagagcagcctggccctgaactacgccgccggccccagaggcatcatcgacctgagccaggtgccccacctgcccgtgctggtgccccccacccccggcacccccgccaccgccatggacagactggcctacctgcccaccgccccccagcccttcagcagcagacacagcagcagccccctgagccccggcggccccacccacctgaccaagcccaccaccaccagcagcagcgagagagagagagacagagacagagagagagacagagacagagagagagagaagagcatcctgaccagcaccaccaccgtggagcacgcccccatctggagacccggcaccgagcagagcagcggcagcagcggcggcggcggcggcagcagcagcagacccgccagccacagccacgcccaccagcacagccccatcagccccagaacccaggacgccctgcagcagagacccagcgtgctgcacaacaccggcatgaagggcatcatcaccgccgtggagcccagcacccccaccgtgctgagaagcaccagcaccagcagccccgtgagacccgccgccaccttcccccccgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91536 - DNA, 1821 bp, Artificial Sequence
  Description of Artificial Sequence: Synthetic coding sequence
ctgcagagcggcgccacccactgccccctgggcggcaccctggacggcgtgtaccccaccctgatggagcccgtgctgctgcccaaggaggcccccagagtggccagacccgagagacccagagccgacaccggccacgccttcctggccaagccccccgccagaagcggcctggagcccgccagcagccccagcaagggcagcgagcccagacccctggtgccccccgtgagcggccacgccaccatcgccagaacccccgccaagaacctggccccccaccacgccagccccgacccccccgccccccccgccagcgccagcgacccccacagagagaagacccagagcaagcccttcagcatccaggagctggagctgagaagcctgggctaccacggcagcagctacagccccgagggcgtggagcccgtgagccccgtgagcagccccagcctgacccacgacaagggcctgcccaagcacctggaggagctggacaagagccacctggagggcgagctgagacccaagcagcccggccccgtgaagctgggcggcgaggccgcccacctgccccacctgagacccctgcccgagagccagcccagcagcagccccctgctgcagaccgcccccggcgtgaagggccaccagagagtggtgaccctggcccagcacatcagcgaggtgatcacccaggactacaccagacaccacccccagcagctgagcgcccccctgcccgcccccctgtacagcttccccggcgccagctgccccgtgctggacctgagaagaccccccagcgacctgtacctgcccccccccgaccacggcgcccccgccagaggcagcccccacagcgagggcggcaagagaagccccgagcccaacaagaccagcgtgctgggcggcggcgaggacggcatcgagcccgtgagcccccccgagggcatgaccgagcccggccacagcagaagcgccgtgtaccccctgctgtacagagacggcgagcagaccgagcccagcagaatgggcagcaagagccccggcaacaccagccagccccccgccttcttcagcaagctgaccgagagcaacagcgccatggtgaagagcaagaagcaggagatcaacaagaagctgaacacccacaacagaaacgagcccgagtacaacatcagccagcccggcaccgagatcttcaacatgcccgccatcaccggcaccggcctgatgacctacagaagccaggccgtgcaggagcacgccagcaccaacatgggcctggaggccatcatcagaaaggccctgatgggcaagtacgaccagtgggaggagagcccccccctgagcgccaacgccttcaaccccctgaacgccagcgccagcctgcccgccgccatgcccatcaccgccgccgacggcagaagcgaccacaccctgaccagccccggcggcggcggcaaggccaaggtgagcggcagacccagcagcagaaaggccaagagccccgcccccggcctggccagcggcgacagaccccccagcgtgagcagcgtgcacagcgagggcgactgcaacagaagaacccccctgaccaacagagtgtgggaggacagacccagcagcgccggcagcacccccttcccctacaaccccctgatcatgagactgcaggccggcgtgatggccagcccccccccccccggcctgcccgccggcagcggccccctggccggcccccaccacgcctgggacgaggagcccaagcccctgctgtgcagccagtacgagaccctgagcgacagcgagtag

SEQ ID NO: 91537 - DNA, 726 bp, Artificial Sequence
  Description of Artificial Sequence: Synthetic coding sequence
atgttctacagcggcctgctgaccgagggcggcagaaaggagaccgacatgagagaggccgccagcctgagacagcagagaagaatgaagcaggccgtgcagttcatccacaaggacagcgccgacctgctgcccctggacggcctgaagaagctgggcagcagcaaggacatgcagccccacaacatcctgcagagaagactgatggagaccaacctgagcaagctgagaagcggccccagagtgccctgggccagcaagaccaacaagctgaaccaggccaagagcgagggcctgaagaagagcgaggaggacgacatgatcctggtgagctgccagtgcgccggcaaggacgtgaaggccctggtggacaccggctgcctgtacaacctgatcagcctggcctgcgtggacagactgggcctgaaggagcacgtgaagagccacaagcacgagggcgagaagctgagcctgcccagacacctgaaggtggtgggccagatcgagcacctggtgatcaccctgggcagcctgagactggactgccccgccgccgtggtggacgacaacgagaagaacctgagcctgggcctgcagaccctgagaagcctgaagtgcatcatcaacctggacaagcacagactgatcatgggcaagaccgacaaggaggagatccccttcgtggagaccgtgagcctgaacgaggacaacaccagcgaggcctag

SEQ ID NO: 91538 - DNA, 774 bp, Artificial Sequence
  Description of Artificial Sequence: Synthetic coding sequence
atgagcaccagccagcccggcgcctgcccctgccagggcgccgccagcagacccgccatcctgtacgccctgctgagcagcagcctgaaggccgtgcccagacccagaagcagatgcctgtgcagacagcacagacccgtgcagctgtgcgccccccacagaacctgcagagaggccctggacgtgctggccaagaccgtggccttcctgagaaacctgcccagcttctggcagctgcccccccaggaccagagaagactgctgcagggctgctggggccccctgttcctgctgggcctggcccaggacgccgtgaccttcgaggtggccgaggcccccgtgcccagcatcctgaagaagatcctgctggaggagcccagcagcagcggcggcagcggccagctgcccgacagaccccagcccagcctggccgccgtgcagtggctgcagtgctgcctggagagcttctggagcctggagctgagccccaaggagtacgcctgcctgaagggcaccatcctgttcaaccccgacgtgcccggcctgcaggccgccagccacatcggccacctgcagcaggaggcccactgggtgctgtgcgaggtgctggagccctggtgccccgccgcccagggcagactgaccagagtgctgctgaccgccagcaccctgaagagcatccccaccagcctgctgggcgacctgttcttcagacccatcatcggcgacgtggacatcgccggcctgctgggcgacatgctgctgctgagatag

SEQ ID NO: 91539 - DNA, 1845 bp, Artificial Sequence
  Description of Artificial Sequence: Synthetic coding sequence
atgaccaccctggacagcaacaacaacaccggcggcgtgatcacctacatcggcagcagcggcagcagccccagcagaaccagccccgagagcctgtacagcgacaacagcaacggcagcttccagagcctgacccagggctgccccacctacttcccccccagccccaccggcagcctgacccaggaccccgccagaagcttcggcagcatcccccccagcctgagcgacgacggcagccccagcagcagcagcagcagcagcagcagcagcagcagcttctacaacggcagcccccccggcagcctgcaggtggccatggaggacagcagcagagtgagccccagcaagagcaccagcaacatcaccaagctgaacggcatggtgctgctgtgcaaggtgtgcggcgacgtggccagcggcttccactacggcgtgcacgcctgcgagggctgcaagggcttcttcagaagaagcatccagcagaacatccagtacaagagatgcctgaagaacgagaactgcagcatcgtgagaatcaacagaaacagatgccagcagtgcagattcaagaagtgcctgagcgtgggcatgagcagagacgccgtgagattcggcagaatccccaagagagagaagcagagaatgctggccgagatgcagagcgccatgaacctggccaacaaccagctgagcagccagtgccccctggagaccagccccacccagcaccccacccccggccccatgggccccagccccccccccgcccccgtgcccagccccctggtgggcttcagccagttcccccagcagctgaccccccccagaagccccagccccgagcccaccgtggaggacgtgatcagccaggtggccagagcccacagagagatcttcacctacgcccacgacaagctgggcagcagccccggcaacttcaacgccaaccacgccagcggcagcccccccgccaccaccccccacagatgggagaaccagggctgcccccccgcccccaacgacaacaacaccctggccgcccagagacacaacgaggccctgaacggcctgagacaggcccccagcagctacccccccacctggccccccggccccgcccaccacagctgccaccagagcaacagcaacggccacagactgtgccccacccacgtgtacgccgcccccgagggcaaggcccccgccaacagccccagacagggcaacagcaagaacgtgctgctggcctgccccatgaacatgtacccccacggcagaagcggcagaaccgtgcaggagatctgggaggacttcagcatgagcttcacccccgccgtgagagaggtggtggagttcgccaagcacatccccggcttcagagacctgagccagcacgaccaggtgaccctgctgaaggccggcaccttcgaggtgctgatggtgagattcgccagcctgttcaacgtgaaggaccagaccgtgatgttcctgagcagaaccacctacagcctgcaggagctgggcgccatgggcatgggcgacctgctgagcgccatgttcgacttcagcgagaagctgaacagcctggccctgaccgaggaggagctgggcctgttcaccgccgtggtgctggtgagcgccgacagaagcggcatggagaacagcgccagcgtggagcagctgcaggagaccctgctgagagccctgagagccctggtgctgaagaacagacccctggagaccagcagattcaccaagctgctgctgaagctgcccgacctgagaaccctgaacaacatgcacagcgagaagctgctgagcttcagagtggacgcccagtag

SEQ ID NO: 91540 - DNA, 1383 bp, Artificial Sequence
  Description of Artificial Sequence: Synthetic coding sequence
atgagcagccccaccaccagcagcctggacacccccctgcccggcaacggccccccccagcccggcgcccccagcagcagccccaccgtgaaggaggagggccccgagccctggcccggcggccccgaccccgacgtgcccggcaccgacgaggccagcagcgcctgcagcaccgactgggtgatccccgaccccgaggaggagcccgagagaaagagaaagaagggccccgcccccaagatgctgggccacgagctgtgcagagtgtgcggcgacaaggccagcggcttccactacaacgtgctgagctgcgagggctgcaagggcttcttcagaagaagcgtggtgagaggcggcgccagaagatacgcctgcagaggcggcggcacctgccagatggacgccttcatgagaagaaagtgccagcagtgcagactgagaaagtgcaaggaggccggcatgagagagcagtgcgtgctgagcgaggagcagatcagaaagaagaagatcagaaagcagcagcaggagagccagagccagagccagagccccgtgggcccccagggcagcagcagcagcgccagcggccccggcgccagccccggcggcagcgaggccggcagccagggcagcggcgagggcgagggcgtgcagctgaccgccgcccaggagctgatgatccagcagctggtggccgcccagctgcagtgcaacaagagaagcttcagcgaccagcccaaggtgaccccctggcccctgggcgccgacccccagagcagagacgccagacagcagagattcgcccacttcaccgagctggccatcatcagcgtgcaggagatcgtggacttcgccaagcaggtgcccggcttcctgcagctgggcagagaggaccagatcgccctgctgaaggccagcaccatcgagatcatgctgctggagaccgccagaagatacaaccacgagaccgagtgcatcaccttcctgaaggacttcacctacagcaaggacgacttccacagagccggcctgcaggtggagttcatcaaccccatcttcgagttcagcagagccatgagaagactgggcctggacgacgccgagtacgccctgctgatcgccatcaacatcttcagcgccgacagacccaacgtgcaggagcccggcagagtggaggccctgcagcagccctacgtggaggccctgctgagctacaccagaatcaagagaccccaggaccagctgagattccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 91541 - DNA, 1377 bp, Artificial Sequence
  Description of Artificial Sequence: Synthetic coding sequence
atgagcagccccaccaccagcagcctggacacccccctgcccggcaacggccccccccagcccggcgcccccagcagcagccccaccgtgaaggaggagggccccgagccctggcccggcggccccgaccccgacgtgcccggcaccgacgaggccagcagcgcctgcagcaccgactgggtgatccccgaccccgaggaggagcccgagagaaagagaaagaagggccccgcccccaagatgctgggccacgagctgtgcagagtgtgcggcgacaaggccagcggcttccactacaacgtgctgagctgcgagggctgcaagggcttcttcagaagaagcgtggtgagaggcggcgccagaagatacgcctgcagaggcggcggcacctgccagatggacgccttcatgagaagaaagtgccagcagtgcagactgagaaagtgcaaggaggccggcatgagagagcagtgcgtgctgagcgaggagcagatcagaaagaagaagatcagaaagcagcagcaggagagccagagccagagccagagccccgtgggcccccagggcagcagcagcagcgccagcggccccggcgccagccccggcggcagcgaggccggcagccagggcagcggcgagggcgagggcgtgcagctgaccgccgcccaggagctgatgatccagcagctggtggccgcccagctgcagtgcaacaagagaagcttcagcgaccagcccaaggtgaccccctggcccctgggcgccgacccccagagcagagacgccagacagcagagattcgcccacttcaccgagctggccatcatcagcgtgcaggagatcgtggacttcgccaagcaggtgcccggcttcctgcagctgggcagagaggaccagatcgccctgctgaaggccagcaccatcgagatcatgctgctggagaccgccagaagatacaaccacgagaccgagtgcatcaccttcctgaaggacttcacctacagcaaggacgacttccacagagccggcctgcaggtggagttcatcaaccccatcttcgagttcagcagagccatgagaagactgggcctggacgacgccgagtacgccctgctgatcgccatcaacatcttcagcgccgacagacccaacggcgccggccccagaggcggcgtggccgccgccctgagaggcggcgccgccgtgctgcacgcccaccaggaggccgccgaccagctgagattccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 91542 - DNA, 1092 bp, Artificial Sequence
  Description of Artificial Sequence: Synthetic coding sequence
atgagcagccccaccaccagcagcctggacacccccctgcccggcaacggccccccccagcccggcgcccccagcagcagccccaccgtgaaggaggagggccccgagccctggcccggcggccccgaccccgacgtgcccggcaccgacgaggccagcagcgcctgcagcaccgactggggcgtgctgagcgaggagcagatcagaaagaagaagatcagaaagcagcagcaggagagccagagccagagccagagccccgtgggcccccagggcagcagcagcagcgccagcggccccggcgccagccccggcggcagcgaggccggcagccagggcagcggcgagggcgagggcgtgcagctgaccgccgcccaggagctgatgatccagcagctggtggccgcccagctgcagtgcaacaagagaagcttcagcgaccagcccaaggtgaccccctggcccctgggcgccgacccccagagcagagacgccagacagcagagattcgcccacttcaccgagctggccatcatcagcgtgcaggagatcgtggacttcgccaagcaggtgcccggcttcctgcagctgggcagagaggaccagatcgccctgctgaaggccagcaccatcgagatcatgctgctggagaccgccagaagatacaaccacgagaccgagtgcatcaccttcctgaaggacttcacctacagcaaggacgacttccacagagccggcctgcaggtggagttcatcaaccccatcttcgagttcagcagagccatgagaagactgggcctggacgacgccgagtacgccctgctgatcgccatcaacatcttcagcgccgacagacccaacgtgcaggagcccggcagagtggaggccctgcagcagccctacgtggaggccctgctgagctacaccagaatcaagagaccccaggaccagctgagattccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 91543 - DNA, 576 bp, Artificial Sequence
  Description of Artificial Sequence: Synthetic coding sequence
atgatccagcagctggtggccgcccagctgcagtgcaacaagagaagcttcagcgaccagcccaaggtgaccctgggcagagaggaccagatcgccctgctgaaggccagcaccatcgagatcatgctgctggagaccgccagaagatacaaccacgagaccgagtgcatcaccttcctgaaggacttcacctacagcaaggacgacttccacagagccggcctgcaggtggagttcatcaaccccatcttcgagttcagcagagccatgagaagactgggcctggacgacgccgagtacgccctgctgatcgccatcaacatcttcagcgccgacagacccaacgtgcaggagcccggcagagtggaggccctgcagcagccctacgtggaggccctgctgagctacaccagaatcaagagaccccaggaccagctgagattccccagaatgctgatgaagctggtgagcctgagaaccctgagcagcgtgcacagcgagcaggtgttcgccctgagactgcaggacaagaagctgccccccctgctgagcgagatctgggacgtgcacgagtag

SEQ ID NO: 91544 - DNA, 1422 bp, Artificial Sequence
  Description of Artificial Sequence: Synthetic coding sequence
atgaccgtgaccagaacccaccacttcaaggagggcagcctgagagcccccgccatccccctgcacagcgccgccgccgagctggccagcaaccaccccagaggccccgaggccaacctggaggtgagacccaaggagagctggaaccacgccgacttcgtgcactgcgaggacaccgagagcgtgcccggcaagcccagcgtgaacgccgacgaggaggtgggcggcccccagatctgcagagtgtgcggcgacaaggccaccggctaccacttcaacgtgatgacctgcgagggctgcaagggcttcttcagaagagccatgaagagaaacgccagactgagatgccccttcagaaagggcgcctgcgagatcaccagaaagaccagaagacagtgccaggcctgcagactgagaaagtgcctggagagcggcatgaagaaggagatgatcatgagcgacgaggccgtggaggagagaagagccctgatcaagagaaagaagagcgagagaaccggcacccagcccctgggcgtgcagggcctgaccgaggagcagagaatgatgatcagagagctgatggacgcccagatgaagaccttcgacaccaccttcagccacttcaagaacttcagactgcccggcgtgctgagcagcggctgcgagctgcccgagagcctgcaggcccccagcagagaggaggccgccaagtggagccaggtgagaaaggacctgtgcagcctgaaggtgagcctgcagctgagaggcgaggacggcagcgtgtggaactacaagccccccgccgacagcggcggcaaggagatcttcagcctgctgccccacatggccgacatgagcacctacatgttcaagggcatcatcagcttcgccaaggtgatcagctacttcagagacctgcccatcgaggaccagatcagcctgctgaagggcgccgccttcgagctgtgccagctgagattcaacaccgtgttcaacgccgagaccggcacctgggagtgcggcagactgagctactgcctggaggacaccgccggcggcttccagcagctgctgctggagcccatgctgaagttccactacatgctgaagaagctgcagctgcacgaggaggagtacgtgctgatgcaggccatcagcctgttcagccccgacagacccggcgtgctgcagcacagagtggtggaccagctgcaggagcagttcgccatcaccctgaagagctacatcgagtgcaacagaccccagcccgcccacagattcctgttcctgaagatcatggccatgctgaccgagctgagaagcatcaacgcccagcacacccagagactgctgagaatccaggacatccaccccttcgccacccccctgatgcaggagctgttcggcatcaccggcagctag

SEQ ID NO: 91545 - DNA, 1305 bp, Artificial Sequence
  Description of Artificial Sequence: Synthetic coding sequence
ctggaggtgagacccaaggagagctggaaccacgccgacttcgtgcactgcgaggacaccgagagcgtgcccggcaagcccagcgtgaacgccgacgaggaggtgggcggcccccagatctgcagagtgtgcggcgacaaggccaccggctaccacttcaacgtgatgacctgcgagggctgcaagggcttcttcagaagagccatgaagagaaacgccagactgagatgccccttcagaaagggcgcctgcgagatcaccagaaagaccagaagacagtgccaggcctgcagactgagaaagtgcctggagagcggcatgaagaaggagatgatcatgagcgacgaggccgtggaggagagaagagccctgatcaagagaaagaagagcgagagaaccggcacccagcccctgggcgtgcagggcctgaccgaggagcagagaatgatgatcagagagctgatggacgcccagatgaagaccttcgacaccaccttcagccacttcaagaacttcagactgcccggcgtgctgagcagcggctgcgagctgcccgagagcctgcaggcccccagcagagaggaggccgccaagtggagccaggtgagaaaggacctgtgcagcctgaaggtgagcctgcagctgagaggcgaggacggcagcgtgtggaactacaagccccccgccgacagcggcggcaaggagatcttcagcctgctgccccacatggccgacatgagcacctacatgttcaagggcatcatcagcttcgccaaggtgatcagctacttcagagacctgcccatcgaggaccagatcagcctgctgaagggcgccgccttcgagctgtgccagctgagattcaacaccgtgttcaacgccgagaccggcacctgggagtgcggcagactgagctactgcctggaggacaccgccggcggcttccagcagctgctgctggagcccatgctgaagttccactacatgctgaagaagctgcagctgcacgaggaggagtacgtgctgatgcaggccatcagcctgttcagccccgacagacccggcgtgctgcagcacagagtggtggaccagctgcaggagcagttcgccatcaccctgaagagctacatcgagtgcaacagaccccagcccgcccacagattcctgttcctgaagatcatggccatgctgaccgagctgagaagcatcaacgcccagcacacccagagactgctgagaatccaggacatccaccccttcgccacccccctgatgcaggagctgttcggcatcaccggcagctag

SEQ ID NO: 91546 - DNA, 1194 bp, Artificial Sequence
  Description of Artificial Sequence: Synthetic coding sequence
ctggaggtgagacccaaggagagctggaaccacgccgacttcgtgcactgcgaggacaccgagagcgtgcccggcaagcccagcgtgaacgccgacgaggaggtgggcggcccccagatctgcagagtgtgcggcgacaaggccaccggctaccacttcaacgtgatgacctgcgagggctgcaagggcttcttcagaagagccatgaagagaaacgccagactgagatgccccttcagaaagggcgcctgcgagatcaccagaaagaccagaagacagtgccaggcctgcagactgagaaagtgcctggagagcggcatgaagaaggagatgatcatgagcgacgaggccgtggaggagagaagagccctgatcaagagaaagaagagcgagagaaccggcacccagcccctgggcgtgcagggcctgaccgaggagcagagaatgatgatcagagagctgatggacgcccagatgaagaccttcgacaccaccttcagccacttcaagaacttcagagtgagcctgcagctgagaggcgaggacggcagcgtgtggaactacaagccccccgccgacagcggcggcaaggagatcttcagcctgctgccccacatggccgacatgagcacctacatgttcaagggcatcatcagcttcgccaaggtgatcagctacttcagagacctgcccatcgaggaccagatcagcctgctgaagggcgccgccttcgagctgtgccagctgagattcaacaccgtgttcaacgccgagaccggcacctgggagtgcggcagactgagctactgcctggaggacaccgccggcggcttccagcagctgctgctggagcccatgctgaagttccactacatgctgaagaagctgcagctgcacgaggaggagtacgtgctgatgcaggccatcagcctgttcagccccgacagacccggcgtgctgcagcacagagtggtggaccagctgcaggagcagttcgccatcaccctgaagagctacatcgagtgcaacagaccccagcccgcccacagattcctgttcctgaagatcatggccatgctgaccgagctgagaagcatcaacgcccagcacacccagagactgctgagaatccaggacatccaccccttcgccacccccctgatgcaggagctgttcggcatcaccggcagctag

SEQ ID NO: 91547 - DNA, 1848 bp, Artificial Sequence
  Description of Artificial Sequence: Synthetic coding sequence
atgaccagccccagccccagaatccagatcatcagcaccgacagcgccgtggccagcccccagagaatccagggcagcgagcccgccagcggccccctgagcgtgttcaccagcctgaacaaggagaagatcgtgaccgaccagcagaccggccagaagatccagatcgtgaccgccgtggacgccagcggcagccccaagcagcagttcatcctgaccagccccgacggcgccggcaccggcaaggtgatcctggccagccccgagaccagcagcgccaagcagctgatcttcaccaccagcgacaacctggtgcccggcagaatccagatcgtgaccgacagcgccagcgtggagagactgctgggcaagaccgacgtgcagagaccccaggtggtggagtactgcgtggtgtgcggcgacaaggccagcggcagacactacggcgccgtgagctgcgagggctgcaagggcttcttcaagagaagcgtgagaaagaacctgacctacagctgcagaagcaaccaggactgcatcatcaacaagcaccacagaaacagatgccagttctgcagactgaagaagtgcctggagatgggcatgaagatggagagcgtgcagagcgagagaaagcccttcgacgtgcagagagagaagcccagcaactgcgccgccagcaccgagaagatctacatcagaaaggacctgagaagccccctgatcgccacccccaccttcgtggccgacaaggacggcgccagacagaccggcctgctggaccccggcatgctggtgaacatccagcagcccctgatcagagaggacggcaccgtgctgctggccaccgacagcaaggccgagaccagccagggcgccctgggcaccctggccaacgtggtgaccagcctggccaacctgagcgagagcctgaacaacggcgacaccagcgagatccagcccgaggaccagagcgccagcgagatcaccagagccttcgacaccctggccaaggccctgaacaccaccgacagcagcagcagccccagcctggccgacggcatcgacaccagcggcggcggcagcatccacgtgatcagcagagaccagagcacccccatcatcgaggtggagggccccctgctgagcgacacccacgtgaccttcaagctgaccatgcccagccccatgcccgagtacctgaacgtgcactacatctgcgagagcgccagcagactgctgttcctgagcatgcactgggccagaagcatccccgccttccaggccctgggccaggactgcaacaccagcctggtgagagcctgctggaacgagctgttcaccctgggcctggcccagtgcgcccaggtgatgagcctgagcaccatcctggccgccatcgtgaaccacctgcagaacagcatccaggaggacaagctgagcggcgacagaatcaagcaggtgatggagcacatctggaagctgcaggagttctgcaacagcatggccaagctggacatcgacggctacgagtacgcctacctgaaggccatcgtgctgttcagccccgaccaccccggcctgaccagcaccagccagatcgagaagttccaggagaaggcccagatggagctgcaggactacgtgcagaagacctacagcgaggacacctacagactggccagaatcctggtgagactgcccgccctgagactgatgagcagcaacatcaccgaggagctgttcttcaccggcctgatcggcaacgtgagcatcgacagcatcatcccctacatcctgaagatggagaccgccgagtacaacggccagatcaccggcgccagcctgtag

SEQ ID NO: 91548 - DNA, 1791 bp, Artificial Sequence
  Description of Artificial Sequence: Synthetic coding sequence
atgaccagccccagccccagaatccagatcatcagcaccgacagcgccgtggccagcccccagagaatccagatcgtgaccgaccagcagaccggccagaagatccagatcgtgaccgccgtggacgccagcggcagccccaagcagcagttcatcctgaccagccccgacggcgccggcaccggcaaggtgatcctggccagccccgagaccagcagcgccaagcagctgatcttcaccaccagcgacaacctggtgcccggcagaatccagatcgtgaccgacagcgccagcgtggagagactgctgggcaagaccgacgtgcagagaccccaggtggtggagtactgcgtggtgtgcggcgacaaggccagcggcagacactacggcgccgtgagctgcgagggctgcaagggcttcttcaagagaagcgtgagaaagaacctgacctacagctgcagaagcaaccaggactgcatcatcaacaagcaccacagaaacagatgccagttctgcagactgaagaagtgcctggagatgggcatgaagatggagagcgtgcagagcgagagaaagcccttcgacgtgcagagagagaagcccagcaactgcgccgccagcaccgagaagatctacatcagaaaggacctgagaagccccctgatcgccacccccaccttcgtggccgacaaggacggcgccagacagaccggcctgctggaccccggcatgctggtgaacatccagcagcccctgatcagagaggacggcaccgtgctgctggccaccgacagcaaggccgagaccagccagggcgccctgggcaccctggccaacgtggtgaccagcctggccaacctgagcgagagcctgaacaacggcgacaccagcgagatccagcccgaggaccagagcgccagcgagatcaccagagccttcgacaccctggccaaggccctgaacaccaccgacagcagcagcagccccagcctggccgacggcatcgacaccagcggcggcggcagcatccacgtgatcagcagagaccagagcacccccatcatcgaggtggagggccccctgctgagcgacacccacgtgaccttcaagctgaccatgcccagccccatgcccgagtacctgaacgtgcactacatctgcgagagcgccagcagactgctgttcctgagcatgcactgggccagaagcatccccgccttccaggccctgggccaggactgcaacaccagcctggtgagagcctgctggaacgagctgttcaccctgggcctggcccagtgcgcccaggtgatgagcctgagcaccatcctggccgccatcgtgaaccacctgcagaacagcatccaggaggacaagctgagcggcgacagaatcaagcaggtgatggagcacatctggaagctgcaggagttctgcaacagcatggccaagctggacatcgacggctacgagtacgcctacctgaaggccatcgtgctgttcagccccgaccaccccggcctgaccagcaccagccagatcgagaagttccaggagaaggcccagatggagctgcaggactacgtgcagaagacctacagcgaggacacctacagactggccagaatcctggtgagactgcccgccctgagactgatgagcagcaacatcaccgaggagctgttcttcaccggcctgatcggcaacgtgagcatcgacagcatcatcccctacatcctgaagatggagaccgccgagtacaacggccagatcaccggcgccagcctgtag

SEQ ID NO: 91549 - DNA, 1791 bp, Artificial Sequence; identical to SEQ ID NO: 91548
  Description of Artificial Sequence: Synthetic coding sequence

SEQ ID NO: 91550 - DNA, 1791 bp, Artificial Sequence; identical to SEQ ID NO: 91548
  Description of Artificial Sequence: Synthetic coding sequence

SEQ ID NO: 91551 - DNA, 111 bp, Artificial Sequence
  Description of Artificial Sequence: Synthetic coding sequence
atgaccagccccagccccagaatccagatcatcagcaccgacagcgccgtggccagcccccagagaatccagggcagcgagcccgccagcggccccctgagcgtgttctag

SEQ ID NO: 91552 - DNA, 618 bp, Artificial Sequence
  Description of Artificial Sequence: Synthetic coding sequence
atgaccagccccagccccagaatccagatcatcagcaccgacagcgccgtggccagcccccagagaatccagggcagcgagcccgccagcggccccctgagcgtgttcaccagcctgaacaaggagaagatcgtgaccgaccagcagaccggccagaagatccagatcgtgaccgccgtggacgccagcggcagccccaagcagcagttcatcctgaccagccccgacggcgccggcaccggcaaggtgatcctggccagccccgagaccagcagcgccaagcagctgatcttcaccaccagcgacaacctggtgcccggcagaatccagatcgtgaccgacagcgccagcgtggagagactgctgggcaagaccgacgtgcagagaccccaggtggtggagtactgcgtggtgtgcggcgacaaggccagcggcagacactacggcgccgtgagctgcgagggctgcaagggcttcttcaagagaagcgtgagaaagaacctgacctacagctgcagaagcaaccaggactgcatcatcaacaagcaccacagaaacagatgccagttctgcagactgaagaagtgcctggagatgggcatgaagatggagtgctag

SEQ ID NO: 91553 - DNA, 1269 bp, Artificial Sequence
  Description of Artificial Sequence: Synthetic coding sequence
atgttcagagccggcgccgagggcgccgagaaggagcccagccccagacccgagtgcagagccgaccccggccccggcctgggcttccccctgggcagcggcctgccctggcccagcctgctggagagccccggcggcagaatcctggacatcccctgcaaggtgtgcggcgacagaagcagcggcaagcactacggcgtgtacgcctgcgacggctgcagcggcttcttcaagagaagcatcagaagaaacagaacctacgtgtgcaagagcggcaaccagggcggctgccccgtggacaagacccacagaaaccagtgcagagcctgcagactgaagaagtgcctggaggtgaacatgaacaaggacgccgtgcagcacgagagaggccccagaaccagcaccatcagaaagcaggtggccctgtacttcagaggccacaaggaggagaacggcgccgccgcccacttccccagcgccgccctgcccgcccccgccttcttcaccgccgtgacccagctggagccccacggcctggagctggccgccgtgagcaccacccccgagagacagaccctggtgagcctggcccagcccacccccaagtacccccacgaggtgaacggcacccccatgtacctgtacgaggtggccaccgagagcgtgtgcgagagcgccgccagactgctgttcatgagcatcaagtgggccaagagcgtgcccgccttcagcaccctgagcctgcaggaccagctgatgctgctggaggacgcctggagagagctgttcgtgctgggcatcgcccagtgggccatccccgtggacgccaacaccctgctggccgtgagcggcatgaacggcgacaacaccgacagccagaagctgaacaagatcatcagcgagatccaggccctgcaggaggtggtggccagattcagacagctgagactggacgccaccgagttcgcctgcctgaagtgcatcgtgaccttcaaggccgtgcccacccacagcggcagcgagctgagaagcttcagaaacgccgccgccatcgccgccctgcaggacgaggcccagctgaccctgaacagctacatccacaccagataccccacccagccctgcagattcggcaagctgctgctgctgctgcccgccctgagaagcatcagccccagcaccatcgaggaggtgttcttcaagaagaccatcggcaacgtgcccatcaccagactgctgagcgacatgtacaagagcagcgacatctag

SEQ ID NO: 91554 - DNA, 1158 bp, Artificial Sequence
  Description of Artificial Sequence: Synthetic coding sequence
atgagcaagcccgccggcagcaccagcagaatcctggacatcccctgcaaggtgtgcggcgacagaagcagcggcaagcactacggcgtgtacgcctgcgacggctgcagcggcttcttcaagagaagcatcagaagaaacagaacctacgtgtgcaagagcggcaaccagggcggctgccccgtggacaagacccacagaaaccagtgcagagcctgcagactgaagaagtgcctggaggtgaacatgaacaaggacgccgtgcagcacgagagaggccccagaaccagcaccatcagaaagcaggtggccctgtacttcagaggccacaaggaggagaacggcgccgccgcccacttccccagcgccgccctgcccgcccccgccttcttcaccgccgtgacccagctggagccccacggcctggagctggccgccgtgagcaccacccccgagagacagaccctggtgagcctggcccagcccacccccaagtacccccacgaggtgaacggcacccccatgtacctgtacgaggtggccaccgagagcgtgtgcgagagcgccgccagactgctgttcatgagcatcaagtgggccaagagcgtgcccgccttcagcaccctgagcctgcaggaccagctgatgctgctggaggacgcctggagagagctgttcgtgctgggcatcgcccagtgggccatccccgtggacgccaacaccctgctggccgtgagcggcatgaacggcgacaacaccgacagccagaagctgaacaagatcatcagcgagatccaggccctgcaggaggtggtggccagattcagacagctgagactggacgccaccgagttcgcctgcctgaagtgcatcgtgaccttcaaggccgtgcccacccacagcggcagcgagctgagaagcttcagaaacgccgccgccatcgccgccctgcaggacgaggcccagctgaccctgaacagctacatccacaccagataccccacccagccctgcagattcggcaagctgctgctgctgctgcccgccctgagaagcatcagccccagcaccatcgaggaggtgttcttcaagaagaccatcggcaacgtgcccatcaccagactgctgagcgacatgtacaagagcagcgacatctag

SEQ ID NO: 91555 - DNA, 141 bp, Artificial Sequence
  Description of Artificial Sequence: Synthetic coding sequence
atgaacaaggacgccgtgcagcacgagagaggccccagaaccagcaccatcagaaagcaggtggccctgtacttcagaggccacaaggaggagaacggcgccgccgcccacttccccagcgccgccctgcccgccccctag

SEQ ID NO: 91556 - DNA, 1272 bp, Artificial Sequence
  Description of Artificial Sequence: Synthetic coding sequence
atggccatggtggtgagcagctggagagacccccaggacgacgtggccggcggcaaccccggcggccccaaccccgccgcccaggccgccagaggcggcggcggcggcgccggcgagcagcagcagcaggccggcagcggcgccccccacaccccccagacccccggccagcccggcgcccccgccacccccggcaccgccggcgacaagggccagggcccccccggcagcggccagagccagcagcacatcgagtgcgtggtgtgcggcgacaagagcagcggcaagcactacggccagttcacctgcgagggctgcaagagcttcttcaagagaagcgtgagaagaaacctgacctacacctgcagagccaacagaaactgccccatcgaccagcaccacagaaaccagtgccagtactgcagactgaagaagtgcctgaaggtgggcatgagaagagaggccgtgcagagaggcagaatgccccccacccagcccaaccccggccagtacgccctgaccaacggcgaccccctgaacggccactgctacctgagcggctacatcagcctgctgctgagagccgagccctaccccaccagcagatacggcagccagtgcatgcagcccaacaacatcatgggcatcgagaacatctgcgagctggccgccagactgctgttcagcgccgtggagtgggccagaaacatccccttcttccccgacctgcagatcaccgaccaggtgagcctgctgagactgacctggagcgagctgttcgtgctgaacgccgcccagtgcagcatgcccctgcacgtggcccccctgctggccgccgccggcctgcacgccagccccatgagcgccgacagagtggtggccttcatggaccacatcagaatcttccaggagcaggtggagaagctgaaggccctgcacgtggacagcgccgagtacagctgcctgaaggccatcgtgctgttcaccagcgacgcctgcggcctgagcgacgccgcccacatcgagagcctgcaggagaagagccagtgcgccctggaggagtacgtgagaagccagtaccccaaccagcccagcagattcggcaagctgctgctgagactgcccagcctgagaaccgtgagcagcagcgtgatcgagcagctgttcttcgtgagactggtgggcaagacccccatcgagaccctgatcagagacatgctgctgagcggcagcagcttcaactggccctacatgagcatccagtgcagctag

SEQ ID NO: 91557 - DNA, 1245 bp, Artificial Sequence
  Description of Artificial Sequence: Synthetic coding sequence
atggccatggtggtgagcacctggagagacccccaggacgaggtgcccggcagccagggcagccaggccagccaggccccccccgtgcccggccccccccccggcgccccccacaccccccagacccccggccagggcggccccgccagcacccccgcccagaccgccgccggcggccagggcggccccggcggccccggcagcgacaagcagcagcagcagcagcacatcgagtgcgtggtgtgcggcgacaagagcagcggcaagcactacggccagttcacctgcgagggctgcaagagcttcttcaagagaagcgtgagaagaaacctgagctacacctgcagagccaacagaaactgccccatcgaccagcaccacagaaaccagtgccagtactgcagactgaagaagtgcctgaaggtgggcatgagaagagaggccgtgcagagaggcagaatgccccccacccagcccacccacggccagttcgccctgaccaacggcgaccccctgaactgccacagctacctgagcggctacatcagcctgctgctgagagccgagccctaccccaccagcagattcggcagccagtgcatgcagcccaacaacatcatgggcatcgagaacatctgcgagctggccgccagaatgctgttcagcgccgtggagtgggccagaaacatccccttcttccccgacctgcagatcaccgaccaggtggccctgctgagactgacctggagcgagctgttcgtgctgaacgccgcccagtgcagcatgcccctgcacgtggcccccctgctggccgccgccggcctgcacgccagccccatgagcgccgacagagtggtggccttcatggaccacatcagaatcttccaggagcaggtggagaagctgaaggccctgcacgtggacagcgccgagtacagctgcctgaaggccatcgtgctgttcaccagcgacgcctgcggcctgagcgacgtggcccacgtggagagcctgcaggagaagagccagtgcgccctggaggagtacgtgagaagccagtaccccaaccagcccaccagattcggcaagctgctgctgagactgcccagcctgagaaccgtgagcagcagcgtgatcgagcagctgttcttcgtgagactggtgggcaagacccccatcgagaccctgatcagagacatgctgctgagcggcagcagcttcaactggccctacatggccatccagtag

SEQ ID NO: 91558 - DNA, 786 bp, Artificial Sequence
  Description of Artificial Sequence: Synthetic coding sequence
atgccccccacccagcccacccacggccagttcgccctgaccaacggcgaccccctgaactgccacagctacctgagcggctacatcagcctgctgctgagagccgagccctaccccaccagcagattcggcagccagtgcatgcagcccaacaacatcatgggcatcgagaacatctgcgagctggccgccagaatgctgttcagcgccgtggagtgggccagaaacatccccttcttccccgacctgcagatcaccgaccaggtggccctgctgagactgacctggagcgagctgttcgtgctgaacgccgcccagtgcagcatgcccctgcacgtggcccccctgctggccgccgccggcctgcacgccagccccatgagcgccgacagagtggtggccttcatggaccacatcagaatcttccaggagcaggtggagaagctgaaggccctgcacgtggacagcgccgagtacagctgcctgaaggccatcgtgctgttcaccagcgacgcctgcggcctgagcgacgtggcccacgtggagagcctgcaggagaagagccagtgcgccctggaggagtacgtgagaagccagtaccccaaccagcccaccagattcggcaagctgctgctgagactgcccagcctgagaaccgtgagcagcagcgtgatcgagcagctgttcttcgtgagactggtgggcaagacccccatcgagaccctgatcagagacatgctgctgagcggcagcagcttcaactggccctacatggccatccagtag

SEQ ID NO: 91559 - DNA, 846 bp, Artificial Sequence
  Description of Artificial Sequence: Synthetic coding sequence
atgcaggccgtgtgggacctggagcagggcaagtacggcttcgccgtgcagagaggcagaatgccccccacccagcccacccacggccagttcgccctgaccaacggcgaccccctgaactgccacagctacctgagcggctacatcagcctgctgctgagagccgagccctaccccaccagcagattcggcagccagtgcatgcagcccaacaacatcatgggcatcgagaacatctgcgagctggccgccagaatgctgttcagcgccgtggagtgggccagaaacatccccttcttccccgacctgcagatcaccgaccaggtggccctgctgagactgacctggagcgagctgttcgtgctgaacgccgcccagtgcagcatgcccctgcacgtggcccccctgctggccgccgccggcctgcacgccagccccatgagcgccgacagagtggtggccttcatggaccacatcagaatcttccaggagcaggtggagaagctgaaggccctgcacgtggacagcgccgagtacagctgcctgaaggccatcgtgctgttcaccagcgacgcctgcggcctgagcgacgtggcccacgtggagagcctgcaggagaagagccagtgcgccctggaggagtacgtgagaagccagtaccccaaccagcccaccagattcggcaagctgctgctgagactgcccagcctgagaaccgtgagcagcagcgtgatcgagcagctgttcttcgtgagactggtgggcaagacccccatcgagaccctgatcagagacatgctgctgagcggcagcagcttcaactggccctacatggccatccagtag

SEQ ID NO: 91560 - DNA, 786 bp, Artificial Sequence; identical to SEQ ID NO: 91558
  Description of Artificial Sequence: Synthetic coding sequence

SEQ ID NO: 91561 - DNA, 1215 bp, Artificial Sequence
  Description of Artificial Sequence: Synthetic coding sequence
atggccatggtgaccggcggctggggcggccccggcggcgacaccaacggcgtggacaaggccggcggctaccccagagccgccgaggacgacagcgccagcccccccggcgccgccagcgacgccgagcccggcgacgaggagagacccggcctgcaggtggactgcgtggtgtgcggcgacaagagcagcggcaagcactacggcgtgttcacctgcgagggctgcaagagcttcttcaagagaagcatcagaagaaacctgagctacacctgcagaagcaacagagactgccagatcgaccagcaccacagaaaccagtgccagtactgcagactgaagaagtgcttcagagtgggcatgagaaaggaggccgtgcagagaggcagaatcccccacagcctgcccggcgccgtggccgccagcagcggcagcccccccggcagcgccctggccgccgtggccagcggcggcgacctgttccccggccagcccgtgagcgagctgatcgcccagctgctgagagccgagccctaccccgccgccgccggcagattcggcgccggcggcggcgccgccggcgccgtgctgggcatcgacaacgtgtgcgagctggccgccagactgctgttcagcaccgtggagtgggccagacacgcccccttcttccccgagctgcccgtggccgaccaggtggccctgctgagactgagctggagcgagctgttcgtgctgaacgccgcccaggccgccctgcccctgcacaccgcccccctgctggccgccgccggcctgcacgccgcccccatggccgccgagagagccgtggccttcatggaccaggtgagagccttccaggagcaggtggacaagctgggcagactgcaggtggacagcgccgagtacggctgcctgaaggccatcgccctgttcacccccgacgcctgcggcctgagcgaccccgcccacgtggagagcctgcaggagaaggcccaggtggccctgaccgagtacgtgagagcccagtaccccagccagccccagagattcggcagactgctgctgagactgcccgccctgagagccgtgcccgccagcctgatcagccagctgttcttcatgagactggtgggcaagacccccatcgagaccctgatcagagacatgctgctgagcggcagcaccttcaactggccctacggcagcggccagtag

SEQ ID NO: 91562 - DNA, 1134 bp, Artificial Sequence
  Description of Artificial Sequence: Synthetic coding sequence
atggccatggtgaccggcggctggggcggccccggcggcgacgccgagcccggcgacgaggagagacccggcctgcaggtggactgcgtggtgtgcggcgacaagagcagcggcaagcactacggcgtgttcacctgcgagggctgcaagagcttcttcaagagaagcatcagaagaaacctgagctacacctgcagaagcaacagagactgccagatcgaccagcaccacagaaaccagtgccagtactgcagactgaagaagtgcttcagagtgggcatgagaaaggaggccgtgcagagaggcagaatcccccacagcctgcccggcgccgtggccgccagcagcggcagcccccccggcagcgccctggccgccgtggccagcggcggcgacctgttccccggccagcccgtgagcgagctgatcgcccagctgctgagagccgagccctaccccgccgccgccggcagattcggcgccggcggcggcgccgccggcgccgtgctgggcatcgacaacgtgtgcgagctggccgccagactgctgttcagcaccgtggagtgggccagacacgcccccttcttccccgagctgcccgtggccgaccaggtggccctgctgagactgagctggagcgagctgttcgtgctgaacgccgcccaggccgccctgcccctgcacaccgcccccctgctggccgccgccggcctgcacgccgcccccatggccgccgagagagccgtggccttcatggaccaggtgagagccttccaggagcaggtggacaagctgggcagactgcaggtggacagcgccgagtacggctgcctgaaggccatcgccctgttcacccccgacgcctgcggcctgagcgaccccgcccacgtggagagcctgcaggagaaggcccaggtggccctgaccgagtacgtgagagcccagtaccccagccagccccagagattcggcagactgctgctgagactgcccgccctgagagccgtgcccgccagcctgatcagccagctgttcttcatgagactggtgggcaagacccccatcgagaccctgatcagagacatgctgctgagcggcagcaccttcaactggccctacggcagcggccagtag

SEQ ID NO: 91563 - DNA, 2121 bp, Artificial Sequence
  Description of Artificial Sequence: Synthetic coding sequence
atggagaccaagggctaccacagcctgcccgagggcctggacatggagagaagatggggccaggtgagccaggccgtggagagaagcagcctgggccccaccgagagaaccgacgagaacaactacatggagatcgtgaacgtgagctgcgtgagcggcgccatccccaacaacagcacccagggcagcagcaaggagaagcaggagctgctgccctgcctgcagcaggacaacaacagacccggcatcctgaccagcgacatcaagaccgagctggagagcaaggagctgagcgccaccgtggccgagagcatgggcctgtacatggacagcgtgagagacgccgactacagctacgagcagcagaaccagcagggcagcatgagccccgccaagatctaccagaacgtggagcagctggtgaagttctacaagggcaacggccacagacccagcaccctgagctgcgtgaacacccccctgagaagcttcatgagcgacagcggcagcagcgtgaacggcggcgtgatgagagccgtggtgaagagccccatcatgtgccacgagaagagccccagcgtgtgcagccccctgaacatgaccagcagcgtgtgcagccccgccggcatcaacagcgtgagcagcaccaccgccagcttcggcagcttccccgtgcacagccccatcacccagggcacccccctgacctgcagccccaacgtggagaacagaggcagcagaagccacagccccgcccacgccagcaacgtgggcagccccctgagcagccccctgagcagcatgaagagcagcatcagcagcccccccagccactgcagcgtgaagagccccgtgagcagccccaacaacgtgaccctgagaagcagcgtgagcagccccgccaacatcaacaacagcagatgcagcgtgagcagccccagcaacaccaacaacagaagcaccctgagcagccccgccgccagcaccgtgggcagcatctgcagccccgtgaacaacgccttcagctacaccgccagcggcaccagcgccggcagcagcaccctgagagacgtggtgcccagccccgacacccaggagaagggcgcccaggaggtgcccttccccaagaccgaggaggtggagagcgccatcagcaacggcgtgaccggccagctgaacatcgtgcagtacatcaagcccgagcccgacggcgccttcagcagcagctgcctgggcggcaacagcaagatcaacagcgacagcagcttcagcgtgcccatcaagcaggagagcaccaagcacagctgcagcggcaccagcttcaagggcaaccccaccgtgaaccccttccccttcatggacggcagctacttcagcttcatggacgacaaggactactacagcctgagcggcatcctgggcccccccgtgcccggcttcgacggcaactgcgagggcagcggcttccccgtgggcatcaagcaggagcccgacgacggcagctactaccccgaggccagcatccccagcagcgccatcgtgggcgtgaacagcggcggccagagcttccactacagaatcggcgcccagggcaccatcagcctgagcagaagcgccagagaccagagcttccagcacctgagcagcttcccccccgtgaacaccctggtggagagctggaagagccacggcgacctgagcagcagaagaagcgacggctaccccgtgctggagtacatccccgagaacgtgagcagcagcaccctgagaagcgtgagcaccggcagcagcagacccagcaagatctgcctggtgtgcggcgacgaggccagcggctgccactacggcgtggtgacctgcggcagctgcaaggtgttcttcaagagagccgtggagggccagcacaactacctgtgcgccggcagaaacgactgcatcatcgacaagatcagaagaaagaactgccccgcctgcagactgcagaagtgcctgcaggccggcatgaacctgggcgagagaagatgcatcagcctgccctgcatgaactacgccagaggctgcaccaagagcgccttcagcagcttcgactgcagcagccccctgaagaacacccccagctag

SEQ ID NO: 91564 - DNA, 2955 bp, Artificial Sequence
  Description of Artificial Sequence: Synthetic coding sequence
atggagaccaagggctaccacagcctgcccgagggcctggacatggagagaagatggggccaggtgagccaggccgtggagagaagcagcctgggccccaccgagagaaccgacgagaacaactacatggagatcgtgaacgtgagctgcgtgagcggcgccatccccaacaacagcacccagggcagcagcaaggagaagcaggagctgctgccctgcctgcagcaggacaacaacagacccggcatcctgaccagcgacatcaagaccgagctggagagcaaggagctgagcgccaccgtggccgagagcatgggcctgtacatggacagcgtgagagacgccgactacagctacgagcagcagaaccagcagggcagcatgagccccgccaagatctaccagaacgtggagcagctggtgaagttctacaagggcaacggccacagacccagcaccctgagctgcgtgaacacccccctgagaagcttcatgagcgacagcggcagcagcgtgaacggcggcgtgatgagagccgtggtgaagagccccatcatgtgccacgagaagagccccagcgtgtgcagccccctgaacatgaccagcagcgtgtgcagccccgccggcatcaacagcgtgagcagcaccaccgccagcttcggcagcttccccgtgcacagccccatcacccagggcacccccctgacctgcagccccaacgtggagaacagaggcagcagaagccacagccccgcccacgccagcaacgtgggcagccccctgagcagccccctgagcagcatgaagagcagcatcagcagcccccccagccactgcagcgtgaagagccccgtgagcagccccaacaacgtgaccctgagaagcagcgtgagcagccccgccaacatcaacaacagcagatgcagcgtgagcagccccagcaacaccaacaacagaagcaccctgagcagccccgccgccagcaccgtgggcagcatctgcagccccgtgaacaacgccttcagctacaccgccagcggcaccagcgccggcagcagcaccctgagagacgtggtgcccagccccgacacccaggagaagggcgcccaggaggtgcccttccccaagaccgaggaggtggagagcgccatcagcaacggcgtgaccggccagctgaacatcgtgcagtacatcaagcccgagcccgacggcgccttcagcagcagctgcctgggcggcaacagcaagatcaacagcgacagcagcttcagcgtgcccatcaagcaggagagcaccaagcacagctgcagcggcaccagcttcaagggcaaccccaccgtgaaccccttccccttcatggacggcagctacttcagcttcatggacgacaaggactactacagcctgagcggcatcctgggcccccccgtgcccggcttcgacggcaactgcgagggcagcggcttccccgtgggcatcaagcaggagcccgacgacggcagctactaccccgaggccagcatccccagcagcgccatcgtgggcgtgaacagcggcggccagagcttccactacagaatcggcgcccagggcaccatcagcctgagcagaagcgccagagaccagagcttccagcacctgagcagcttcccccccgtgaacaccctggtggagagctggaagagccacggcgacctgagcagcagaagaagcgacggctaccccgtgctggagtacatccccgagaacgtgagcagcagcaccctgagaagcgtgagcaccggcagcagcagacccagcaagatctgcctggtgtgcggcgacgaggccagcggctgccactacggcgtggtgacctgcggcagctgcaaggtgttcttcaagagagccgtggagggccagcacaactacctgtgcgccggcagaaacgactgcatcatcgacaagatcagaagaaagaactgccccgcctgcagactgcagaagtgcctgcaggccggcatgaacctgggcgccagaaagagcaagaagctgggcaagctgaagggcatccacgaggagcagccccagcagcagcagcccccccccccccccccccccccccagagccccgaggagggcaccacctacatcgcccccgccaaggagcccagcgtgaacaccgccctggtgccccagctgagcaccatcagcagagccctgacccccagccccgtgatggtgctggagaacatcgagcccgagatcgtgtacgccggctacgacagcagcaagcccgacaccgccgagaacctgctgagcaccctgaacagactggccggcaagcagatgatccaggtggtgaagtgggccaaggtgctgcccggcttcaagaacctgcccctggaggaccagatcaccctgatccagtacagctggatgtgcctgagcagcttcgccctgagctggagaagctacaagcacaccaacagccagttcctgtacttcgcccccgacctggtgttcaacgaggagaagatgcaccagagcgccatgtacgagctgtgccagggcatgcaccagatcagcctgcagttcgtgagactgcagctgaccttcgaggagtacaccatcatgaaggtgctgctgctgctgagcaccatccccaaggacggcctgaagagccaggccgccttcgaggagatgagaaccaactacatcaaggagctgagaaagatggtgaccaagtgccccaacaacagcggccagagctggcagagattctaccagctgaccaagctgctggacagcatgcacgacctggtgagcgacctgctggagttctgcttctacaccttcagagagagccacgccctgaaggtggagttccccgccatgctggtggagatcatcagcgaccagctgcccaaggtggagagcggcaacgccaagcccctgtacttccacagaaagtag

SEQ ID NO: 91565 - DNA, 2967 bp, Artificial Sequence
  Description of Artificial Sequence: Synthetic coding sequence
atggagaccaagggctaccacagcctgcccgagggcctggacatggagagaagatggggccaggtgagccaggccgtggagagaagcagcctgggccccaccgagagaaccgacgagaacaactacatggagatcgtgaacgtgagctgcgtgagcggcgccatccccaacaacagcacccagggcagcagcaaggagaagcaggagctgctgccctgcctgcagcaggacaacaacagacccggcatcctgaccagcgacatcaagaccgagctggagagcaaggagctgagcgccaccgtggccgagagcatgggcctgtacatggacagcgtgagagacgccgactacagctacgagcagcagaaccagcagggcagcatgagccccgccaagatctaccagaacgtggagcagctggtgaagttctacaagggcaacggccacagacccagcaccctgagctgcgtgaacacccccctgagaagcttcatgagcgacagcggcagcagcgtgaacggcggcgtgatgagagccgtggtgaagagccccatcatgtgccacgagaagagccccagcgtgtgcagccccctgaacatgaccagcagcgtgtgcagccccgccggcatcaacagcgtgagcagcaccaccgccagcttcggcagcttccccgtgcacagccccatcacccagggcacccccctgacctgcagccccaacgtggagaacagaggcagcagaagccacagccccgcccacgccagcaacgtgggcagccccctgagcagccccctgagcagcatgaagagcagcatcagcagcccccccagccactgcagcgtgaagagccccgtgagcagccccaacaacgtgaccctgagaagcagcgtgagcagccccgccaacatcaacaacagcagatgcagcgtgagcagccccagcaacaccaacaacagaagcaccctgagcagccccgccgccagcaccgtgggcagcatctgcagccccgtgaacaacgccttcagctacaccgccagcggcaccagcgccggcagcagcaccctgagagacgtggtgcccagccccgacacccaggagaagggcgcccaggaggtgcccttccccaagaccgaggaggtggagagcgccatcagcaacggcgtgaccggccagctgaacatcgtgcagtacatcaagcccgagcccgacggcgccttcagcagcagctgcctgggcggcaacagcaagatcaacagcgacagcagcttcagcgtgcccatcaagcaggagagcaccaagcacagctgcagcggcaccagcttcaagggcaaccccaccgtgaaccccttccccttcatggacggcagctacttcagcttcatggacgacaaggactactacagcctgagcggcatcctgggcccccccgtgcccggcttcgacggcaactgcgagggcagcggcttccccgtgggcatcaagcaggagcccgacgacggcagctactaccccgaggccagcatccccagcagcgccatcgtgggcgtgaacagcggcggccagagcttccactacagaatcggcgcccagggcaccatcagcctgagcagaagcgccagagaccagagcttccagcacctgagcagcttcccccccgtgaacaccctggtggagagctggaagagccacggcgacctgagcagcagaagaagcgacggctaccccgtgctggagtacatccccgagaacgtgagcagcagcaccctgagaagcgtgagcaccggcagcagcagacccagcaagatctgcctggtgtgcggcgacgaggccagcggctgccactacggcgtggtgacctgcggcagctgcaaggtgttcttcaagagagccgtggagggcaagtgcagctggcagcacaactacctgtgcgccggcagaaacgactgcatcatcgacaagatcagaagaaagaactgccccgcctgcagactgcagaagtgcctgcaggccggcatgaacctgggcgccagaaagagcaagaagctgggcaagctgaagggcatccacgaggagcagccccagcagcagcagcccccccccccccccccccccccccagagccccgaggagggcaccacctacatcgcccccgccaaggagcccagcgtgaacaccgccctggtgccccagctgagcaccatcagcagagccctgacccccagccccgtgatggtgctggagaacatcgagcccgagatcgtgtacgccggctacgacagcagcaagcccgacaccgccgagaacctgctgagcaccctgaacagactggccggcaagcagatgatccaggtggtgaagtgggccaaggtgctgcccggcttcaagaacctgcccctggaggaccagatcaccctgatccagtacagctggatgtgcctgagcagcttcgccctgagctggagaagctacaagcacaccaacagccagttcctgtacttcgcccccgacctggtgttcaacgaggagaagatgcaccagagcgccatgtacgagctgtgccagggcatgcaccagatcagcctgcagttcgtgagactgcagctgaccttcgaggagtacaccatcatgaaggtgctgctgctgctgagcaccatccccaaggacggcctgaagagccaggccgccttcgaggagatgagaaccaactacatcaaggagctgagaaagatggtgaccaagtgccccaacaacagcggccagagctggcagagattctaccagctgaccaagctgctggacagcatgcacgacctggtgagcgacctgctggagttctgcttctacaccttcagagagagccacgccctgaaggtggagttccccgccatgctggtggagatcatcagcgaccagctgcccaaggtggagagcggcaacgccaagcccctgtacttccacagaaagtag

SEQ ID NO: 91566 - DNA, 2955 bp, Artificial Sequence; identical to SEQ ID NO: 91564
  Description of Artificial Sequence: Synthetic coding sequence

SEQ ID NO: 91567 - DNA, 2967 bp, Artificial Sequence; identical to SEQ ID NO: 91565
  Description of Artificial Sequence: Synthetic coding sequence

SEQ ID NO: 91568 - DNA, 2604 bp, Artificial Sequence
  Description of Artificial Sequence: Synthetic coding sequence
atggagaccaagggctaccacagcctgcccgagggcctggacatggagagaagatggggccaggtgagccaggccgtggagagaagcagcctgggccccaccgagagaaccgacgagaacaactacatggagatcgtgaacgtgagctgcgtgagcggcgccatccccaacaacagcacccagggcagcagcaaggagaagcaggagctgctgccctgcctgcagcaggacaacaacagacccggcatcctgaccagcgacatcaagaccgagctggagagcaaggagctgagcgccaccgtggccgagagcatgggcctgtacatggacagcgtgagagacgccgactacagctacgagcagcagaaccagcagggcagcatgagccccgccaagatctaccagaacgtggagcagctggtgaagttctacaagggcaacggccacagacccagcaccctgagctgcgtgaacacccccctgagaagcttcatgagcgacagcggcagcagcgtgaacggcggcgtgatgagagccgtggtgaagagccccatcatgtgccacgagaagagccccagcgtgtgcagccccctgaacatgaccagcagcgtgtgcagccccgccggcatcaacagcgtgagcagcaccaccgccagcttcggcagcttccccgtgcacagccccatcacccagggcacccccctgacctgcagccccaacgtggagaacagaggcagcagaagccacagccccgcccacgccagcaacgtgggcagccccctgagcagccccctgagcagcatgaagagcagcatcagcagcccccccagccactgcagcgtgaagagccccgtgagcagccccaacaacgtgaccctgagaagcagcgtgagcagccccgccaacatcaacaacagcagatgcagcgtgagcagccccagcaacaccaacaacagaagcaccctgagcagccccgccgccagcaccgtgggcagcatctgcagccccgtgaacaacgccttcagctacaccgccagcggcaccagcgccggcagcagcaccctgagagacgtggtgcccagccccgacacccaggagaagggcgcccaggaggtgcccttccccaagaccgaggaggtggagagcgccatcagcaacggcgtgaccggccagctgaacatcgtgcagtacatcaagcccgagcccgacggcgccttcagcagcagctgcctgggcggcaacagcaagatcaacagcgacagcagcttcagcgtgcccatcaagcaggagagcaccaagcacagctgcagcggcaccagcttcaagggcaaccccaccgtgaaccccttccccttcatggacggcagctacttcagcttcatggacgacaaggactactacagcctgagcggcatcctgggcccccccgtgcccggcttcgacggcaactgcgagggcagcggcttccccgtgggcatcaagcaggagcccgacgacggcagctactaccccgaggccagcatccccagcagcgccatcgtgggcgtgaacagcggcggccagagcttccactacagaatcggcgcccagggcaccatcagcctgagcagaagcgccagagaccagagcttccagcacctgagcagcttcccccccgtgaacaccctggtggagagctggaagagccacggcgacctgagcagcagaagaagcgacggctaccccgtgctggagtacatccccgagaacgtgagcagcagcaccctgagaagcgtgagcaccggcagcagcagacccagcaagatctgcctggtgtgcggcgacgaggccagcggctgccactacggcgtggtgacctgcggcagctgcaaggtgttcttcaagagagccgtggagggccagcacaactacctgtgcgccggcagaaacgactgcatcatcgacaagatcagaagaaagaactgccccgcctgcagactgcagaagtgcctgcaggccggcatgaacctgggcggcttcaagaacctgcccctggaggaccagatcaccctgatccagtacagctggatgtgcctgagcagcttcgccctgagctggagaagctacaagcacaccaacagccagttcctgtacttcgcccccgacctggtgttcaacgaggagaagatgcaccagagcgccatgtacgagctgtgccagggcatgcaccagatcagcctgcagttcgtgagactgcagctgaccttcgaggagtacaccatcatgaaggtgctgctgctgctgagcaccatccccaaggacggcctgaagagccaggccgccttcgaggagatgagaaccaactacatcaaggagctgagaaagatggtgaccaagtgccccaacaacagcggccagagctggcagagattctaccagctgaccaagctgctggacagcatgcacgacctggtgagcgacctgctggagttctgcttctacaccttcagagagagccacgccctgaaggtggagttccccgccatgctggtggagatcatcagcgaccagctgcccaaggtggagagcggcaacgccaagcccctgtacttccacagaaagtag

SEQ ID NO: 91569 - DNA, 1920 bp, Artificial Sequence
  Description of Artificial Sequence: Synthetic coding sequence
atggagaccaagggctaccacagcctgcccgagggcctggacatggagagaagatggggccaggtgagccaggccgtggagagaagcagcctgggccccaccgagagaaccgacgagaacaactacatggagatcgtgaacgtgagctgcgtgagcggcgccatccccaacaacagcacccagggcagcagcaaggagaagcaggagctgctgccctgcctgcagcaggacaacaacagacccggcatcctgaccagcgacatcaagaccgagctggagagcaaggagctgagcgccaccgtggccgagagcatgggcctgtacatggacagcgtgagagacgccgactacagctacgagcagcagaaccagcagggcagcatgagccccgccaagatctaccagaacgtggagcagctggtgaagttctacaagggcaacggccacagacccagcaccctgagctgcgtgaacacccccctgagaagcttcatgagcgacagcggcagcagcgtgaacggcggcgtgatgagagccgtggtgaagagccccatcatgtgccacgagaagagccccagcgtgtgcagccccctgaacatgaccagcagcgtgtgcagccccgccggcatcaacagcgtgagcagcaccaccgccagcttcggcagcttccccgtgcacagccccatcacccagggcacccccctgacctgcagccccaacgtggagaacagaggcagcagaagccacagccccgcccacgccagcaacgtgggcagccccctgagcagccccctgagcagcatgaagagcagcatcagcagcccccccagccactgcagcgtgaagagccccgtgagcagccccaacaacgtgaccctgagaagcagcgtgagcagccccgccaacatcaacaacagcagatgcagcgtgagcagccccagcaacaccaacaacagaagcaccctgagcagccccgccgccagcaccgtgggcagcatctgcagccccgtgaacaacgccttcagctacaccgccagcggcaccagcgccggcagcagcaccctgagagacgtggtgcccagccccgacacccaggagaagggcgcccaggaggtgcccttccccaagaccgaggaggtggagagcgccatcagcaacggcgtgaccggccagctgaacatcgtgcagtacatcaagcccgagcccgacggcgccttcagcagcagctgcctgggcggcaacagcaagatcaacagcgacagcagcttcagcgtgcccatcaagcaggagagcaccaagcacagctgcagcggcaccagcttcaagggcaaccccaccgtgaaccccttccccttcatggacggcagctacttcagcttcatggacgacaaggactactacagcctgagcggcatcctgggcccccccgtgcccggcttcgacggcaactgcgagggcagcggcttccccgtgggcatcaagcaggagcccgacgacggcagctactaccccgaggccagcatccccagcagcgccatcgtgggcgtgaacagcggcggccagagcttccactacagaatcggcgcccagggcaccatcagcctgagcagaagcgccagagaccagagcttccagcacctgagcagcttcccccccgtgaacaccctggtggagagctggaagagccacggcgacctgagcagcagaagaagcgacggctaccccgtgctggagtacatccccgagaacgtgagcagcagcaccctgagaagcgtgagcaccggcagcagcagacccagcaagaagaacatctacagattcctgctgtgcaacaacagaaccagaggcgtgggccagcagctgcccctgagccccagaagcagcaccgtgttctgcatcaccggcatccacaccagatag

SEQ ID NO: 91570 - DNA, 1797 bp, Artificial Sequence
  Description of Artificial Sequence: Synthetic coding sequence
atgccctgcatccaggcccagtacggcacccccgcccccagccccggccccagagaccacctggccagcgaccccctgacccccgagttcatcaagcccaccatggacctggccagccccgaggccgcccccgccgcccccaccgccctgcccagcttcagcaccttcatggacggctacaccggcgagttcgacaccttcctgtaccagctgcccggcaccgtgcagccctgcagcagcgccagcagcagcgccagcagcaccagcagcagcagcgccaccagccccgccagcgccagcttcaagttcgaggacttccaggtgtacggctgctaccccggccccctgagcggccccgtggacgaggccctgagcagcagcggcagcgactactacggcagcccctgcagcgcccccagccccagcacccccagcttccagcccccccagctgagcccctgggacggcagcttcggccacttcagccccagccagacctacgagggcctgagagcctggaccgagcagctgcccaaggccagcggccccccccagccccccgccttcttcagcttcagcccccccaccggccccagccccagcctggcccagagccccctgaagctgttccccagccaggccacccaccagctgggcgagggcgagagctacagcatgcccaccgccttccccggcctggcccccaccagcccccacctggagggcagcggcatcctggacacccccgtgaccagcaccaaggccagaagcggcgcccccggcggcagcgagggcagatgcgccgtgtgcggcgacaacgccagctgccagcactacggcgtgagaacctgcgagggctgcaagggcttcttcaagagaaccgtgcagaagaacgccaagtacatctgcctggccaacaaggactgccccgtggacaagagaagaagaaacagatgccagttctgcagattccagaagtgcctggccgtgggcatggtgaaggaggtggtgagaaccgacagcctgaagggcagaagaggcagactgcccagcaagcccaagcagccccccgacgccagccccgccaacctgctgaccagcctggtgagagcccacctggacagcggccccagcaccgccaagctggactacagcaagttccaggagctggtgctgccccacttcggcaaggaggacgccggcgacgtgcagcagttctacgacctgctgagcggcagcctggaggtgatcagaaagtgggccgagaagatccccggcttcgccgagctgagccccgccgaccaggacctgctgctggagagcgccttcctggagctgttcatcctgagactggcctacagaagcaagcccggcgagggcaagctgatcttctgcagcggcctggtgctgcacagactgcagtgcgccagaggcttcggcgactggatcgacagcatcctggccttcagcagaagcctgcacagcctgctggtggacgtgcccgccttcgcctgcctgagcgccctggtgctgatcaccgacagacacggcctgcaggagcccagaagagtggaggagctgcagaacagaatcgccagctgcctgaaggagcacgtggccgccgtggccggcgagccccagcccgccagctgcctgagcagactgctgggcaagctgcccgagctgagaaccctgtgcacccagggcctgcagagaatcttctacctgaagctggaggacctggtgccccccccccccatcatcgacaagatcttcatggacaccctgcccttctag

SEQ ID NO: 91571 - DNA, 1836 bp, Artificial Sequence
  Description of Artificial Sequence: Synthetic coding sequence
atgtggctggccaaggcctgctggagcatccagagcgagatgccctgcatccaggcccagtacggcacccccgcccccagccccggccccagagaccacctggccagcgaccccctgacccccgagttcatcaagcccaccatggacctggccagccccgaggccgcccccgccgcccccaccgccctgcccagcttcagcaccttcatggacggctacaccggcgagttcgacaccttcctgtaccagctgcccggcaccgtgcagccctgcagcagcgccagcagcagcgccagcagcaccagcagcagcagcgccaccagccccgccagcgccagcttcaagttcgaggacttccaggtgtacggctgctaccccggccccctgagcggccccgtggacgaggccctgagcagcagcggcagcgactactacggcagcccctgcagcgcccccagccccagcacccccagcttccagcccccccagctgagcccctgggacggcagcttcggccacttcagccccagccagacctacgagggcctgagagcctggaccgagcagctgcccaaggccagcggccccccccagccccccgccttcttcagcttcagcccccccaccggccccagccccagcctggcccagagccccctgaagctgttccccagccaggccacccaccagctgggcgagggcgagagctacagcatgcccaccgccttccccggcctggcccccaccagcccccacctggagggcagcggcatcctggacacccccgtgaccagcaccaaggccagaagcggcgcccccggcggcagcgagggcagatgcgccgtgtgcggcgacaacgccagctgccagcactacggcgtgagaacctgcgagggctgcaagggcttcttcaagagaaccgtgcagaagaacgccaagtacatctgcctggccaacaaggactgccccgtggacaagagaagaagaaacagatgccagttctgcagattccagaagtgcctggccgtgggcatggtgaaggaggtggtgagaaccgacagcctgaagggcagaagaggcagactgcccagcaagcccaagcagccccccgacgccagccccgccaacctgctgaccagcctggtgagagcccacctggacagcggccccagcaccgccaagctggactacagcaagttccaggagctggtgctgccccacttcggcaaggaggacgccggcgacgtgcagcagttctacgacctgctgagcggcagcctggaggtgatcagaaagtgggccgagaagatccccggcttcgccgagctgagccccgccgaccaggacctgctgctggagagcgccttcctggagctgttcatcctgagactggcctacagaagcaagcccggcgagggcaagctgatcttctgcagcggcctggtgctgcacagactgcagtgcgccagaggcttcggcgactggatcgacagcatcctggccttcagcagaagcctgcacagcctgctggtggacgtgcccgccttcgcctgcctgagcgccctggtgctgatcaccgacagacacggcctgcaggagcccagaagagtggaggagctgcagaacagaatcgccagctgcctgaaggagcacgtggccgccgtggccggcgagccccagcccgccagctgcctgagcagactgctgggcaagctgcccgagctgagaaccctgtgcacccagggcctgcagagaatcttctacctgaagctggaggacctggtgccccccccccccatcatcgacaagatcttcatggacaccctgcccttctag

SEQ ID NO: 91572 - DNA, 1797 bp, Artificial Sequence; identical to SEQ ID NO: 91570
  Description of Artificial Sequence: Synthetic coding sequence

SEQ ID NO: 91573 - DNA, 1797 bp, Artificial Sequence; identical to SEQ ID NO: 91570
  Description of Artificial Sequence: Synthetic coding sequence

SEQ ID NO: 91574 - DNA, 1959 bp, Artificial Sequence
  Description of Artificial Sequence: Synthetic coding sequence
atgaccagcgcccagtacaagatcaagatcctgatcgagggcctgcaccacggccagagacccggccccgccccccccagacagcccggcagcttctgctgggccctgaaggccgacggcatcatgtggctggccaaggcctgctggagcatccagagcgagatgccctgcatccaggcccagtacggcacccccgcccccagccccggccccagagaccacctggccagcgaccccctgacccccgagttcatcaagcccaccatggacctggccagccccgaggccgcccccgccgcccccaccgccctgcccagcttcagcaccttcatggacggctacaccggcgagttcgacaccttcctgtaccagctgcccggcaccgtgcagccctgcagcagcgccagcagcagcgccagcagcaccagcagcagcagcgccaccagccccgccagcgccagcttcaagttcgaggacttccaggtgtacggctgctaccccggccccctgagcggccccgtggacgaggccctgagcagcagcggcagcgactactacggcagcccctgcagcgcccccagccccagcacccccagcttccagcccccccagctgagcccctgggacggcagcttcggccacttcagccccagccagacctacgagggcctgagagcctggaccgagcagctgcccaaggccagcggccccccccagccccccgccttcttcagcttcagcccccccaccggccccagccccagcctggcccagagccccctgaagctgttccccagccaggccacccaccagctgggcgagggcgagagctacagcatgcccaccgccttccccggcctggcccccaccagcccccacctggagggcagcggcatcctggacacccccgtgaccagcaccaaggccagaagcggcgcccccggcggcagcgagggcagatgcgccgtgtgcggcgacaacgccagctgccagcactacggcgtgagaacctgcgagggctgcaagggcttcttcaagagaaccgtgcagaagaacgccaagtacatctgcctggccaacaaggactgccccgtggacaagagaagaagaaacagatgccagttctgcagattccagaagtgcctggccgtgggcatggtgaaggaggtggtgagaaccgacagcctgaagggcagaagaggcagactgcccagcaagcccaagcagccccccgacgccagccccgccaacctgctgaccagcctggtgagagcccacctggacagcggccccagcaccgccaagctggactacagcaagttccaggagctggtgctgccccacttcggcaaggaggacgccggcgacgtgcagcagttctacgacctgctgagcggcagcctggaggtgatcagaaagtgggccgagaagatccccggcttcgccgagctgagccccgccgaccaggacctgctgctggagagcgccttcctggagctgttcatcctgagactggcctacagaagcaagcccggcgagggcaagctgatcttctgcagcggcctggtgctgcacagactgcagtgcgccagaggcttcggcgactggatcgacagcatcctggccttcagcagaagcctgcacagcctgctggtggacgtgcccgccttcgcctgcctgagcgccctggtgctgatcaccgacagacacggcctgcaggagcccagaagagtggaggagctgcagaacagaatcgccagctgcctgaaggagcacgtggccgccgtggccggcgagccccagcccgccagctgcctgagcagactgctgggcaagctgcccgagctgagaaccctgtgcacccagggcctgcagagaatcttctacctgaagctggaggacctggtgccccccccccccatcatcgacaagatcttcatggacaccctgcccttctag

SEQ ID NO: 91575 - DNA, 978 bp, Artificial Sequence
  Description of Artificial Sequence: Synthetic coding sequence
atgccctgcatccaggcccagtacggcacccccgcccccagccccggccccagagaccacctggccagcgaccccctgacccccgagttcatcaagcccaccatggacctggccagccccgaggccgcccccgccgcccccaccgccctgcccagcttcagcaccttcatggacggctacaccggcgagttcgacaccttcctgtaccagctgcccggcaccgtgcagccctgcagcagcgccagcagcagcgccagcagcaccagcagcagcagcgccaccagccccgccagcgccagcttcaagttcgaggacttccaggtgtacggctgctaccccggccccctgagcggccccgtggacgaggccctgagcagcagcggcagcgactactacggcagcccctgcagcgcccccagccccagcacccccagcttccagcccccccagctgagcccctgggacggcagcttcggccacttcagccccagccagacctacgagggcctgagagcctggaccgagcagctgcccaaggccagcggccccccccagccccccgccttcttcagcttcagcccccccaccggccccagccccagcctggcccagagccccctgaagctgttccccagccaggccacccaccagctgggcgagggcgagagctacagcatgcccaccgccttccccggcctggcccccaccagcccccacctggagggcagcggcatcctggacacccccgtgaccagcaccaaggccagaagcggcgcccccggcggcagcgagggcagatgcgccgtgtgcggcgacaacgccagctgccagcactacggcgtgagaacctgcgagggctgcaagggcttcttcaaggtgcccagaagccccagatggggcctgctgctggagatggagagaggctggccccaccccatcggcacctgcggcctgcccctgggcagcccccccagctag

SEQ ID NO: 91576 - DNA, 1836 bp, Artificial Sequence; identical to SEQ ID NO: 91571
  Description of Artificial Sequence: Synthetic coding sequence

SEQ ID NO: 91577 - DNA, 1797 bp, Artificial Sequence
  Description of Artificial Sequence: Synthetic coding sequence
atgccctgcgtgcaggcccagtacggcagcagcccccagggcgccagccccgccagccagagctacagctaccacagcagcggcgagtacagcagcgacttcctgacccccgagttcgtgaagttcagcatggacctgaccaacaccgagatcaccgccaccaccagcctgcccagcttcagcaccttcatggacaactacagcaccggctacgacgtgaagcccccctgcctgtaccagatgcccctgagcggccagcagagcagcatcaaggtggaggacatccagatgcacaactaccagcagcacagccacctgcccccccagagcgaggagatgatgccccacagcggcagcgtgtactacaagcccagcagcccccccacccccaccacccccggcttccaggtgcagcacagccccatgtgggacgaccccggcagcctgcacaacttccaccagaactacgtggccaccacccacatgatcgagcagagaaagacccccgtgagcagactgagcctgttcagcttcaagcagagcccccccggcacccccgtgagcagctgccagatgagattcgacggccccctgcacgtgcccatgaaccccgagcccgccggcagccaccacgtggtggacggccagaccttcgccgtgcccaaccccatcagaaagcccgccagcatgggcttccccggcctgcagatcggccacgccagccagctgctggacacccaggtgcccagcccccccagcagaggcagccccagcaacgagggcctgtgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctggccgtgggcatggtgaaggaggtggtgagaaccgacagcctgaagggcagaagaggcagactgcccagcaagcccaagagcccccaggagcccagcccccccagcccccccgtgagcctgatcagcgccctggtgagagcccacgtggacagcaaccccgccatgaccagcctggactacagcagattccaggccaaccccgactaccagatgagcggcgacgacacccagcacatccagcagttctacgacctgctgaccggcagcatggagatcatcagaggctgggccgagaagatccccggcttcgccgacctgcccaaggccgaccaggacctgctgttcgagagcgccttcctggagctgttcgtgctgagactggcctacagaagcaaccccgtggagggcaagctgatcttctgcaacggcgtggtgctgcacagactgcagtgcgtgagaggcttcggcgagtggatcgacagcatcgtggagttcagcagcaacctgcagaacatgaacatcgacatcagcgccttcagctgcatcgccgccctggccatggtgaccgagagacacggcctgaaggagcccaagagagtggaggagctgcagaacaagatcgtgaactgcctgaaggaccacgtgaccttcaacaacggcggcctgaacagacccaactacctgagcaagctgctgggcaagctgcccgagctgagaaccctgtgcacccagggcctgcagagaatcttctacctgaagctggaggacctggtgcccccccccgccatcatcgacaagctgttcctggacaccctgcccttctag

SEQ ID NO: 91578 - DNA, 1797 bp, Artificial Sequence; identical to SEQ ID NO: 91577
  Description of Artificial Sequence: Synthetic coding sequence

SEQ ID NO: 91579 - DNA, 1179 bp, Artificial Sequence
  Description of Artificial Sequence: Synthetic coding sequence
atggacaactacagcaccggctacgacgtgaagcccccctgcctgtaccagatgcccctgagcggccagcagagcagcatcaaggtggaggacatccagatgcacaactaccagcagcacagccacctgcccccccagagcgaggagatgatgccccacagcggcagcgtgtactacaagcccagcagcccccccacccccaccacccccggcttccaggtgcagcacagccccatgtgggacgaccccggcagcctgcacaacttccaccagaactacgtggccaccacccacatgatcgagcagagaaagacccccgtgagcagactgagcctgttcagcttcaagcagagcccccccggcacccccgtgagcagctgccagatgagattcgacggccccctgcacgtgcccatgaaccccgagcccgccggcagccaccacgtggtggacggccagaccttcgccgtgcccaaccccatcagaaagcccgccagcatgggcttccccggcctgcagatcggccacgccagccagctgctggacacccaggtgcccagcccccccagcagaggcagccccagcaacgagggcctgtgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctggccgtgggcatggtgaaggaggtggtgagaaccgacagcctgaagggcagaagaggcagactgcccagcaagcccaagagcccccaggagcccagcccccccagcccccccgtgagcctgatcagcgccctggtgagagcccacgtggacagcaaccccgccatgaccagcctggactacagcagattccaggccaaccccgactaccagatgagcggcgacgacacccagcacatccagcagttctacgacctgctgaccggcagcatggagatcatcagaggctgggccgagaagatccccggcttcgccgacctgcccaaggccgaccaggacctgctgttcgagagcgccttcctggagctgttcgtgctgagactggcctacagaatctag

SEQ ID NO: 91580 - DNA, 1179 bp, Artificial Sequence; identical to SEQ ID NO: 91579
  Description of Artificial Sequence: Synthetic coding sequence

SEQ ID NO: 91581 - DNA, 777 bp, Artificial Sequence
  Description of Artificial Sequence: Synthetic coding sequence
atgccctgcgtgcaggcccagtacggcagcagcccccagggcgccagccccgccagccagagctacagctaccacagcagcggcgagtacagcagcgacttcctgacccccgagttcgtgaagttcagcatggacctgaccaacaccgagatcaccgccaccaccagcctgcccagcttcagcaccttcatggacaactacagcaccggctacgacgtgaagcccccctgcctgtaccagatgcccctgagcggccagcagagcagcatcaaggtggaggacatccagatgcacaactaccagcagcacagccacctgcccccccagagcgaggagatgatgccccacagcggcagcgtgtactacaagcccagcagcccccccacccccaccacccccggcttccaggtgcagcacagccccatgtgggacgaccccggcagcctgcacaacttccaccagaactacgtggccaccacccacatgatcgagcagagaaagacccccgtgagcagactgagcctgttcagcttcaagcagagcccccccggcacccccgtgagcagctgccagatgagattcgacggccccctgcacgtgcccatgaaccccgagcccgccggcagccaccacgtggtggacggccagaccttcgccgtgcccaaccccatcagaaagcccgccagcatgggcttccccggcctgcagatcggccacgccagccagctgctggacacccaggtgcccagcccccccagcagaggcagccccagctag

SEQ ID NO: 91582 - DNA, 1608 bp, Artificial Sequence
  Description of Artificial Sequence: Synthetic coding sequence
atggacaactacagcaccggctacgacgtgaagcccccctgcctgtaccagatgcccctgagcggccagcagagcagcatcaaggtggaggacatccagatgcacaactaccagcagcacagccacctgcccccccagagcgaggagatgatgccccacagcggcagcgtgtactacaagcccagcagcccccccacccccaccacccccggcttccaggtgcagcacagccccatgtgggacgaccccggcagcctgcacaacttccaccagaactacgtggccaccacccacatgatcgagcagagaaagacccccgtgagcagactgagcctgttcagcttcaagcagagcccccccggcacccccgtgagcagctgccagatgagattcgacggccccctgcacgtgcccatgaaccccgagcccgccggcagccaccacgtggtggacggccagaccttcgccgtgcccaaccccatcagaaagcccgccagcatgggcttccccggcctgcagatcggccacgccagccagctgctggacacccaggtgcccagcccccccagcagaggcagccccagcaacgagggcctgtgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctggccgtgggcatggtgaaggaggtggtgagaaccgacagcctgaagggcagaagaggcagactgcccagcaagcccaagagcccccaggagcccagcccccccagcccccccgtgagcctgatcagcgccctggtgagagcccacgtggacagcaaccccgccatgaccagcctggactacagcagattccaggccaaccccgactaccagatgagcggcgacgacacccagcacatccagcagttctacgacctgctgaccggcagcatggagatcatcagaggctgggccgagaagatccccggcttcgccgacctgcccaaggccgaccaggacctgctgttcgagagcgccttcctggagctgttcgtgctgagactggcctacagaagcaaccccgtggagggcaagctgatcttctgcaacggcgtggtgctgcacagactgcagtgcgtgagaggcttcggcgagtggatcgacagcatcgtggagttcagcagcaacctgcagaacatgaacatcgacatcagcgccttcagctgcatcgccgccctggccatggtgaccgagagacacggcctgaaggagcccaagagagtggaggagctgcagaacaagatcgtgaactgcctgaaggaccacgtgaccttcaacaacggcggcctgaacagacccaactacctgagcaagctgctgggcaagctgcccgagctgagaaccctgtgcacccagggcctgcagagaatcttctacctgaagctggaggacctggtgcccccccccgccatcatcgacaagctgttcctggacaccctgcccttctag

SEQ ID NO: 91583 - DNA, 1830 bp, Artificial Sequence
  Description of Artificial Sequence: Synthetic coding sequence
atgaacgaggacagaagaggcgagctgctgaccatgccctgcgtgcaggcccagtacggcagcagcccccagggcgccagccccgccagccagagctacagctaccacagcagcggcgagtacagcagcgacttcctgacccccgagttcgtgaagttcagcatggacctgaccaacaccgagatcaccgccaccaccagcctgcccagcttcagcaccttcatggacaactacagcaccggctacgacgtgaagcccccctgcctgtaccagatgcccctgagcggccagcagagcagcatcaaggtggaggacatccagatgcacaactaccagcagcacagccacctgcccccccagagcgaggagatgatgccccacagcggcagcgtgtactacaagcccagcagcccccccacccccaccacccccggcttccaggtgcagcacagccccatgtgggacgaccccggcagcctgcacaacttccaccagaactacgtggccaccacccacatgatcgagcagagaaagacccccgtgagcagactgagcctgttcagcttcaagcagagcccccccggcacccccgtgagcagctgccagatgagattcgacggccccctgcacgtgcccatgaaccccgagcccgccggcagccaccacgtggtggacggccagaccttcgccgtgcccaaccccatcagaaagcccgccagcatgggcttccccggcctgcagatcggccacgccagccagctgctggacacccaggtgcccagcccccccagcagaggcagccccagcaacgagggcctgtgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctggccgtgggcatggtgaaggaggtggtgagaaccgacagcctgaagggcagaagaggcagactgcccagcaagcccaagagcccccaggagcccagcccccccagcccccccgtgagcctgatcagcgccctggtgagagcccacgtggacagcaaccccgccatgaccagcctggactacagcagattccaggccaaccccgactaccagatgagcggcgacgacacccagcacatccagcagttctacgacctgctgaccggcagcatggagatcatcagaggctgggccgagaagatccccggcttcgccgacctgcccaaggccgaccaggacctgctgttcgagagcgccttcctggagctgttcgtgctgagactggcctacagaagcaaccccgtggagggcaagctgatcttctgcaacggcgtggtgctgcacagactgcagtgcgtgagaggcttcggcgagtggatcgacagcatcgtggagttcagcagcaacctgcagaacatgaacatcgacatcagcgccttcagctgcatcgccgccctggccatggtgaccgagagacacggcctgaaggagcccaagagagtggaggagctgcagaacaagatcgtgaactgcctgaaggaccacgtgaccttcaacaacggcggcctgaacagacccaactacctgagcaagctgctgggcaagctgcccgagctgagaaccctgtgcacccagggcctgcagagaatcttctacctgaagctggaggacctggtgcccccccccgccatcatcgacaagctgttcctggacaccctgcccttctag

SEQ ID NO: 91584 - DNA, 738 bp, Artificial Sequence
  Description of Artificial Sequence: Synthetic coding sequence
gtggaggaggagggcgacgtgagcaacagaggcgtggagctgctgcagctggagcccgacgaggaccaggtgagagccagaatcctgggctgcctgcaggagcccaccaagagcagacccgaccagcccgccgccttcggcctgctgtgcagaatggccgaccagaccttcatcagcatcgtggactgggccagaagatgcatggtgttcaaggagctggaggtggccgaccagatgaccctgctgcagaactgctggagcgagctgctggtgttcgaccacatctacagacaggtgcagcacggcaaggagggcagcatcctgctggtgaccggccaggaggtggagctgaccaccgtggccacccaggccggcagcctgctgcacagcctggtgctgagagcccaggagctggtgctgcagctgctggccctgcagctggacagacaggagttcgtgtgcctgaagttcatcatcctgttcagcctggacctgaagttcctgaacaaccacatcctggtgaaggacgcccaggagaaggccaacgccgccctgctggactacaccctgtgccactacccccactgcggcgacaagttccagcagctgctgctgtgcctggtggaggtgagagccctgagcatgcaggccaaggagtacctgtaccacaagcacctgggcaacgagatgcccagaaacaacctgctgatcgagatgctgcaggccaagcagacctag

SEQ ID NO: 91585 - DNA, 1386 bp, Artificial Sequence
  Description of Artificial Sequence: Synthetic coding sequence
atggactacagctacgacgaggacctggacgagctgtgccccgtgtgcggcgacaaggtgagcggctaccactacggcctgctgacctgcgagagctgcaagggcttcttcaagagaaccgtgcagaacaacaagcactacacctgcaccgagagccagagctgcaagatcgacaagacccagagaaagagatgccccttctgcagattccagaagtgcctgaccgtgggcatgagactggaggccgtgagagccgacagaatgagaggcggcagaaacaagttcggccccatgtacaagagagacagagccctgaagcagcagaagaaggcccagatcagagccaacggcttcaagctggagaccggcccccccatgggcgtgccccccccccccccccccgcccccgactacgtgctgccccccagcctgcacggccccgagcccaagggcctggccgccggcccccccgccggccccctgggcgacttcggcgcccccgccctgcccatggccgtgcccggcgcccacggccccctggccggctacctgtaccccgccttccccggcagagccatcaagagcgagtaccccgagccctacgccagccccccccagcccggcctgccctacggctaccccgagcccttcagcggcggccccaacgtgcccgagctgatcctgcagctgctgcagctggagcccgacgaggaccaggtgagagccagaatcctgggctgcctgcaggagcccaccaagagcagacccgaccagcccgccgccttcggcctgctgtgcagaatggccgaccagaccttcatcagcatcgtggactgggccagaagatgcatggtgttcaaggagctggaggtggccgaccagatgaccctgctgcagaactgctggagcgagctgctggtgttcgaccacatctacagacaggtgcagcacggcaaggagggcagcatcctgctggtgaccggccaggaggtggagctgaccaccgtggccacccaggccggcagcctgctgcacagcctggtgctgagagcccaggagctggtgctgcagctgctggccctgcagctggacagacaggagttcgtgtgcctgaagttcatcatcctgttcagcctggacctgaagttcctgaacaaccacatcctggtgaaggacgcccaggagaaggccaacgccgccctgctggactacaccctgtgccactacccccactgcggcgacaagttccagcagctgctgctgtgcctggtggaggtgagagccctgagcatgcaggccaaggagtacctgtaccacaagcacctgggcaacgagatgcccagaaacaacctgctgatcgagatgctgcaggccaagcagacctag

SEQ ID NO: 91586 - DNA, 537 bp, Artificial Sequence
  Description of Artificial Sequence: Synthetic coding sequence
atggactacagctacgacgaggacctggacgagctgtgccccgtgtgcggcgacaaggtgagcggctaccactacggcctgctgacctgcgagagctgcaagggcttcttcaagagaaccgtgcagaacaacaagcactacacctgcaccgagagccagagctgcaagatcgacaagacccagagaaagagatgccccttctgcagattccagaagtgcctgaccgtgggcatgagactggaggccgtgagagccgacagaatgagaggcggcagaaacaagttcggccccatgtacaagagagacagagccctgaagcagcagaagaaggcccagatcagagccaacggcttcaagctggagaccggcccccccatgggcgtgccccccccccccccccccgcccccgactacgtgctgccccccagcctgcacggccccgagcccaagggcctggccgccggcccccccgccggccccctgggcgacttcggcgcccccgccctgcccatggccgtgcccggcgcccacggctag

SEQ ID NO: 91587 - DNA, 972 bp, Artificial Sequence
  Description of Artificial Sequence: Synthetic coding sequence
gacctggaggagctgtgccccgtgtgcggcgacaaggtgagcggctaccactacggcctgctgacctgcgagagctgcaagggcttcttcaagagaaccgtgcagaacaacaagagatacacctgcatcgagaaccagaactgccagatcgacaagacccagagaaagagatgcccctactgcagattccagaagtgcctgagcgtgggcatgaagctggaggccgtgagagccgacagaatgagaggcggcagaaacaagttcggccccatgtacaagagagacagagccctgaagcagcagaagaaggccctgatcagagccaacggcctgaagctggaggccatgagccaggtgatccaggccatgcccagcgacctgaccatcagcagcgccatccagaacatccacagcgccagcaagggcctgcccctgaaccacgccgccctgccccccaccgactacgacagaagccccttcgtgaccagccccatcagcatgaccatgcccccccacggcagcctgcagggctaccagacctacggccacttccccagcagagccatcaagagcgagtaccccgacccctacaccagcagccccgagagcatcatgggctacagctacatggacagctaccagaccagcagccccgccagcatcccccacctgatcctggagctgctgaagtgcgagcccgacgagccccaggtgcaggccaagatcatggcctacctgcagcaggagcaggccaacagaagcaagcacgagaagctgagcaccttcggcctgatgtgcaagatggccgaccagaccctgttcagcatcgtggagtgggccagaagcagcatcttcttcagagagctgaagggcctgaccctgagccccagcctggagtgcagcggcagctggctgatggccaccagcaccagctgcatccaggtgatcagactgccccagccccccgagtag

SEQ ID NO: 91588 - DNA, 1488 bp, Artificial Sequence
  Description of Artificial Sequence: Synthetic coding sequence
atgagcagcaacagcgacaccggcgacctgcaggagagcctgaagcacggcctgacccccatcgtgagccagttcaagatggtgaactacagctacgacgaggacctggaggagctgtgccccgtgtgcggcgacaaggtgagcggctaccactacggcctgctgacctgcgagagctgcaagggcttcttcaagagaaccgtgcagaacaacaagagatacacctgcatcgagaaccagaactgccagatcgacaagacccagagaaagagatgcccctactgcagattccagaagtgcctgagcgtgggcatgaagctggaggccgtgagagccgacagaatgagaggcggcagaaacaagttcggccccatgtacaagagagacagagccctgaagcagcagaagaaggccctgatcagagccaacggcctgaagctggaggccatgagccaggtgatccaggccatgcccagcgacctgaccatcagcagcgccatccagaacatccacagcgccagcaagggcctgcccctgaaccacgccgccctgccccccaccgactacgacagaagccccttcgtgaccagccccatcagcatgaccatgcccccccacggcagcctgcagggctaccagacctacggccacttccccagcagagccatcaagagcgagtaccccgacccctacaccagcagccccgagagcatcatgggctacagctacatggacagctaccagaccagcagccccgccagcatcccccacctgatcctggagctgctgaagtgcgagcccgacgagccccaggtgcaggccaagatcatggcctacctgcagcaggagcaggccaacagaagcaagcacgagaagctgagcaccttcggcctgatgtgcaagatggccgaccagaccctgttcagcatcgtggagtgggccagaagcagcatcttcttcagagagctgaaggtggacgaccagatgaagctgctgcagaactgctggagcgagctgctgatcctggaccacatctacagacaggtggtgcacggcaaggagggcagcatcttcctggtgaccggccagcaggtggactacagcatcatcgccagccaggccggcgccaccctgaacaacctgatgagccacgcccaggagctggtggccaagctgagaagcctgcagttcgaccagagagagttcgtgtgcctgaagttcctggtgctgttcagcctggacgtgaagaacctggagaacttccagctggtggagggcgtgcaggagcaggtgaacgccgccctgctggactacaccatgtgcaactacccccagcagaccgagaagttcggccagctgctgctgagactgcccgagatcagagccatcagcatgcaggccgaggagtacctgtactacaagcacctgaacggcgacgtgccctacaacaacctgctgatcgagatgctgcacgccaagagagcctag

SEQ ID NO: 91589 - DNA, 1134 bp, Artificial Sequence
  Description of Artificial Sequence: Synthetic coding sequence
tgagacctggaggagctgtgccccgtgtgcggcgacaaggtgagcggctaccactacggcctgctgacctgcgagagctgcaagggcttcttcaagagaaccgtgcagaacaacaagagatacacctgcatcgagaaccagaactgccagatcgacaagacccagagaaagagatgcccctactgcagattccagaagtgcctgagcgtgggcatgaagctggaggccgtgagagccgacagaatgagaggcggcagaaacaagttcggccccatgtacaagagagacagagccctgaagcagcagaagaaggccctgatcagagccaacggcctgaagctggaggccatgagccaggtgatccaggccatgcccagcgacctgaccatcagcagcgccatccagaacatccacagcgccagcaagggcctgcccctgaaccacgccgccctgccccccaccgactacgacagaagccccttcgtgaccagccccatcagcatgaccatgcccccccacggcagcctgcagggctaccagacctacggccacttccccagcagagccatcaagagcgagtaccccgacccctacaccagcagccccgagagcatcatgggctacagctacatggacagctaccagaccagcagccccgccagcatcccccacctgatcctggagctgctgaagtgcgagcccgacgagccccaggtgcaggccaagatcatggcctacctgcagcaggagcaggccaacagaagcaagcacgagaagctgagcaccttcggcctgatgtgcaagatggccgaccagaccctgttcagcatcgtggagtgggccagaagcagcatcttcttcagagagctgaagggcctgaccctgagccccagcctggagtgcagcggcaccatcctggcccacggcaacctgcacctgctgcacagcagcgacagccccgccagcgccagcagagtggccggcatcaccggcgtgcaccacaacacccacctgatcttcgtgttcctggtggagatgggcttctgccacgtgggccaggccggcctgaagacccccgacctgagagtgatctgcctgcccagaccccccaaggtgctgggcctgtgggcctag

SEQ ID NO: 91590 - DNA, 1626 bp, Artificial Sequence
  Description of Artificial Sequence: Synthetic coding sequence
atgagcagcaacagcgacaccggcgacctgcaggagagcctgaagcacggcctgacccccatcggcgccggcctgcccgacagacacggcagccccatccccgccagaggcagactggtgatgctgcccaaggtggagaccgaggccctgggcctggccagaagccacggcgagcagggccagatgcccgagaacatgcaggtgagccagttcaagatggtgaactacagctacgacgaggacctggaggagctgtgccccgtgtgcggcgacaaggtgagcggctaccactacggcctgctgacctgcgagagctgcaagggcttcttcaagagaaccgtgcagaacaacaagagatacacctgcatcgagaaccagaactgccagatcgacaagacccagagaaagagatgcccctactgcagattccagaagtgcctgagcgtgggcatgaagctggaggccgtgagagccgacagaatgagaggcggcagaaacaagttcggccccatgtacaagagagacagagccctgaagcagcagaagaaggccctgatcagagccaacggcctgaagctggaggccatgagccaggtgatccaggccatgcccagcgacctgaccatcagcagcgccatccagaacatccacagcgccagcaagggcctgcccctgaaccacgccgccctgccccccaccgactacgacagaagccccttcgtgaccagccccatcagcatgaccatgcccccccacggcagcctgcagggctaccagacctacggccacttccccagcagagccatcaagagcgagtaccccgacccctacaccagcagccccgagagcatcatgggctacagctacatggacagctaccagaccagcagccccgccagcatcccccacctgatcctggagctgctgaagtgcgagcccgacgagccccaggtgcaggccaagatcatggcctacctgcagcaggagcaggccaacagaagcaagcacgagaagctgagcaccttcggcctgatgtgcaagatggccgaccagaccctgttcagcatcgtggagtgggccagaagcagcatcttcttcagagagctgaaggtggacgaccagatgaagctgctgcagaactgctggagcgagctgctgatcctggaccacatctacagacaggtggtgcacggcaaggagggcagcatcttcctggtgaccggccagcaggtggactacagcatcatcgccagccaggccggcgccaccctgaacaacctgatgagccacgcccaggagctggtggccaagctgagaagcctgcagttcgaccagagagagttcgtgtgcctgaagttcctggtgctgttcagcctggacgtgaagaacctggagaacttccagctggtggagggcgtgcaggagcaggtgaacgccgccctgctggactacaccatgtgcaactacccccagcagaccgagaagttcggccagctgctgctgagactgcccgagatcagagccatcagcatgcaggccgaggagtacctgtactacaagcacctgaacggcgacgtgccctacaacaacctgctgatcgagatgctgcacgccaagagagcctag

SEQ ID NO: 91591 - DNA, 216 bp, Artificial Sequence
  Description of Artificial Sequence: Synthetic coding sequence
tgaagcctgaagcacggcctgacccccatcgacagaggcaactgcagaagcggctgcttcagcttcgccgccaccctgagacagagaagcctgctgaccagctgcgccggcctgcccgacagacacggcagccccatccccgccagaggcagactggtgatgctgcccaaggtggagaccgaggccctgggcctggccagaagccacggcgagtag

SEQ ID NO: 91592 - DNA, 66 bp, Artificial Sequence
  Description of Artificial Sequence: Synthetic coding sequence
atgagcagcaacagcgacaccggcgacctgcaggagagcctgaagcacggcctgacccccatctag

SEQ ID NO: 91593 - DNA, 249 bp, Artificial Sequence
  Description of Artificial Sequence: Synthetic coding sequence
atgagcagcaacagcgacaccggcgacctgcaggagagcctgaagcacggcctgacccccatcgacagaggcaactgcagaagcggctgcttcagcttcgccgccaccctgagacagagaagcctgctgaccagctgcgccggcctgcccgacagacacggcagccccatccccgccagaggcagactggtgatgctgcccaaggtggagaccgaggccctgggcctggccagaagccacggcgagtag

SEQ ID NO: 91594 - DNA, 1410 bp, Artificial Sequence
  Description of Artificial Sequence: Synthetic coding sequence
atggtgaactacagctacgacgaggacctggaggagctgtgccccgtgtgcggcgacaaggtgagcggctaccactacggcctgctgacctgcgagagctgcaagggcttcttcaagagaaccgtgcagaacaacaagagatacacctgcatcgagaaccagaactgccagatcgacaagacccagagaaagagatgcccctactgcagattccagaagtgcctgagcgtgggcatgaagctggaggccgtgagagccgacagaatgagaggcggcagaaacaagttcggccccatgtacaagagagacagagccctgaagcagcagaagaaggccctgatcagagccaacggcctgaagctggaggccatgagccaggtgatccaggccatgcccagcgacctgaccatcagcagcgccatccagaacatccacagcgccagcaagggcctgcccctgaaccacgccgccctgccccccaccgactacgacagaagccccttcgtgaccagccccatcagcatgaccatgcccccccacggcagcctgcagggctaccagacctacggccacttccccagcagagccatcaagagcgagtaccccgacccctacaccagcagccccgagagcatcatgggctacagctacatggacagctaccagaccagcagccccgccagcatcccccacctgatcctggagctgctgaagtgcgagcccgacgagccccaggtgcaggccaagatcatggcctacctgcagcaggagcaggccaacagaagcaagcacgagaagctgagcaccttcggcctgatgtgcaagatggccgaccagaccctgttcagcatcgtggagtgggccagaagcagcatcttcttcagagagctgaaggtggacgaccagatgaagctgctgcagaactgctggagcgagctgctgatcctggaccacatctacagacaggtggtgcacggcaaggagggcagcatcttcctggtgaccggccagcaggtggactacagcatcatcgccagccaggccggcgccaccctgaacaacctgatgagccacgcccaggagctggtggccaagctgagaagcctgcagttcgaccagagagagttcgtgtgcctgaagttcctggtgctgttcagcctggacgtgaagaacctggagaacttccagctggtggagggcgtgcaggagcaggtgaacgccgccctgctggactacaccatgtgcaactacccccagcagaccgagaagttcggccagctgctgctgagactgcccgagatcagagccatcagcatgcaggccgaggagtacctgtactacaagcacctgaacggcgacgtgccctacaacaacctgctgatcgagatgctgcacgccaagagagcctag

SEQ ID NO: 91595 - DNA, 681 bp, Artificial Sequence
  Description of Artificial Sequence: Synthetic coding sequence
atgctgctgagactggtgagcaacagctggccccaggtgatcctgccccccagaccccccaaggtgctgggcctgcaggcccccagaagagccagaaagagagccgagggcaccgccagcagcaacgtgttcagcatgttcgaccagagccagatccaggagttcaaggagagcctggccctgagccccagactggagagaaacggcatgatcagcgcccactgcaacctgtgcctgaccggcagcagcaacagccccgccagcgccagccaggccttcaccatcatggaccagaacagagacggcttcatcgacaaggaggacctgagagacaccttcgccgccctgggcagaatcaacgtgaagaacgaggagctggaggccatggtgaaggaggcccccggccccatcaacttcaccgtgttcctgaccatgttcggcgagaagctgaagggcaccgaccccgaggagaccatcctgcacgccttcaaggtgttcgacaccgagggcaagggcttcgtgaaggccgacgtgatcaaggagaagctgatgacccaggccgacagattcagcgaggaggaggtgaagcagatgttcgccgccttcccccccgacgtgtgcggcaacctggactacagaaacctgtgctacgtgatcacccacggcgaggagaaggactag

SEQ ID NO: 91596 - DNA, 1569 bp, Artificial Sequence
  Description of Artificial Sequence: Synthetic coding sequence
atggaggagcacggcgtgacccagaccgagcacatggccaccatcgaggcccacgccgtggcccagcaggtgcagcaggtgcacgtggccacctacaccgagcacagcatgctgagcgccgacgaggacagccccagcagccccgaggacaccagctacgacgacagcgacatcctgaacagcaccgccgccgacgaggtgaccgcccacctggccgccgccggccccgtgggcatggccgccgccgccgccgtggccaccggcaagaagagaaagagaccccacgtgttcgagagcaaccccagcatcagaaagagacagcagaccagactgctgagaaagctgagagccaccctggacgagtacaccaccagagtgggccagcaggccatcgtgctgtgcatcagccccagcaagcccaaccccgtgttcaaggtgttcggcgccgcccccctggagaacgtggtgagaaagtacaagagcatgatcctggaggacctggagagcgccctggccgagcacgcccccgccccccaggaggtgaacagcgagctgccccccctgaccatcgacggcatccccgtgagcgtggacaagatgacccaggcccagctgagagccttcatccccgagatgctgaagtacagcaccggcagaggcaagcccggctggggcaaggagagctgcaagcccatctggtggcccgaggacatcccctgggccaacgtgagaagcgacgtgagaaccgaggagcagaagcagagagtgagctggacccaggccctgagaaccatcgtgaagaactgctacaagcagcacggcagagaggacctgctgtacgccttcgaggaccagcagacccagacccaggccaccgccacccacagcatcgcccacctggtgcccagccagaccgtggtgcagaccttcagcaaccccgacggcaccgtgagcctgatccaggtgggcaccggcgccaccgtggccaccctggccgacgccagcgagctgcccaccaccgtgaccgtggcccaggtgaactacagcgccgtggccgacggcgaggtggagcagaactgggccaccctgcagggcggcgagatgaccatccagaccacccaggccagcgaggccacccaggccgtggccagcctggccgaggccgccgtggccgccagccaggagatgcagcagggcgccaccgtgaccatggccctgaacagcgaggccgccgcccacgccgtggccaccctggccgaggccaccctgcagggcggcggccagatcgtgctgagcggcgagaccgccgccgccgtgggcgccctgaccggcgtgcaggacgccaacggcctgttcatggccgacagagccggcagaaagtggatcctgaccgacaaggccaccggcctggtgcagatccccgtgagcatgtaccagaccgtggtgaccagcctggcccagggcaacggccccgtgcaggtggccatggcccccgtgaccaccagaatcagcgacagcgccgtgaccatggacggccaggccgtggaggtggtgaccctggagcagtag

SEQ ID NO: 91597 - DNA, 1314 bp, Artificial Sequence
  Description of Artificial Sequence: Synthetic coding sequence
atggaggagcacggcgtgacccagaccgagcacatggccaccatcgaggcccacgccgtggcccagcaggtgcagcaggtgcacgtggccacctacaccgagcacagcatgctgagcgccgacgaggacagccccagcagccccgaggacaccagctacgacgacagcgacatcctgaacagcaccgccgccgacgaggtgaccgcccacctggccgccgccggccccgtgggcatggccgccgccgccgccgtggccaccggcaagaagagaaagagaccccacgtgttcgagagcaaccccagcatcagaaagagacagcagaccagactgctgagaaagctgagagccaccctggacgagtacaccaccagagtgggccagcaggccatcgtgctgtgcatcagccccagcaagcccaaccccgtgttcaaggtgttcggcgccgcccccctggagaacgtggtgagaaagtacaagagcatgatcctggaggacctggagagcgccctggccgagcacgcccccgccccccaggaggtgaacagcgagctgccccccctgaccatcgacggcatccccgtgagcgtggacaagatgacccaggcccagctgagagccttcatccccgagatgctgaagtacagcaccggcagaggcaagcccggctggggcaaggagagctgcaagcccatctggtggcccgaggacatcccctgggccaacgtgagaagcgacgtgagaaccgaggagcagaagcagagagtgggcaccggcgccaccgtggccaccctggccgacgccagcgagctgcccaccaccgtgaccgtggcccaggtgaactacagcgccgtggccgacggcgaggtggagcagaactgggccaccctgcagggcggcgagatgaccatccagaccacccaggccagcgaggccacccaggccgtggccagcctggccgaggccgccgtggccgccagccaggagatgcagcagggcgccaccgtgaccatggccctgaacagcgaggccgccgcccacgccgtggccaccctggccgaggccaccctgcagggcggcggccagatcgtgctgagcggcgagaccgccgccgccgtgggcgccctgaccggcgtgcaggacgccaacggcctggtgcagatccccgtgagcatgtaccagaccgtggtgaccagcctggcccagggcaacggccccgtgcaggtggccatggcccccgtgaccaccagaatcagcgacagcgccgtgaccatggacggccaggccgtggaggtggtgaccctggagcagtag

SEQ ID NO: 91598 - DNA, 1512 bp, Artificial Sequence; identical to SEQ ID NO: 76286
  Description of Artificial Sequence: Synthetic coding sequence

SEQ ID NO: 91599 - DNA, 1569 bp, Artificial Sequence; identical to SEQ ID NO: 91596
  Description of Artificial Sequence: Synthetic coding sequence

SEQ ID NO: 91600 - DNA, 1512 bp, Artificial Sequence; identical to SEQ ID NO: 76286
  Description of Artificial Sequence: Synthetic coding sequence

SEQ ID NO: 91601 - DNA, 633 bp, Artificial Sequence
  Description of Artificial Sequence: Synthetic coding sequence
atggaggagcacggcgtgacccagaccgagcacatggccaccatcgaggcccacgccgtggcccagcaggtgcagcaggtgcacgtggccacctacaccgagcacagcatgctgagcgccgacgaggacagccccagcagccccgaggacaccagctacgacgacagcgacatcctgaacagcaccgccgccgacgaggtgaccgcccacctggccgccgccggccccgtgggcatggccgccgccgccgccgtggccaccggcaagaagagaaagagaccccacgtgttcgagagcaaccccagcatcagaaagagacagcagaccagactgctgagaaagctgagagccaccctggacgagtacaccaccagagtgggccagcaggccatcgtgctgtgcatcagccccagcaagcccaaccccgtgttcaaggtgttcggcgccgcccccctggagaacgtggtgagaaagtacaagagcatgatcctggaggacctggagagcgccctggccgagcacgcccccgccccccaggaggtgaacagcgagctgccccccctgaccatcgacggcatccccgtgagcgtggacaagatgacccaggcccagctgagagccttcatcccctag

SEQ ID NO: 91602 - DNA, 1029 bp, Artificial Sequence
  Description of Artificial Sequence: Synthetic coding sequence
atgatcctggaggacctggagagcgccctggccgagcacgcccccgccccccaggaggtgaacagcgagctgccccccctgaccatcgacggcatccccgtgagcgtggacaagatgacccaggcccagctgagagccttcatccccgagatgctgaagtacagcaccggcagaggcaagcccggctggggcaaggagagctgcaagcccatctggtggcccgaggacatcccctgggccaacgtgagaagcgacgtgagaaccgaggagcagaagcagagagtgagctggacccaggccctgagaaccatcgtgaagaactgctacaagcagcacggcagagaggacctgctgtacgccttcgaggaccagcagacccagacccaggccaccgccacccacagcatcgcccacctggtgcccagccagaccgtggtgcagaccttcagcaaccccgacggcaccgtgagcctgatccaggtgggcaccggcgccaccgtggccaccctggccgacgccagcgagctgcccaccaccgtgaccgtggcccaggtgaactacagcgccgtggccgacggcgaggtggagcagaactgggccaccctgcagggcggcgagatgaccatccagaccacccaggccagcgaggccacccaggccgtggccagcctggccgaggccgccgtggccgccagccaggagatgcagcagggcgccaccgtgaccatggccctgaacagcgaggccgccgcccacgccgtggccaccctggccgaggccaccctgcagggcggcggccagatcgtgctgagcggcgagaccgccgccgccgtgggcgccctgaccggcgtgcaggacgccaacggcctggtgcagatccccgtgagcatgtaccagaccgtggtgaccagcctggcccagggcaacggccccgtgcaggtggccatggcccccgtgaccaccagaatcagcgacagcgccgtgaccatggacggccaggccgtggaggtggtgaccctggagcagtag

SEQ ID NO: 91603 - DNA, 1860 bp, Artificial Sequence
  Description of Artificial Sequence: Synthetic coding sequence
atggccgacgagggcaagagctacagcgagcacgacgacgagagagtgaacttcccccagagaaagaagaagggcagaggccccttcagatggaagtacggcgagggcaacagaagaagcggcagaggcggcagcggcatcagaagcagcagactggaggaggacgacggcgacgtggccatgagcgacgcccaggacggccccagagtgagatacaacccctacaccaccagacccaacagaagaggcgacacctggcacgacagagacagaatccacgtgaccgtgagaagagacagagccccccccgagagaggcggcgccggcaccagccaggacggcaccagcaagaactggttcaagatcaccatcccctacggcagaaagtacgacaaggcctggctgctgagcatgatccagagcaagtgcagcgtgcccttcacccccatcgagttccactacgagaacaccagagcccagttcttcgtggaggacgccagcaccgccagcgccctgaaggccgtgaactacaagatcctggacagagagaacagaagaatcagcatcatcatcaacagcagcgcccccccccacaccatcctgaacgagctgaagcccgagcaggtggagcagctgaagctgatcatgagcaagagatacgacggcagccagcaggccctggacctgaagggcctgagaagcgaccccgacctggtggcccagaacatcgacgtggtgctgaacagaagaagctgcatggccgccaccctgagaatcatcgaggagaacatccccgagctgctgagcctgaacctgagcaacaacagactgtacagactggacgacatgagcagcatcgtgcagaaggcccccaacctgaagatcctgaacctgagcggcaacgagctgaagagcgagagagagctggacaagatcaagggcctgaagctggaggagctgtggctggacggcaacagcctgtgcgacaccttcagagaccagagcacctacatcagcgccatcagagagagattccccaagctgctgagactggacggccacgagctgcccccccccatcgccttcgacgtggaggcccccaccaccctgcccccctgcaagggcagctacttcggcaccgagaacctgaagagcctggtgctgcacttcctgcagcagtactacgccatctacgacagcggcgacagacagggcctgctggacgcctaccacgacggcgcctgctgcagcctgagcatccccttcatcccccagaaccccgccagaagcagcctggccgagtacttcaaggacagcagaaacgtgaagaagctgaaggaccccaccctgagattcagactgctgaagcacaccagactgaacgtggtggccttcctgaacgagctgcccaagacccagcacgacgtgaacagcttcgtggtggacatcagcgcccagaccagcaccctgctgtgcttcagcgtgaacggcgtgttcaaggaggtggacggcaagagcagagacagcctgagagccttcaccagaaccttcatcgccgtgcccgccagcaacagcggcctgtgcatcgtgaacgacgagctgttcgtgagaaacgccagcagcgaggagatccagagagccttcgccatgcccgcccccacccccagcagcagccccgtgcccaccctgagccccgagcagcaggagatgctgcaggccttcagcacccagagcggcatgaacctggagtggagccagaagtgcctgcaggacaacaactgggactacaccagaagcgcccaggccttcacccacctgaaggccaagggcgagatccccgaggtggccttcatgaagtag

SEQ ID NO: 91604 - DNA, 1071 bp, Artificial Sequence
  Description of Artificial Sequence: Synthetic coding sequence
atggccgacgagggcaagagctacagcgagcacgacgacgagagagtgaacttcccccagagaaagaagaagggcagaggccccttcagatggaagtacggcgagggcaacagaagaagcggcagaggcggcagcggcatcagaagcagcagactggaggaggacgacggcgacgtggccatgagcgacgcccaggacggccccagagtgagatacaacccctacaccaccagacccaacagaagaggcgacacctggcacgacagagacagaatccacgtgaccgtgagaagagacagagccccccccgagagaggcggcgccggcaccagccaggacggcaccagcaagaactggttcaagatcaccatcccctacggcagaaagtacgacaaggcctggctgctgagcatgatccagagcaagtgcagcgtgcccttcacccccatcgagttccactacgagaacaccagagcccagttcttcgtggaggacgccagcaccgccagcgccctgaaggccgtgaactacaagatcctggacagagagaacagaagaatcagcatcatcatcaacagcagcgcccccccccacaccatcctgaacgagctgaagcccgagcaggtggagcagctgaagctgatcatgagcaagagatacgacggcagccagcaggccctggacctgaagggcctgagaagcgaccccgacctggtggcccagaacatcgacgtggtgctgaacagaagaagctgcatggccgccaccctgagaatcatcgaggagaacatccccgagctgctgagcctgaacctgagcaacaacagactgtacagactggacgacatgagcagcatcgtgcagaaggcccccaacctgaagatcctgaacctgagcggcaacgagctgaagagcgagagagagctggacaagatcaagggcctgaagctggaggagctgtggctggacggcaacagcctgtgcgacaccttcagagaccagagcacctacatcagaagcgtggtggcctgcgtgagcccccccggcgacctgcaccccctgggcggctag

SEQ ID NO: 91605 - DNA, 1071 bp, Artificial Sequence; identical to SEQ ID NO: 91604
  Description of Artificial Sequence: Synthetic coding sequence

SEQ ID NO: 91606 - DNA, 1860 bp, Artificial Sequence; identical to SEQ ID NO: 91603
  Description of Artificial Sequence: Synthetic coding sequence

SEQ ID NO: 91607 - DNA, 1881 bp, Artificial Sequence
  Description of Artificial Sequence: Synthetic coding sequence
atgtgcagcaccctgaagaagtgcggcacctacagaaccgaggtggccgagtgccacgaccacggcagcaccttccagggcagaaagaagggcggcagcagcttcagagacaacttcgacaagagaagctgccactacgagcacggcggctacgagagaccccccagccactgccaggagaacgacggcagcgtggagatgagagacgtgcacaaggaccagcagctgagacacaccccctacagcatcagatgcgagagaagaatgaagtggcacagcgaggacgagatcagaatcaccacctggagaaacagaaagccccccgagagaaagatgagccagaacacccaggacggctacaccagaaactggttcaaggtgaccatcccctacggcatcaagtacgacaaggcctggctgatgaacagcatccagagccactgcagcgacagattcacccccgtggacttccactacgtgagaaacagagcctgcttcttcgtgcaggacgccagcgccgccagcgccctgaaggacgtgagctacaagatctacgacgacgagaaccagaagatctgcatcttcgtgaaccacagcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcatcgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagtactacagcatctacgacagcggcgacagacagggcctgctgggcgcctaccacgacgaggcctgcttcagcctggccatccccttcgaccccaaggacagcgcccccagcagcctgtgcaagtacttcgaggacagcagaaacatgaagaccctgaaggacccctacctgaagggcgagctgctgagaagaaccaagagagacatcgtggacagcctgagcgccctgcccaagacccagcacgacctgagcagcatcctggtggacgtgtggtgccagaccgagagaatgctgtgcttcagcgtgaacggcgtgttcaaggaggtggagggccagagccagggcagcgtgctggccttcaccagaaccttcatcgccacccccggcagcagcagcagcctgtgcatcgtgaacgacgagctgttcgtgagagacgccagcccccaggagacccagagcgccttcagcatccccgtgagcaccctgagcagcagcagcgagcccagcctgagccaggagcagcaggagatggtgcaggccttcagcgcccagagcggcatgaagctggagtggagccagaagtgcctgcaggacaacgagtggaactacaccagagccggccaggccttcaccatgctgcagaccgagggcaagatccccgccgaggccttcaagcagatcagctag

SEQ ID NO: 91608 - DNA, 1881 bp, Artificial Sequence; identical to SEQ ID NO: 91607
  Description of Artificial Sequence: Synthetic coding sequence

SEQ ID NO: 91609 - DNA, 1881 bp, Artificial Sequence; identical to SEQ ID NO: 91607
  Description of Artificial Sequence: Synthetic coding sequence

SEQ ID NO: 91610 - DNA, 1230 bp, Artificial Sequence
  Description of Artificial Sequence: Synthetic coding sequence
atgaagtggcacagcgaggacgagatcagaatcaccacctggagaaacagaaagccccccgagagaaagatgagccagaacacccaggacggctacaccagaaactggttcaaggtgaccatcccctacggcatcaagtacgacaaggcctggctgatgaacagcatccagagccactgcagcgacagattcacccccgtggacttccactacgtgagaaacagagcctgcttcttcgtgcaggacgccagcgccgccagcgccctgaaggacgtgagctacaagatctacgacgacgagaaccagaagatctgcatcttcgtgaaccacagcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcatcgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagtactacagcatctacgacagcggcgacagacagggcctgctgggcgcctaccacgacgaggcctgcttcagcctggccatccccttcgaccccaaggacagcgcccccagcagcctgtgcaagtacttcgaggacagcagaaacatgaagaccctgaaggacccctacctgaagggcgagctgctgagaagaaccaagagagacatcgtggacagcctgagcgccctgcccaagacccagcacgacctgagcagcatcctggtggacgtgtggtgccagaccgtgcccagcggccagtag

SEQ ID NO: 91611 - DNA, 1881 bp, Artificial Sequence; identical to SEQ ID NO: 91607
  Description of Artificial Sequence: Synthetic coding sequence

SEQ ID NO: 91612 - DNA, 1596 bp, Artificial Sequence
  Description of Artificial Sequence: Synthetic coding sequence
atgagcctgcccagcggccacaccaccggccacaccgaccaggtggtgcagagaagagccagatgctgggacatctaccagagaagattcagcagcagaagcgagcccgtgaaccccggcatgcacagcagcagccaccagcagcaggacggcgacgccgccatgcacggcgcccacatggacagccccgtgagatacaccccctacaccatcagcccctacaacagaaagggcagcttcagaaagcaggaccagacccacgtgaacatggagagagagcagaagccccccgagagaagaatggagggcaacatgcccgacggcaccctgggcagctggttcaagatcaccgtgcccttcggcatcaagtacaacgagaagtggctgctgaacctgatccagaacgagtgcagcgtgcccttcgtgcccgtggagttccactacgagaacatgcacgccagcttcttcgtggagaacgccagcatcgcctacgccctgaagaacgtgagcggcaagatctgggacgaggacaacgagaagatcagcatcttcgtgaaccccgccggcatcccccacttcgtgcacagagagctgaagagcgagaaggtggagcagatcaagctggccatgaaccagcagtgcgacgtgagccaggaggccctggacatccagagactgcccttctaccccgacatggtgaacagagacaccaagatggccagcaaccccagaaagtgcatggccgccagcctggacgtgcacgaggagaacatccccaccgtgatgagcgccggcgagatggacaagtggaagggcatcgagcccggcgagaagtgcgccgacagaagccccgtgtgcaccaccttcagcgacaccagcagcaacatcaacagcatcctggagctgttccccaagctgctgtgcctggacggccagcagagccccagagccaccctgtgcggcaccgaggcccacaagagactgcccacctgcaagggcagcttcttcggcagcgagatgctgaagaacctggtgctgcagttcctgcagcagtactacctgatctacgacagcggcgacagacagggcctgctgagcgcctaccacgacgaggcctgcttcagcctgagcatccccttcaaccccgaggacagcgcccccagcagcttctgcaagttcttcaaggacagcagaaacatcaagatcctgaaggacccctacctgagaggcgagctgctgaagcacaccaagctggacatcgtggacagcctgagcgccctgcccaagacccagcacgacctgagcagcttcctggtggacatgtggtaccagaccgagtggatgctgtgcttcagcgtgaacggcgtgttcaaggaggtggagggccagagccagggcagcgtgctggccttcaccagaaccttcatcgccacccccggcagcagcagcagcctgtgcatcgtgaacgacaagctgttcgtgagagacaccagccaccagggcacccagagcgccctgttcaccctggtgcccaccgccttcagcagcagcgtgcccgccttcagccaggagcagcagaagatgctgcccagctag

SEQ ID NO: 91613 - DNA, 702 bp, Artificial Sequence
  Description of Artificial Sequence: Synthetic coding sequence
atggagagagagcagaagccccccgagagaagaatggagggcaacatgcccgacggcaccctgggcagctggttcaagatcaccgtgcccttcggcatcaagtacaacgagaagtggctgctgaacctgatccagaacgagtgcagcgtgcccttcgtgcccgtggagttccactacgagaacatgcacgccagcttcttcgtggagaacgccagcatcgcctacgccctgaagaacgtgagcggcaagatctgggacgaggacaacgagaagatcagcatcttcgtgaaccccgccggcatcccccacttcgtgcacagagagctgaagagcgagaaggtggagcagatcaagctggccatgaaccagcagtgcgacgtgagccaggaggccctggacatccagagactgcccttctaccccgacatggtgaacagagacaccaagatggccagcaaccccagaaagtgcatggccgccagcctggacgtgcacgaggagaacatccccaccgtgatgagcgccggcgagatggacaagtggaagggcatcgagcccggcgagaagtgcgccgacagaagccccgtgtgcaccaccttcagcgacaccagcagcaacatcaagagcgtggtgcccagcgtgaccacctgggaccccgacctgtgcctgatcgcccccttctgcagaagaagacagcactag

SEQ ID NO: 91614 - DNA, 612 bp, Artificial Sequence
  Description of Artificial Sequence: Synthetic coding sequence
atggccagcagccaccccgagcagctgtacgtggtgctgaagcccaccagaggctaccagcccgtgagatactacctgatctacgacagcggcgacagacagggcctgctgagcgcctaccacgacgaggcctgcttcagcctgagcatccccttcaaccccgaggacagcgcccccagcagcttctgcaagttcttcaaggacagcagaaacatcaagatcctgaaggacccctacctgagaggcgagctgctgaagcacaccaagctggacatcgtggacagcctgagcgccctgcccaagacccagcacgacctgagcagcttcctggtggacatgtggtaccagaccgagtggatgctgtgcttcagcgtgaacggcgtgttcaaggaggtggagggccagagccagggcagcgtgctggccttcaccagaaccttcatcgccacccccggcagcagcagcagcctgtgcatcgtgaacgacaagctgttcgtgagagacaccagccaccagggcacccagagcgccctgttcaccctggtgcccaccgccttcagcagcagcgtgcccgccttcagccaggagcagcagaagatgctgcccagctag

SEQ ID NO: 91615 - DNA, 1086 bp, Artificial Sequence
  Description of Artificial Sequence: Synthetic coding sequence
tgaaacgagaagtggctgctgaacctgatccagaacgagtgcagcgtgcccttcgtgcccgtggagttccactacgagaacatgcacgccagcttcttcgtggagaacgccagcatcgcctacgccctgaagaacgtgagcggcaagatctgggacgaggacaacgagaagatcagcatcttcgtgaaccccgccggcatcccccacttcgtgcacagagagctgaagagcgagaaggtggagcagatcaagctggccatgaaccagcagtgcgacgtgagccaggaggccctggacatccagagactgcccttctaccccgacatggtgaacagagacaccaagatggccagcaaccccagaaagtgcatggccgccagcctggacgtgcacgaggagaacatccccaccgtgatgagcgccggcgagatggacaagtggaagggcatcgagcccggcgagaagtgcgccgacagaagccccgtgtgcaccaccttcagcgacaccagcagcaacatcaacagcatcctggagctgttccccaagctgctgtgcctggacggccagcagagccccagagccaccctgtgcggcaccgaggcccacaagagactgcccacctgcaagggcagcttcttcggcagcgagatgctgaagaacctggtgctgcagttcctgcagcagtactacctgatctacgacagcggcgacagacagggcctgctgagcgcctaccacgacgaggcctgcttcagcctgagcatccccttcaaccccgaggacagcgcccccagcagcttctgcaagttcttcaaggacagcagaaacatcaagatcctgaaggacccctacctgagaggcgagctgctgaagcacaccaagctggacatcgtggacagcctgagcgccctgcccaagacccagcacgacctgagcagcttcctggtggacatgtggtaccagaccgagtggatgctgtgcttcagcgtgaacggcgtgttcaaggaggtgagcggcttctgcagcagactgcaccccgacctgcactgctacccctggcagcagttccagagcgtgcacagatag

SEQ ID NO: 91616 - DNA, 1194 bp, Artificial Sequence
  Description of Artificial Sequence: Synthetic coding sequence
atgagaagaaacacccaggacgagaacatgagaaagtggttcaaggtgaccatcccctacggcatcaagtacgacaaggcctggctgatgaacagcatccagagcaactgcagcgtgcccttcacccccgtggacttccactacatcagaaacagagcctgcttcttcgtgcaggtggccagcgccgccagcgccctgaaggacgtgagctacaagatctacgacgacgagaaccagaagatctgcatcttcgtgagccacttcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcaccgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagagcaacctgtgcaagtacttcaaggacagcagaaacatcaagatcctgaaggacccctacctgcagagaaagctgctgaagcacaccaagtgccccagaaacgtggacagcctgagcgccctgcccgagacccagcacgacttcaccagcatcctggtggacatgtggtaccagaccgtgaacacctgcttcctgcccagagccggccccgagagccagagatggtggtgcctgctgagcctgaagtggaaggacggcctgagagtgctgatcctgcccagctgcggccccagcagcctgcccctggccgccatccccgtgtgcgccagctag

SEQ ID NO: 91617 - DNA, 1194 bp, Artificial Sequence; identical to SEQ ID NO: 91616
  Description of Artificial Sequence: Synthetic coding sequence

SEQ ID NO: 91618 - DNA, 1098 bp, Artificial Sequence
  Description of Artificial Sequence: Synthetic coding sequence
atgagaagaaacacccaggacgagaacatgagaaagtggttcaaggtgaccatcccctacggcatcaagtacgacaaggcctggctgatgaacagcatccagagcaactgcagcgtgcccttcacccccgtggacttccactacatcagaaacagagcctgcttcttcgtgcaggtggccagcgccgccagcgccctgaaggacgtgagctacaagatctacgacgacgagaaccagaagatctgcatcttcgtgagccacttcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcaccgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagagcaacctgtgcaagtacttcaaggacagcagaaacatcaagatcctgaaggacccctacctgcagagaaagctgctgaagcacaccaagtgccccagaaacgtggacagcctgagcgccctgcccgagacccagcacgacttcaccagcatcctggtggacatgtggtaccagaccgtgaacacctgcttcctgcccagagccggccccgagagccagagcctgagacccctgtag

SEQ ID NO: 91619 - DNA, 1098 bp, Artificial Sequence; identical to SEQ ID NO: 91618
  Description of Artificial Sequence: Synthetic coding sequence

SEQ ID NO: 91620 - DNA, 1044 bp, Artificial Sequence
  Description of Artificial Sequence: Synthetic coding sequence
atggagcagtacaccgccaacagcaacagcagcaccgagcagatcgtggtgcaggccggccagatccagcagcagcagcagggcggcgtgaccgccgtgcagctgcagaccgaggcccaggtggccagcgccagcggccagcaggtgcagaccctgcaggtggtgcagggccagcccctgatggtgcaggtgagcggcggccagctgatcaccagcaccggccagcccatcatggtgcaggccgtgcccggcggccagggccagaccatcatgcaggtgcccgtgagcggcacccagggcctgcagcagatccagctggtgccccccggccagatccagatccagggcggccaggccgtgcaggtgcagggccagcagggccagacccagcagatcatcatccagcagccccagaccgccgtgaccgccggccagacccagacccagcagcagatcgccgtgcagggccagcaggtggcccagaccgccgagggccagaccatcgtgtaccagcccgtgaacgccgacggcaccatcctgcagcaggtgaccgtgcccgtgagcggcatgatcaccatccccgccgccagcctggccggcgcccagatcgtgcagaccggcgccaacaccaacaccaccagcagcggccagggcaccgtgaccgtgaccctgcccgtggccggcaacgtggtgaacagcggcggcatggtgatgatggtgcccggcgccggcagcgtgcccgccatccagagaatccccctgcccggcgccgagatgctggaggaggagcccctgtacgtgaacgccaagcagtaccacagaatcctgaagagaagacaggccagagccaagctggaggccgagggcaagatccccaaggagagaagaaagtacctgcacgagagcagacacagacacgccatggccagaaagagaggcgagggcggcagattcttcagccccaaggagaaggacagcccccacatgcaggaccccaaccaggccgacgaggaggccatgacccagatcatcagagtgagctag

SEQ ID NO: 91621 - DNA, 957 bp, Artificial Sequence
  Description of Artificial Sequence: Synthetic coding sequence
atggagcagtacaccgccaacagcaacagcagcaccgagcagatcgtggtgcaggccggccagatccagcagcaggtgcagggccagcccctgatggtgcaggtgagcggcggccagctgatcaccagcaccggccagcccatcatggtgcaggccgtgcccggcggccagggccagaccatcatgcaggtgcccgtgagcggcacccagggcctgcagcagatccagctggtgccccccggccagatccagatccagggcggccaggccgtgcaggtgcagggccagcagggccagacccagcagatcatcatccagcagccccagaccgccgtgaccgccggccagacccagacccagcagcagatcgccgtgcagggccagcaggtggcccagaccgccgagggccagaccatcgtgtaccagcccgtgaacgccgacggcaccatcctgcagcaggtgaccgtgcccgtgagcggcatgatcaccatccccgccgccagcctggccggcgcccagatcgtgcagaccggcgccaacaccaacaccaccagcagcggccagggcaccgtgaccgtgaccctgcccgtggccggcaacgtggtgaacagcggcggcatggtgatgatggtgcccggcgccggcagcgtgcccgccatccagagaatccccctgcccggcgccgagatgctggaggaggagcccctgtacgtgaacgccaagcagtaccacagaatcctgaagagaagacaggccagagccaagctggaggccgagggcaagatccccaaggagagaagaaagtacctgcacgagagcagacacagacacgccatggccagaaagagaggcgagggcggcagattcttcagccccaaggagaaggacagcccccacatgcaggaccccaaccaggccgacgaggaggccatgacccagatcatcagagtgagctag

SEQ ID NO: 91622 - DNA, 624 bp, Artificial Sequence
  Description of Artificial Sequence: Synthetic coding sequence
atgaccatggacggcgacagcagcaccaccgacgccagccagctgggcatcagcgccgactacatcggcggcagccactacgtgatccagccccacgacgacaccgaggacagcatgaacgaccacgaggacaccaacggcagcaaggagagcttcagagagcaggacatctacctgcccatcgccaacgtggccagaatcatgaagaacgccatcccccagaccggcaagatcgccaaggacgccaaggagtgcgtgcaggagtgcgtgagcgagttcatcagcttcatcaccagcgaggccagcgagagatgccaccaggagaagagaaagaccatcaacggcgaggacatcctgttcgccatgagcaccctgggcttcgacagctacgtggagcccctgaagctgtacctgcagaagttcagagaggccatgaagggcgagaagggcatcggcggcgccgtgaccgccaccgacggcctgagcgaggagctgaccgaggaggccttcaccaaccagctgcccgccggcctgatcaccaccgacggccagcagcagaacgtgatggtgtacaccaccagctaccagcagatcagcggcgtgcagcagatccagttcagctag

SEQ ID NO: 91623 - DNA, 624 bp, Artificial Sequence; identical to SEQ ID NO: 91622
  Description of Artificial Sequence: Synthetic coding sequence

SEQ ID NO: 91624 - DNA, 1377 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagggccagagaaacgccagccagggcaagcccagaagatgcctgaaggagaccctgcagatcacccagaccgaggtgcagcagggccagcagcagttcagccagttcaccgacggccagagaaacagcgtgcagcaggccagagtgagcgagctgaccggcgaggccgagcccagagaggtgaaggccaccggcaacagcaccccctgcaccagcagcctgcccaccacccacccccccagccacagagccggcgccagctgcgtgtgctgcagccagccccagcagagcagcaccagccccccccccagcgacgccctgcagtgggtggtggtggaggtgagcggcacccccaaccagctggagacccacagagagctgcacgcccccctgcccggcatgaccagcctgagccccctgcaccccagccagcagctgtaccagatccagcaggtgaccatgcccgccggccaggacctggcccagcccatgttcatccagagcgccaaccagcccagcgacggccaggccccccaggtgaccggcgactag

SEQ ID NO: 91625 - DNA, 1008 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagcagctgtaccagatccagcaggtgaccatgcccgccggccaggacctggcccagcccatgttcatccagagcgccaaccagcccagcgacggccaggccccccaggtgaccggcgactag

SEQ ID NO: 91626 - DNA, 1320 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagagaaacagcgtgcagcaggccagagtgagcgagctgaccggcgaggccgagcccagagaggtgaaggccaccggcaacagcaccccctgcaccagcagcctgcccaccacccacccccccagccacagagccggcgccagctgcgtgtgctgcagccagccccagcagagcagcaccagccccccccccagcgacgccctgcagtgggtggtggtggaggtgagcggcacccccaaccagctggagacccacagagagctgcacgcccccctgcccggcatgaccagcctgagccccctgcaccccagccagcagctgtaccagatccagcaggtgaccatgcccgccggccaggacctggcccagcccatgttcatccagagcgccaaccagcccagcgacggccaggccccccaggtgaccggcgactag

SEQ ID NO: 91627 - DNA, 906 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagcagctgtaccagatccagcaggtgaccatgcccgccggccaggacctggcccagcccatgttcatccagagcgccaaccagcccagcgacggccaggccccccaggtgaccggcgactag

SEQ ID NO: 91628 - DNA, 1008 bp, Artificial Sequence; identical to SEQ ID NO: 91625
  Description of Artificial Sequence: Synthetic coding sequence

SEQ ID NO: 91629 - DNA, 702 bp, Artificial Sequence
  Description of Artificial Sequence: Synthetic coding sequence
atggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagcagctgtaccagatccagcaggtgaccatgagagccagaaccagccccagcccctgcagcagcagccagcccaccagcccccccaccggcccccccggcgacagaagactgagagcctag

SEQ ID NO: 91630 - DNA, 606 bp, Artificial Sequence
  Description of Artificial Sequence: Synthetic coding sequence
atggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagacccaggccatggagaccttcttcgccttcaagagacagatctacagcctgtggagagtgggcggcttcatcgccaccctgttcagccccagagaccccggcaactag

SEQ ID NO: 91631 - DNA, 942 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgagaccggcctggccgtgagcctgagactgatgaagtgcagcggcctgatcagcgcccactgcagcttcagactgcccggcagcagcgacagccccgccagcgccagcagagtggccggcatcatcggcgccgccgagtgcagacccgccgccgtgtaccccctgagccccgcctgcatcagacacagcagctgcgccggcaccgaccccgacacctgctag

SEQ ID NO: 91632 - DNA, 543 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcctag

SEQ ID NO: 91633 - DNA, 1065 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagggccagagaaacgccagccagggcaagcccagaagatgcctgaaggagaccctgcagatcacccagaccgaggtgcagcagggccagcagcagttcagccagttcaccgacggccagcagctgtaccagatccagcaggtgaccatgcccgccggccaggacctggcccagcccatgttcatccagagcgccaaccagcccagcgacggccaggccccccaggtgaccggcgactag

SEQ ID NO: 91634 - DNA, 894 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagcagctgtaccagatccagcaggtgaccatgcccgccggccaggacctggcccagcccatgttcatccagagcgccaaccagcccagcgacggccaggccccccaggtgaccggcgactag

SEQ ID NO: 91635 - DNA, 1008 bp, Artificial Sequence; identical to SEQ ID NO: 91625
  Description of Artificial Sequence: Synthetic coding sequence

SEQ ID NO: 91636 - DNA, 1008 bp, Artificial Sequence; identical to SEQ ID NO: 91625
  Description of Artificial Sequence: Synthetic coding sequence

SEQ ID NO: 91637 - DNA, 390 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacagtag

SEQ ID NO: 91638 - DNA, 1005 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggaggtgagacagagcgtgacccccgccgagcccgtgcagtactacttcaccctggcccagcagcccaccgccgtgcaggtgcagggccagcagcagggccagcagaccaccagcagcaccaccaccatccagcccggccagatcatcatcgcccagccccagcagggccagaccacccccgtgaccatgcaggtgggcgagggccagcaggtgcagatcgtgcaggcccagccccagggccaggcccagcaggcccagagcggcaccggccagaccatgcaggtgatgcagcagatcatcaccaacaccggcgagatccagcagatccccgtgcagctgaacgccggccagctgcagtacatcagactggcccagcccgtgagcggcacccaggtggtgcagggccagatccagaccctggccaccaacgcccagcagatcacccagaccgaggtgcagcagggccagcagcagttcagccagttcaccgacggccagctgtaccagatccagcaggtgaccatgcccgccggccaggacctggcccagcccatgttcatccagagcgccaaccagcccagcgacggccaggccccccaggtgaccggcgactag

SEQ ID NO: 91639 - DNA, 426 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgcccagagacgagctgaagccccccaagagacaggaggtgagacagagcgtgacccccgccgagcccgtgtag

SEQ ID NO: 91640 - DNA, 288 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgatgatcagcgccgaggcccccgtgctgttcgccaaggccgcccagatcttcatcaccgagctgaccctgagagcctggatccacaccgaggacaacaagagaagaaccctgcagagaaacgacatcgccatggccatcaccaagttcgaccagttcgacttcctgatcgacatcgtgccctag

SEQ ID NO: 91641 - DNA, 183 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgaagctggacgaggacgtgaagatgtag

SEQ ID NO: 91642 - DNA, 159 bp, Artificial Sequence
  Description of Artificial Sequence: Synthetic coding sequence
atgagcaccgagggcggcttcggcggcaccagcagcagcgacgcccagcagagcctgcagagcttctggcccagagtgatggaggagatcagaaacctgaccgtgaaggacttcagagtgcaggagctgcccctggccagaatcaagaagatcatgtag

SEQ ID NO: 91643 - DNA, 555 bp, Artificial Sequence
  Description of Artificial Sequence: Synthetic coding sequence
atggccagaagcctggtgcacgacaccgtgttctactgcctgagcgtgtaccaggtgaagatcagccccaccccccagctgggcgccgccagcagcgccgagggccacgtgggccagggcgcccccggcctgatgggcaacatgaaccccgagggcggcgtgaaccacgagaacggcatgaacagagacggcggcatgatccccgagggcggcggcggcaaccaggagcccagacagcagccccagcccccccccgaggagcccgcccaggccgccatggagggcccccagcccgagaacatgcagcccagaaccagaagaaccaagttcaccctgctgcaggtggaggagctggagagcgtgttcagacacacccagtaccccgacgtgcccaccagaagagagctggccgagaacctgggcgtgaccgaggacaaggtgagagtgtggttcaagaacaagagagccagatgcagaagacaccagagagagctgatgctggccaacgagctgagagccgaccccgacgactgcgtgtacatcgtggtggactag

SEQ ID NO: 91644 - DNA, 345 bp, Artificial Sequence
  Description of Artificial Sequence: Synthetic coding sequence
atggacaagagaagaagagccctgaccagactgtacctggacaaggccaccctgatctggaacggcaacgccgtgagcggcctggacgccctgaacaacttcttcgacaccctgcccagcagcgagttccaggtgaacatgctggactgccagcccgtgcacgagcaggccacccagagccagaccaccgtgctggtggtgaccagcggcaccgtgaagttcgacggcaacaagcagcacttcttcaaccagaacttcctgctgaccgcccagagcacccccaacaacaccgtgtggaagatcgccagcgactgcttcagattccaggactggagcagcagctag

SEQ ID NO: 91645 - DNA, 429 bp, Artificial Sequence
  Description of Artificial Sequence: Synthetic coding sequence
atggccaccagcctggacttcaagacctacgtggaccaggcctgcagagccgccgaggagttcgtgaacatctactacgagaccatggacaagagaagaagagccctgaccagactgtacctggacaaggccaccctgatctggaacggcaacgccgtgagcggcctggacgccctgaacaacttcttcgacaccctgcccagcagcgagttccaggtgaacatgctggactgccagcccgtgcacgagcaggccacccagagccagaccaccgtgctggtggtgaccagcggcaccgtgaagttcgacggcaacaagcagcacttcttcaaccagaacttcctgctgaccgcccagagcacccccaacaacaccgtgtggaagatcgccagcgactgcttcagattccaggactggagcagcagctag

SEQ ID NO: 91646 - DNA, 345 bp, Artificial Sequence; identical to SEQ ID NO: 91644
  Description of Artificial Sequence: Synthetic coding sequence

SEQ ID NO: 91647 - DNA, 882 bp, Artificial Sequence
  Description of Artificial Sequence: Synthetic coding sequence
atgaccggcctgtacgagctggtgtggagagtgctgcacgccctgctgtgcctgcacagaaccctgaccagctggctgagagtgagattcggcacctggaactggatctggagaagatgctgcagagccgccagcgccgccgtgctggcccccctgggcttcaccctgagaaagccccccgccgtgggcagaaacagaagacaccacagacaccccagaggcggcagctgcctggccgccgcccaccacagaatgagatggagagccgacggcagaagcctggagaagctgcccgtgcacatgggcctggtgatcaccgaggtggagcaggagcccagcttcagcgacatcgccagcctggtggtgtggtgcatggccgtgggcatcagctacatcagcgtgtacgaccaccagggcatcttcaagagaaacaacagcagactgatggacgagatcctgaagcagcagcaggagctgctgggcctggactgcagcaagtacagccccgagttcgccaacagcaacgacaaggacgaccaggtgctgaactgccacctggccgtgaaggtgctgagccccgaggacggcaaggccgacatcgtgagagccgcccaggacttctgccagctggtggcccagaagcagaagagacccaccgacctggacgtggacaccctggccagcctgctgagcagcaacggctgccccgaccccgacctggtgctgaagttcggccccgtggacagcaccctgggcttcctgccctggcacatcagactgaccgagatcgtgagcctgcccagccacctgaacatcagctacgaggacttcttcagcgccctgagacagtacgccgcctgcgagcagagactgggcaagtag

SEQ ID NO: 91648 - DNA, 2571 bp, Artificial Sequence
  Description of Artificial Sequence: Synthetic coding sequence
atgaagcccagacccgccggcttcgtggacaacaagctgaagcagagagtgatccagtacctgaccagcaacaagtgcggcaagtacgtggacatcggcgtgctggccagcgacctgcagagagtgtacagcatcgactacggcagaagaaagagaaacgccttcagaatccaggtggagaaggtgttcagcatcatcagcagcgagaaggagctgaagaacctgaccgagctggaggacgagcacctggccaagagagccagacagggcgaggaggacaacgagtacaccgagagctacagcgacgacgacagcagcatggaggactaccccgacccccagagcgccaaccacatgaacagcagcctgctgagcctgtacagaaagggcaaccccgacagcgtgagcaacacccccgagatggagcagagagagaccaccagcagcacccccagaatcagcagcaagaccggcagcatccccctgaagacccccgccaaggacagcgagggcggctggttcatcgacaagacccccagcgtgaagaaggacagcttcttcctggacctgagctgcgagaagagcaaccccaagaagcccatcaccgagatccaggacagcaaggacagcagcctgctggagagcgacatgaagagaaagggcaagctgaagaacaagggcagcaagagaaagaaggaggacctgcaggaggtggacggcgagatcgaggccgtgctgcagaagaaggccaaggccagaggcctggagttccagatcagcaacgtgaagttcgaggacgtgggcggcaacgacatgaccctgaaggaggtgtgcaagatgctgatccacatgagacaccccgaggtgtaccaccacctgggcgtggtgccccccagaggcgtgctgctgcacggcccccccggctgcggcaagaccctgctggcccacgccatcgccggcgagctggacctgcccatcctgaaggtggccgcccccgagatcgtgagcggcgtgagcggcgagagcgagcagaagctgagagagctgttcgagcaggccgtgagcaacgccccctgcatcatcttcatcgacgagatcgacgccatcacccccaagagagaggtggccagcaaggacatggagagaagaatcgtggcccagctgctgacctgcatggacgacctgaacaacgtggccgccaccgccagagtgctggtgatcggcgccaccaacagacccgacagcctggaccccgccctgagaagagccggcagattcgacagagagatctgcctgggcatccccgacgaggccagcagagagagaatcctgcagaccctgtgcagaaagctgagactgccccaggccttcgacttctgccacctggcccacctgacccccggcttcgtgggcgccgacctgatggccctgtgcagagaggccgccatgtgcgccgtgaacagagtgctgatgaagctgcaggagcagcagaagaagaaccccgagatggaggacctgcccagcaagggcgtgcaggaggagagactgggcaccgagcccaccagcgagacccaggacgagctgcagagactgctgggcctgctgagagaccaggaccccctgagcgaggagcagatgcagggcctgtgcatcgagctgaacgacttcatcgtggccctgagcagcgtgcagcccagcgccaagagagagggcttcgtgaccgtgcccaacgtgacctgggccgacatcggcgccctggaggacatcagagaggagctgaccatggccatcctggcccccgtgagaaaccccgaccagttcaaggccctgggcctggtgacccccgccggcgtgctgctggccggcccccccggctgcggcaagaccctgctggccaaggccgtggccaacgagagcggcctgaacttcatcagcgtgaagggccccgagctgctgaacatgtacgtgggcgagagcgagagagccgtgagacaggtgttccagagagccaagaacagcgccccctgcgtgatcttcttcgacgaggtggacgccctgtgccccagaagaagcgacagagagaccggcgccagcgtgagagtggtgaaccagctgctgaccgagatggacggcctggaggccagacagcaggtgttcatcatggccgccaccaacagacccgacatcatcgaccccgccatcctgagacccggcagactggacaagaccctgttcgtgggcctgcccccccccgccgacagactggccatcctgaagaccatcaccaagaacggcaccaagccccccctggacgccgacgtgaacctggaggccatcgccggcgacctgagatgcgactgctacaccggcgccgacctgagcgccctggtgagagaggccagcatctgcgccctgagacaggagatggccagacagaagagcggcaacgagaagggcgagctgaaggtgagccacaagcacttcgaggaggccttcaagaaggtgagaagcagcatcagcaagaaggaccagatcatgtacgagagactgcaggagagcctgagcagatag

SEQ ID NO: 91649 - DNA, 2004 bp, Artificial Sequence
  Description of Artificial Sequence: Synthetic coding sequence
atgaagagaaagggcaagctgaagaacaagggcagcaagagaaagaaggaggacctgcaggaggtggacggcgagatcgaggccgtgctgcagaagaaggccaaggccagaggcctggagttccagatcagcaacgtgaagttcgaggacgtgggcggcaacgacatgaccctgaaggaggtgtgcaagatgctgatccacatgagacaccccgaggtgtaccaccacctgggcgtggtgccccccagaggcgtgctgctgcacggcccccccggctgcggcaagaccctgctggcccacgccatcgccggcgccgagtgcagcggcatgatcaccgcccactgcagcttcgacttcagcggcagcaacgacccccccgccagcgccagccaggagctggacctgcccatcctgaaggtggccgcccccgagatcgtgagcggcgtgagcggcgagagcgagcagaagctgagagagctgttcgagcaggccgtgagcaacgccccctgcatcatcttcatcgacgagatcgacgccatcacccccaagagagaggtggccagcaaggacatggagagaagaatcgtggcccagctgctgacctgcatggacgacctgaacaacgtggccgccaccgccagagtgctggtgatcggcgccaccaacagacccgacagcctggaccccgccctgagaagagccggcagattcgacagagagatctgcctgggcatccccgacgaggccagcagagagagaatcctgcagaccctgtgcagaaagctgagactgccccaggccttcgacttctgccacctggcccacctgacccccggcttcgtgggcgccgacctgatggccctgtgcagagaggccgccatgtgcgccgtgaacagagtgctgatgaagctgcaggagcagcagaagaagaaccccgagatggaggacctgcccagcaagggcgtgcaggaggagagactgggcaccgagcccaccagcgagacccaggacgagctgcagagactgctgggcctgctgagagaccaggaccccctgagcgaggagcagatgcagggcctgtgcatcgagctgaacgacttcatcgtggccctgagcagcgtgcagcccagcgccaagagagagggcttcgtgaccgtgcccaacgtgacctgggccgacatcggcgccctggaggacatcagagaggagctgaccatggccatcctggcccccgtgagaaaccccgaccagttcaaggccctgggcctggtgacccccgccggcgtgctgctggccggcccccccggctgcggcaagaccctgctggccaaggccgtggccaacgagagcggcctgaacttcatcagcgtgaagggccccgagctgctgaacatgtacgtgggcgagagcgagagagccgtgagacaggtgttccagagagccaagaacagcgccccctgcgtgatcttcttcgacgaggtggacgccctgtgccccagaagaagcgacagagagaccggcgccagcgtgagagtggtgaaccagctgctgaccgagatggacggcctggaggccagacagcaggtgttcatcatggccgccaccaacagacccgacatcatcgaccccgccatcctgagacccggcagactggacaagaccctgttcgtgggcctgcccccccccgccgacagactggccatcctgaagaccatcaccaagaacggcaccaagccccccctggacgccgacgtgaacctggaggccatcgccggcgacctgagatgcgactgctacaccggcgccgacctgagcgccctggtgagagaggccagcatctgcgccctgagacaggagatggccagacagaagagcggcaacgagaagggcgagctgaaggtgagccacaagcacttcgaggaggccttcaagaaggtgagaagcagcatcagcaagaaggaccagatcatgtacgagagactgcaggagagcctgagcagatag

SEQ ID NO: 91650 - DNA, 1770 bp, Artificial Sequence
  Description of Artificial Sequence: Synthetic coding sequence
atggaggactaccccgacccccagagcgccaaccacatgaacagcagcctgctgagcctgtacagaaagggcaaccccgacagcgtgagcaacacccccgagatggagcagagagagaccaccagcagcacccccagaatcagcagcaagaccggcagcatccccctgaagacccccgccaaggacagcgagggcggctggttcatcgacaagacccccagcgtgaagaaggacagcttcttcctggacctgagctgcgagaagagcaaccccaagaagcccatcaccgagatccaggacagcaaggacagcagcctgctggagagcgacatgaagagaaagggcaagctgaagaacaagggcagcaagagaaagaaggaggacctgcaggaggtggacggcgagatcgaggccgtgctgcagaagaaggccaaggccagaggcctggagttccagatcagcaacgtgaagttcgaggacgtgggcggcaacgacatgaccctgaaggaggtgtgcaagatgctgatccacatgagacaccccgaggtgtaccaccacctgggcgtggtgccccccagaggcgtgctgctgcacggcccccccggctgcggcaagaccctgctggcccacgccatcgccggcgagctggacctgcccatcctgaaggtggccgcccccgagatcgtgagcggcgtgagcggcgagagcgagcagaagctgagagagctgttcgagcaggccgtgagcaacgccccctgcatcatcttcatcgacgagatcgacgccatcacccccaagagagaggtggccagcaaggacatggagagaagaatcgtggcccagctgctgacctgcatggacgacctgaacaacgtggccgccaccgccagagtgctggtgatcggcgccaccaacagacccgacagcctggaccccgccctgagaagagccggcagattcgacagagagatctgcctgggcatccccgacgaggccagcagagagagaatcctgcagaccctgtgcagaaagctgagactgccccaggccttcgacttctgccacctggcccacctgacccccggcttcgtgggcgccgacctgatggccctgtgcagagaggccgccatgtgcgccgtgaacagagtgctgatgaagctgcaggagcagcagaagaagaaccccgagatggaggacctgcccagcaagggcgtgcaggaggagagactgggcaccgagcccaccagcgagacccaggacgagctgcagagactgctgggcctgctgagagaccaggaccccctgagcgaggagcagatgcagggcctgtgcatcgagctgaacgacttcatcgtggccctgagcagcgtgcagcccagcgccaagagagagggcttcgtgaccgtgcccaacgtgacctgggccgacatcggcgccctggaggacatcagagaggagctgaccatggccatcctggcccccgtgagaaaccccgaccagttcaaggccctgggcctggtgacccccgccggcgtgctgctggccggcccccccggctgcggcaagaccctgctggccaaggccgtggccaacgagagcggcctgaacttcatcagcgtgaagggccccgagctgctgaacatgtacgtgggcgagagcgagagagccgtgagacaggtgttccagagagccaagaacagcgccccctgcgtgatcttcttcgacgaggtggacgccctgtgccccagaagaagcgacagagagatctag

SEQ ID NO: 91651 - DNA, 2253 bp, Artificial Sequence
  Description of Artificial Sequence: Synthetic coding sequence
atggaggactaccccgacccccagagcgccaaccacatgaacagcagcctgctgagcctgtacagaaagggcaaccccgacagcgtgagcaacacccccgagatggagcagagagagaccaccagcagcacccccagaatcagcagcaagaccggcagcatccccctgaagacccccgccaaggacagcgagggcggctggttcatcgacaagacccccagcgtgaagaaggacagcttcttcctggacctgagctgcgagaagagcaaccccaagaagcccatcaccgagatccaggacagcaaggacagcagcctgctggagagcgacatgaagagaaagggcaagctgaagaacaagggcagcaagagaaagaaggaggacctgcaggaggtggacggcgagatcgaggccgtgctgcagaagaaggccaaggccagaggcctggagttccagatcagcaacgtgaagttcgaggacgtgggcggcaacgacatgaccctgaaggaggtgtgcaagatgctgatccacatgagacaccccgaggtgtaccaccacctgggcgtggtgccccccagaggcgtgctgctgcacggcccccccggctgcggcaagaccctgctggcccacgccatcgccggcgagctggacctgcccatcctgaaggtggccgcccccgagatcgtgagcggcgtgagcggcgagagcgagcagaagctgagagagctgttcgagcaggccgtgagcaacgccccctgcatcatcttcatcgacgagatcgacgccatcacccccaagagagaggtggccagcaaggacatggagagaagaatcgtggcccagctgctgacctgcatggacgacctgaacaacgtggccgccaccgccagagtgctggtgatcggcgccaccaacagacccgacagcctggaccccgccctgagaagagccggcagattcgacagagagatctgcctgggcatccccgacgaggccagcagagagagaatcctgcagaccctgtgcagaaagctgagactgccccaggccttcgacttctgccacctggcccacctgacccccggcttcgtgggcgccgacctgatggccctgtgcagagaggccgccatgtgcgccgtgaacagagtgctgatgaagctgcaggagcagcagaagaagaaccccgagatggaggacctgcccagcaagggcgtgcaggaggagagactgggcaccgagcccaccagcgagacccaggacgagctgcagagactgctgggcctgctgagagaccaggaccccctgagcgaggagcagatgcagggcctgtgcatcgagctgaacgacttcatcgtggccctgagcagcgtgcagcccagcgccaagagagagggcttcgtgaccgtgcccaacgtgacctgggccgacatcggcgccctggaggacatcagagaggagctgaccatggccatcctggcccccgtgagaaaccccgaccagttcaaggccctgggcctggtgacccccgccggcgtgctgctggccggcccccccggctgcggcaagaccctgctggccaaggccgtggccaacgagagcggcctgaacttcatcagcgtgaagggccccgagctgctgaacatgtacgtgggcgagagcgagagagccgtgagacaggtgttccagagagccaagaacagcgccccctgcgtgatcttcttcgacgaggtggacgccctgtgccccagaagaagcgacagagagaccggcgccagcgtgagagtggtgaaccagctgctgaccgagatggacggcctggaggccagacagcaggtgttcatcatggccgccaccaacagacccgacatcatcgaccccgccatcctgagacccggcagactggacaagaccctgttcgtgggcctgcccccccccgccgacagactggccatcctgaagaccatcaccaagaacggcaccaagccccccctggacgccgacgtgaacctggaggccatcgccggcgacctgagatgcgactgctacaccggcgccgacctgagcgccctggtgagagaggccagcatctgcgccctgagacaggagatggccagacagaagagcggcaacgagaagggcgagctgaaggtgagccacaagcacttcgaggaggccttcaagaaggtgagaagcagcatcagcaagaaggaccagatcatgtacgagagactgcaggagagcctgagcagatag

SEQ ID NO: 91652 - DNA, 2298 bp, Artificial Sequence
  Description of Artificial Sequence: Synthetic coding sequence
atgaagcccagacccgccggcttcgtggacaacaagctgaagcagagagtgatccagtacctgaccagcaacaagtgcggcaagtacgtggacatcggcgtgctggccagcgacctgcagagagtgtacagcatcgactacggcagaagaaagagaaacgccttcagaatccaggtggagaaggtgttcagcatcatcagcagcgagaaggagctgaagaacctgaccgagctggaggacgagcacctggccaagagagccagacagggcgaggaggacaacgagtacaccgagagctacagcgacgacgacagcagcatggaggactaccccgacccccaggacagcaaggacagcagcctgctggagagcgacatgaagagaaagggcaagctgaagaacaagggcagcaagagaaagaaggaggacctgcaggaggtggacggcgagatcgaggccgtgctgcagaagaaggccaaggccagaggcctggagttccagatcagcaacgtgaagttcgaggacgtgggcggcaacgacatgaccctgaaggaggtgtgcaagatgctgatccacatgagacaccccgaggtgtaccaccacctgggcgtggtgccccccagaggcgtgctgctgcacggcccccccggctgcggcaagaccctgctggcccacgccatcgccggcgagctggacctgcccatcctgaaggtggccgcccccgagatcgtgagcggcgtgagcggcgagagcgagcagaagctgagagagctgttcgagcaggccgtgagcaacgccccctgcatcatcttcatcgacgagatcgacgccatcacccccaagagagaggtggccagcaaggacatggagagaagaatcgtggcccagctgctgacctgcatggacgacctgaacaacgtggccgccaccgccagagtgctggtgatcggcgccaccaacagacccgacagcctggaccccgccctgagaagagccggcagattcgacagagagatctgcctgggcatccccgacgaggccagcagagagagaatcctgcagaccctgtgcagaaagctgagactgccccaggccttcgacttctgccacctggcccacctgacccccggcttcgtgggcgccgacctgatggccctgtgcagagaggccgccatgtgcgccgtgaacagagtgctgatgaagctgcaggagcagcagaagaagaaccccgagatggaggacctgcccagcaagggcgtgcaggaggagagactgggcaccgagcccaccagcgagacccaggacgagctgcagagactgctgggcctgctgagagaccaggaccccctgagcgaggagcagatgcagggcctgtgcatcgagctgaacgacttcatcgtggccctgagcagcgtgcagcccagcgccaagagagagggcttcgtgaccgtgcccaacgtgacctgggccgacatcggcgccctggaggacatcagagaggagctgaccatggccatcctggcccccgtgagaaaccccgaccagttcaaggccctgggcctggtgacccccgccggcgtgctgctggccggcccccccggctgcggcaagaccctgctggccaaggccgtggccaacgagagcggcctgaacttcatcagcgtgaagggccccgagctgctgaacatgtacgtgggcgagagcgagagagccgtgagacaggtgttccagagagccaagaacagcgccccctgcgtgatcttcttcgacgaggtggacgccctgtgccccagaagaagcgacagagagaccggcgccagcgtgagagtggtgaaccagctgctgaccgagatggacggcctggaggccagacagcaggtgttcatcatggccgccaccaacagacccgacatcatcgaccccgccatcctgagacccggcagactggacaagaccctgttcgtgggcctgcccccccccgccgacagactggccatcctgaagaccatcaccaagaacggcaccaagccccccctggacgccgacgtgaacctggaggccatcgccggcgacctgagatgcgactgctacaccggcgccgacctgagcgccctggtgagagaggccagcatctgcgccctgagacaggagatggccagacagaagagcggcaacgagaagggcgagctgaaggtgagccacaagcacttcgaggaggccttcaagaaggtgagaagcagcatcagcaagaaggaccagatcatgtacgagagactgcaggagagcctgagcagatag

SEQ ID NO: 91653 - DNA, 1386 bp, Artificial Sequence
  Description of Artificial Sequence: Synthetic coding sequence
atgccccccagcggccccagaggcaccctgctgctgctgcccctgctgctgctgctgctgctgagagccgtgctggccgtgcccctggagagaggcgcccccaacaaggaggagacccccgccaccgagagccccgacaccggcctgtactaccacagatacctgcaggaggtgatcgacgtgctggagaccgacggccacttcagagagaagctgcaggccgccaacgccgaggacatcaagagcggcaagctgagcagagagctggacttcgtgagccaccacgtgagaaccaagctggacgagctgaagagacaggaggtgagcagactgagaatgctgctgaaggccaagatggacgccgagcaggaccccaacgtgcaggtggaccacctgaacctgctgaagcagttcgagcacctggacccccagaaccagcacaccttcgaggccagagacctggagctgctgatccagaccgccaccagagacctggcccagtacgacgccgcccaccacgaggagttcaagagatacgagatgctgaaggagcacgagagaagaagatacctggagagcctgggcgaggagcagagaaaggaggccgagagaaagctggaggagcagcagagaagacacagagagcaccccaaggtgaacgtgcccggcagccaggcccagctgaaggaggtgtgggaggagctggacggcctggaccccaacagattcaaccccaagaccttcttcatcctgcacgacatcaacagcgacggcgtgctggacgagcaggagctggaggccctgttcaccaaggagctggagaaggtgtacgaccccaagaacgaggaggacgacatgagagagatggaggaggagagactgagaatgagagagcacgtgatgaagaacgtggacaccaaccaggacagactggtgaccctggaggagttcctggccagcacccagagaaaggagttcggcgacaccggcgagggctgggagaccgtggagatgcaccccgcctacaccgaggaggagctgagaagattcgaggaggagctggccgccagagaggccgagctgaacgccaaggcccagagactgagccaggagaccgaggccctgggcagaagccagggcagactggaggcccagaagagagagctgcagcaggccgtgctgcacatggagcagagaaagcagcagcagcagcagcagcagggccacaaggcccccgccgcccaccccgagggccagctgaagttccaccccgacaccgacgacgtgcccgtgcccgcccccgccggcgaccagaaggaggtggacaccagcgagaagaagctgctggagagactgcccgaggtggaggtgccccagcacctgtag

SEQ ID NO: 91654 - DNA, 1386 bp, Artificial Sequence; identical to SEQ ID NO: 91653
  Description of Artificial Sequence: Synthetic coding sequence

SEQ ID NO: 91655 - DNA, 1386 bp, Artificial Sequence; identical to SEQ ID NO: 91653
  Description of Artificial Sequence: Synthetic coding sequence

SEQ ID NO: 91656 - DNA, 375 bp, Artificial Sequence
  Description of Artificial Sequence: Synthetic coding sequence
atgccccccagcggccccagaggcaccctgctgctgctgcccctgctgctgctgctgctgctgagagccgtgctggccgtgcccctggagagaggcgcccccaacaaggaggagacccccgccaccgagagccccgacaccggcctgtactaccacagatacctgcaggaggtgatcgacgtgctggagaccgacggccacttcagagagaagctgcaggccgccaacgccgaggacatcaagagcggcaagctgagcagagagctggacttcgtgagccaccacgtgagaaccaagctggacgagctgaagagacaggaggtgagcagactgagaatgctgctgaaggccaagatggacgccgagcaggactag

SEQ ID NO: 91657 - DNA, 336 bp, Artificial Sequence
  Description of Artificial Sequence: Synthetic coding sequence
atgccccccagcggccccagaggcaccctgctgctgctgcccctgctgctgctgctgctgctgagagccgtgctggccgtgcccctggagagaggcgcccccaacaaggaggagacccccgccaccgagagccccgacaccggcctgtactaccacagatacctgcaggaggtgatcgacgtgctggagaccgacggccacttcagagagaagctgcaggccgccaacgccgaggacatcaagagcggcaagctgagcagagagctggacttcgtgagccaccacgtgagaaccaagctggacgagctgaagagacaggaggtgagcagactgtag

SEQ ID NO: 91658 - DNA, 1263 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaaggagctggacctggtgagccaccacgtgagaaccaagctggacgagctgaagagacaggaggtgggcagactgagaatgctgatcaaggccaagctggacagcctgcaggacatcggcatggaccaccaggccctgctgaagcagttcgaccacctgaaccacctgaaccccgacaagttcgagagcaccgacctggacatgctgatcaaggccgccaccagcgacctggagcactacgacaagaccagacacgaggagttcaagaagtacgagatgatgaaggagcacgagagaagagagtacctgaagaccctgaacgaggagaagagaaaggaggaggagagcaagttcgaggagatgaagaagaagcacgagaaccaccccaaggtgaaccaccccggcagcaaggaccagctgaaggaggtgtgggaggagaccgacggcctggaccccaacgacttcgaccccaagaccttcttcaagctgcacgacgtgaacagcgacggcttcctggacgagcaggagctggaggccctgttcaccaaggagctggagaaggtgtacgaccccaagaacgaggaggacgacatggtggagatggaggaggagagactgagaatgagagagcacgtgatgagcgaggtggacaccaacaaggacagactggtgaccctggaggagttcctgaaggccaccgagaagaaggagttcctggagcccgacagctgggagaccctggaccagcagcagttcttcaccgaggaggagctgaaggagtacgagaacatcatcgccctgcaggagaacgagctgaagaagaaggccgacgagctgcagaagcagaaggaggagctgcagagacagcacgaccagctggaggcccagaagctggagtaccaccaggtgatccagcagatggagcagaagaagctgcagcagggcatcccccccagcggccccgccggcgagctgaagttcgagcccagagtgtag

SEQ ID NO: 91659 - DNA, 1173 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaaggagctggacctggtgagccaccacgtgagaaccaagctggacgagctgaagagacaggaggtgggcagactgagaatgctgatcaaggccaagctggacagcctgcaggacatcggcatggaccaccaggccctgctgaagcagttcgaccacctgaaccacctgaaccccgacaagttcgagagcaccgacctggacatgctgatcaaggccgccaccagcgacctggagcactacgacaagaccagacacgaggagttcaagaagtacgagatgatgaaggagcacgagagaagagagtacctgaagaccctgaacgaggagaagagaaaggaggaggagagcaagttcgaggagatgaagaagaagcacgagaaccaccccaaggtgaaccaccccggcagcaaggaccagctgaaggaggtgtgggaggagaccgacggcctggaccccaacgacttcgaccccaagaccttcttcaagctgcacgacgtgaacagcgacggcttcctggacgagcaggagctggaggccctgttcaccaaggagctggagaaggtgtacgaccccaagaacgaggaggacgacatggtggagatggaggaggagagactgagaatgagagagcacgtgatgagcgagaccctggaccagcagcagttcttcaccgaggaggagctgaaggagtacgagaacatcatcgccctgcaggagaacgagctgaagaagaaggccgacgagctgcagaagcagaaggaggagctgcagagacagcacgaccagctggaggcccagaagctggagtaccaccaggtgatccagcagatggagcagaagaagctgcagcagggcatcccccccagcggccccgccggcgagctgaagttcgagccccacatctag

SEQ ID NO: 91660 - DNA, 210 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagtag

SEQ ID NO: 91661 - DNA, 105 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgtag

SEQ ID NO: 91662 - DNA, 1263 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaaggagctggacctggtgagccaccacgtgagaaccaagctggacgagctgaagagacaggaggtgggcagactgagaatgctgatcaaggccaagctggacagcctgcaggacatcggcatggaccaccaggccctgctgaagcagttcgaccacctgaaccacctgaaccccgacaagttcgagagcaccgacctggacatgctgatcaaggccgccaccagcgacctggagcactacgacaagaccagacacgaggagttcaagaagtacgagatgatgaaggagcacgagagaagagagtacctgaagaccctgaacgaggagaagagaaaggaggaggagagcaagttcgaggagatgaagaagaagcacgagaaccaccccaaggtgaaccaccccggcagcaaggaccagctgaaggaggtgtgggaggagaccgacggcctggaccccaacgacttcgaccccaagaccttcttcaagctgcacgacgtgaacagcgacggcttcctggacgagcaggagctggaggccctgttcaccaaggagctggagaaggtgtacgaccccaagaacgaggaggacgacatggtggagatggaggaggagagactgagaatgagagagcacgtgatgagcgaggtggacaccaacaaggacagactggtgaccctggaggagttcctgaaggccaccgagaagaaggagttcctggagcccgacagctgggagaccctggaccagcagcagttcttcaccgaggaggagctgaaggagtacgagaacatcatcgccctgcaggagaacgagctgaagaagaaggccgacgagctgcagaagcagaaggaggagctgcagagacagcacgaccagctggaggcccagaagctggagtaccaccaggtgatccagcagatggagcagaagaagctgcagcagggcatcccccccagcggccccgccggcgagctgaagttcgagccccacatctag

SEQ ID NO: 91663 - DNA, 588 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaaggagctggacctggtgagccaccacgtgagaaccaagctggacgagctgaagagacaggaggtgggcagactgagaatgctgatcaaggccaagctggacagcctgcaggacatcggcatggaccaccaggccctgctgaagcagttcgaccacctgaaccacctgaaccccgacaagttcgagagcaccgacctggacatgctgatcaaggccgccaccagcgacctggagcactacgacaagaccagacacgaggagttcaagaagtacgagatgatgaaggagcacgagagaagagagtacctgaagaccctgtag

SEQ ID NO: 91664 - DNA, 597 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaaggagctggacctggtgagccaccacgtgagaaccaagctggacgagctgaagagacaggaggtgggcagactgagaatgctgatcaaggccaagctggacagcctgcaggacatcggcatggaccaccaggccctgctgaagcagttcgaccacctgaaccacctgaaccccgacaagttcgagagcaccgacctggacatgctgatcaaggccgccaccagcgacctggagcactacgacaagaccagacacgaggagttcaagaagtacgagatgatgaaggagcacgagagaagagagtacctgaagaccctgaacgaggagtag

SEQ ID NO: 91665 - DNA, 105 bp, Artificial Sequence; identical to SEQ ID NO: 91661
  Description of Artificial Sequence: Synthetic coding sequence

SEQ ID NO: 91666 - DNA, 120 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccacccctag

SEQ ID NO: 91667 - DNA, 210 bp, Artificial Sequence; identical to SEQ ID NO: 91660
  Description of Artificial Sequence: Synthetic coding sequence

SEQ ID NO: 91668 - DNA, 273 bp, Artificial Sequence
  Description of Artificial Sequence: Synthetic coding sequence
atgagatggagaaccatcctgctgcagtactgcttcctgctgatcacctgcctgctgaccgccctggaggccgtgcccatcgacatcgacaagaccaaggtgcagaacatccaccccgtggagagcgccaagatcgagccccccgacaccggcctgtactacgacgagtacctgaagcaggtgatcgacgtgctggagaccgacaagcacttcagagagaagctgcagaaggccgacatcgaggagatcaagagcggcagactgagcaagtag

SEQ ID NO: 91669 - DNA, 1323 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagcagaaccacagcgagatcaagatcagcaaccccaccgagttccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccgtgatcacccccttcaagctgaccaccgaggccacccagacccccgtgagcaacaagaagcccgtgttcgacctgaaggccagcctgagcagacccctgaactacgagccccacaagggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91670 - DNA, 1209 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagcagaaccacagcgagatcaagatcagcaaccccaccgagttccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91671 - DNA, 1326 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagcagaaccacagcgagatcaagatcagcaaccccaccgagttccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccgtgatcacccccttcaagctgaccaccgaggccacccagacccccgtgagcaacaagaagcccgtgttcgacctgaaggccagcctgagcagacccctgaactacgagccccacaagggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91672 - DNA, 1323 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagaaccacagcgagatcaagatcagcaaccccaccgagttccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccgtgatcacccccttcaagctgaccaccgaggccacccagacccccgtgagcaacaagaagcccgtgttcgacctgaaggccagcctgagcagacccctgaactacgagccccacaagggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91673 - DNA, 1320 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagaaccacagcgagatcaagatcagcaaccccaccgagttccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccgtgatcacccccttcaagctgaccaccgaggccacccagacccccgtgagcaacaagaagcccgtgttcgacctgaaggccagcctgagcagacccctgaactacgagccccacaagggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91674 - DNA, 1281 bp, Artificial Sequence
  Description of Artificial Sequence: Synthetic coding sequence
atgatcatccccagcctggaggagctggacagcctgaagtacagcgacctgcagaacctggccaagagcctgggcctgagagccaacctgagagccaccaagctgctgaaggccctgaagggctacatcaagcacgaggccagaaagggcaacgagaaccaggacgagagccagaccagcgccagcagctgcgacgagaccgagatccagatcagcaaccaggaggaggccgagagacagcccctgggccacgtgaccaagaccagaagaagatgcaagaccgtgagagtggaccccgacagccagaaccacgagaagcaggagagccaggacctgagagccaccgccaaggtgcccagcccccccgacgagcaccaggaggccgagaacgccgtgagcagcggcaacagagacagcaaggtgcccagcgagggcaagaagagcctgtacaccgacgagagcagcaagcccggcaagaacaagagaaccgccatcaccacccccaacttcaagaagctgcacgaggcccacttcaaggagatggagagcatcgaccagtacatcgagagaaagaagaagcacttcgaggagcacaacagcatgaacgagctgaagcagcagcccatcaacaagggcggcgtgagaacccccgtgccccccagaggcagactgagcgtggccagcacccccatcagccagagaagaagccagggcagaagctgcggccccgccagccagagcaccctgggcctgaagggcagcctgaagagaagcgccatcagcgccgccaagaccggcgtgagattcagcgccgccaccaaggacaacgagcacaagagaagcctgaccaagacccccgccagaaagagcgcccacgtgaccgtgagcggcggcacccccaagggcgaggccgtgctgggcacccacaagctgaagaccatcaccggcaacagcgccgccgtgatcacccccttcaagctgaccaccgaggccacccagacccccgtgagcaacaagaagcccgtgttcgacctgaaggccagcctgagcagacccctgaactacgagccccacaagggcaagctgaagccctggggccagagcaaggagaacaactacctgaaccagcacgtgaacagaatcaacttctacaagaagacctacaagcagccccacctgcagaccaaggaggagcagagaaagaagagagagcaggagagaaaggagaagaaggccaaggtgctgggcatgagaagaggcctgatcctggccgaggactag

SEQ ID NO: 91675 - DNA, 2250 bp, Artificial Sequence
  Description of Artificial Sequence: Synthetic coding sequence
atggccgccgccggcagcagaaagagaagactggccgagctgaccgtggacgagttcctggccagcggcttcgacagcgagagcgagagcgagagcgagaacagcccccaggccgagaccagagaggccagagaggccgccagaagccccgacaagcccggcggcagccccagcgccagcagaagaaagggcagagccagcgagcacaaggaccagctgagcagactgaaggacagagaccccgagttctacaagttcctgcaggagaacgaccagagcctgctgaacttcagcgacagcgacagcagcgaggaggaggagggccccttccacagcctgcccgacgtgctggaggaggccagcgaggaggaggacggcgccgaggagggcgaggacggcgacagagtgcccagaggcctgaagggcaagaagaacagcgtgcccgtgaccgtggccatggtggagagatggaagcaggccgccaagcagagactgacccccaagctgttccacgaggtggtgcaggccttcagagccgccgtggccaccaccagaggcgaccaggagagcgccgaggccaacaagttccaggtgaccgacagcgccgccttcaacgccctggtgaccttctgcatcagagacctgatcggctgcctgcagaagctgctgttcggcaaggtggccaaggacagcagcagaatgctgcagcccagcagcagccccctgtggggcaagctgagagtggacatcaaggcctacctgggcagcgccatccagctggtgagctgcctgagcgagaccaccgtgctggccgccgtgctgagacacatcagcgtgctggtgccctgcttcctgaccttccccaagcagtgcagaatgctgctgaagagaatggtgatcgtgtggagcaccggcgaggagagcctgagagtgctggccttcctggtgctgagcagagtgtgcagacacaagaaggacaccttcctgggccccgtgctgaagcagatgtacatcacctacgtgagaaactgcaagttcaccagccccggcgccctgcccttcatcagcttcatgcagtggaccctgaccgagctgctggccctggagcccggcgtggcctaccagcacgccttcctgtacatcagacagctggccatccacctgagaaacgccatgaccaccagaaagaaggagacctaccagagcgtgtacaactggcagtacgtgcactgcctgttcctgtggtgcagagtgctgagcaccgccggccccagcgaggccctgcagcccctggtgtaccccctggcccaggtgatcatcggctgcatcaagctgatccccaccgccagattctaccccctgagaatgcactgcatcagagccctgaccctgctgagcggcagcagcggcgccttcatccccgtgctgcccttcatcctggagatgttccagcaggtggacttcaacagaaagcccggcagaatgagcagcaagcccatcaacttcagcgtgatcctgaagctgagcaacgtgaacctgcaggagaaggcctacagagacggcctggtggagcagctgtacgacctgaccctggagtacctgcacagccaggcccactgcatcggcttccccgagctggtgctgcccgtggtgctgcagctgaagagcttcctgagagagtgcaaggtggccaactactgcagacaggtgcagcagctgctgggcaaggtgcaggagaacagcgcctacatctgcagcagaagacagagagtgagcttcggcgtgagcgagcagcaggccgtggaggcctgggagaagctgaccagagaggagggcacccccctgaccctgtactacagccactggagaaagctgagagacagagagatccagctggagatcagcggcaaggagagactggaggacctgaacttccccgagatcaagagaagaaagatggccgacagaaaggacgaggacagaaagcagttcaaggacctgttcgacctgaacagcagcgaggaggacgacaccgagggcttcagcgagagaggcatcctgagacccctgagcaccagacacggcgtggaggacgacgaggaggacgaggaggagggcgaggaggacagcagcaacagcgaggacggcgaccccgacgccgaggccggcctggcccccggcgagctgcagcagctggcccagggccccgaggacgagctggaggacctgcagctgagcgaggacgactag

SEQ ID NO: 91676 - DNA, 2403 bp, Artificial Sequence
  Description of Artificial Sequence: Synthetic coding sequence
atgaagttcagaagaaacaagaagcagatccccagcttcagaaagctgatcaagaccagcaaggtgaagctggagaacaagctgaagaacaagcagttcaagcagcagagcaccctgaagaagtacagaaaggagcagagaaagctgagacaggccgtgaaggacgccgtgagcaagaagcccatccccctggagaaccccaaggagaagagacccggcaagagaatcgagagagaggaggaggaggaggaggaggccctgcccctggacatgatggacgaggacgacctgcagctgatgaaggacctgggccagagagtgagcttcctgaccagagacctgagcagcagcgagcccgtgcacgccaagaagagaaagcacgagagaatcatcgacaagtacgagaagatccccagaaccctgcagaccgcccccgagaaggagctgatccacctgctgcccatcaaggacaagagcggcatcatcccccagaccagagagaagcccgtgaccgacagcaacaaggacgaggaggaccaggaggaggagagagagctggaggaggagatcatcgaggaccccatccaggagctgaccatcgaggagcacctgatcgagagaaagaagaagctgcaggagaagaagatgcacatcgccgccctggccagcgccatcctgagcgaccccgagaacaacatcaagaagctgaaggagctgagaagcatgctgatggagcaggaccccgacgtggccgtgaccgtgagaaagctggtgatcgtgagcctgatggagctgttcaaggacatcacccccagctacaagatcagacccctgaccgaggccgagaagagcaccaagaccagaaaggagacccagaagctgagagagttcgaggagggcctggtgagccagtacaagttctacctggagaacctggagcagatggtgaaggactggaagcagagaaagctgaagaagagcaacgtggtgagcctgaaggcctacaagggcctggccgaggtggccgtgaagagcctgtgcgagctgctggtggccctgccccacttcaacttccacaacaacatcatcgtgctgatcgtgcccctgatgaacgacatgagcaagctgatcagcgagatgtgctgcgaggccgtgaagaagctgttcaagcaggacaagctgggccaggccagcctgggcgtgatcaaggtgatcagcggcttcgtgaagggcagaaactacgaggtgagacccgagatgctgaagaccttcctgtgcctgagaatcaaggaggtggaggtgaagaaggacaccgaggacatcaacaagcccaagaagttcatgaccttcaaggagaagagaaagagcctgagcagaatgcagagaaagtggaagaaggccgaggagaagctggagagagagctgagagaggccgaggccagcgagagcaccgagaagaagctgaagctgcacaccgagaccctgaacatcgtgttcgtgacctacttcagaatcctgaagaaggcccagagaagccccctgctgcccgccgtgctggagggcctggccaagttcgcccacctgatcaacgtggagttcttcgacgacctgctggtggtgctgcacaccctgatcgagagcggcgacctgagctaccaggagagcctgcactgcgtgcagaccgccttccacatcctgagcggccagggcgacgtgctgaacatcgaccccctgaagttctacacccacctgtacaagaccctgttcaagctgcacgccggcgccaccaacgagggcgtggagatcgtgctgcagtgcctggacgtgatgctgaccaagagaagaaagcaggtgagccagcagagagccctggccttcatcaagagactgtgcaccctggccctgcacgtgctgcccaacagcagcatcggcatcctggccaccaccagaatcctgatgcacaccttccccaagaccgacctgctgctggacagcgagagccagggcagcggcgtgttcctgcccgagctggacgagcccgagtactgcaacgcccagaacaccgccctgtgggagctgcacgccctgagaagacactaccaccccatcgtgcagagattcgccgcccacctgatcgccggcgcccccagcgagggcagcggcgccctgaagcccgagctgagcagaagaagcgccaccgagctgttcgaggcctacagcatggccgagatgaccttcaacccccccgtggagagcagcaaccccaagatcaagggcaagttcctgcagggcgacagcttcctgaacgaggacctgaaccagctgatcaagagatacagcagcgaggtggccaccgagagccccctggacttcaccaagtacctgaagaccagcctgcactag

SEQ ID NO: 91677 - DNA, 2403 bp, Artificial Sequence
  Description of Artificial Sequence: Synthetic coding sequence
atgaaggccagaagaaacaagaagcagatccccagcttcagaaagctgatcaagaccagcaaggtgaagctggagaacaagctgaagaacaagcagttcaagcagcagagcaccctgaagaagtacagaaaggagcagagaaagctgagacaggccgtgaaggacgccgtgagcaagaagcccatccccctggagaaccccaaggagaagagacccggcaagagaatcgagagagaggaggaggaggaggaggaggccctgcccctggacatgatggacgaggacgacctgcagctgatgaaggacctgggccagagagtgagcttcctgaccagagacctgagcagcagcgagcccgtgcacgccaagaagagaaagcacgagagaatcatcgacaagtacgagaagatccccagaaccctgcagaccgcccccgagaaggagctgatccacctgctgcccatcaaggacaagagcggcatcatcccccagaccagagagaagcccgtgaccgacagcaacaaggacgaggaggaccaggaggaggagagagagctggaggaggagatcatcgaggaccccatccaggagctgaccatcgaggagcacctgatcgagagaaagaagaagctgcaggagaagaagatgcacatcgccgccctggccagcgccatcctgagcgaccccgagaacaacatcaagaagctgaaggagctgagaagcatgctgatggagcaggaccccgacgtggccgtgaccgtgagaaagctggtgatcgtgagcctgatggagctgttcaaggacatcacccccagctacaagatcagacccctgaccgaggccgagaagagcaccaagaccagaaaggagacccagaagctgagagagttcgaggagggcctggtgagccagtacaagttctacctggagaacctggagcagatggtgaaggactggaagcagagaaagctgaagaagagcaacgtggtgagcctgaaggcctacaagggcctggccgaggtggccgtgaagagcctgtgcgagctgctggtggccctgccccacttcaacttccacaacaacatcatcgtgctgatcgtgcccctgatgaacgacatgagcaagctgatcagcgagatgtgctgcgaggccgtgaagaagctgttcaagcaggacaagctgggccaggccagcctgggcgtgatcaaggtgatcagcggcttcgtgaagggcagaaactacgaggtgagacccgagatgctgaagaccttcctgtgcctgagaatcaaggaggtggaggtgaagaaggacaccgaggacatcaacaagcccaagaagttcatgaccttcaaggagaagagaaagagcctgagcagaatgcagagaaagtggaagaaggccgaggagaagctggagagagagctgagagaggccgaggccagcgagagcaccgagaagaagctgaagctgcacaccgagaccctgaacatcgtgttcgtgacctacttcagaatcctgaagaaggcccagagaagccccctgctgcccgccgtgctggagggcctggccaagttcgcccacctgatcaacgtggagttcttcgacgacctgctggtggtgctgcacaccctgatcgagagcggcgacctgagctaccaggagagcctgcactgcgtgcagaccgccttccacatcctgagcggccagggcgacgtgctgaacatcgaccccctgaagttctacacccacctgtacaagaccctgttcaagctgcacgccggcgccaccaacgagggcgtggagatcgtgctgcagtgcctggacgtgatgctgaccaagagaagaaagcaggtgagccagcagagagccctggccttcatcaagagactgtgcaccctggccctgcacgtgctgcccaacagcagcatcggcatcctggccaccaccagaatcctgatgcacaccttccccaagaccgacctgctgctggacagcgagagccagggcagcggcgtgttcctgcccgagctggacgagcccgagtactgcaacgcccagaacaccgccctgtgggagctgcacgccctgagaagacactaccaccccatcgtgcagagattcgccgcccacctgatcgccggcgcccccagcgagggcagcggcgccctgaagcccgagctgagcagaagaagcgccaccgagctgttcgaggcctacagcatggccgagatgaccttcaacccccccgtggagagcagcaaccccaagatcaagggcaagttcctgcagggcgacagcttcctgaacgaggacctgaaccagctgatcaagagatacagcagcgaggtggccaccgagagccccctggacttcaccaagtacctgaagaccagcctgcactag

SEQ ID NO: 91678 - DNA, 1506 bp, Artificial Sequence
  Description of Artificial Sequence: Synthetic coding sequence
atggagctgttcaaggacatcacccccagctacaagatcagacccctgaccgaggccgagaagagcaccaagaccagaaaggagacccagaagctgagagagttcgaggagggcctggtgagccagtacaagttctacctggagaacctggagcagatggtgaaggactggaagcagagaaagctgaagaagagcaacgtggtgagcctgaaggcctacaagggcctggccgaggtggccgtgaagagcctgtgcgagctgctggtggccctgccccacttcaacttccacaacaacatcatcgtgctgatcgtgcccctgatgaacgacatgagcaagctgatcagcgagatgtgctgcgaggccgtgaagaagctgttcaagcaggacaagctgggccaggccagcctgggcgtgatcaaggtgatcagcggcttcgtgaagggcagaaactacgaggtgagacccgagatgctgaagaccttcctgtgcctgagaatcaaggaggtggaggtgaagaaggacaccgaggacatcaacaagcccaagaagttcatgaccttcaaggagaagagaaagagcctgagcagaatgcagagaaagtggaagaaggccgaggagaagctggagagagagctgagagaggccgaggccagcgagagcaccgagaagaagctgaagctgcacaccgagaccctgaacatcgtgttcgtgacctacttcagaatcctgaagaaggcccagagaagccccctgctgcccgccgtgctggagggcctggccaagttcgcccacctgatcaacgtggagttcttcgacgacctgctggtggtgctgcacaccctgatcgagagcggcgacctgagctaccaggagagcctgcactgcgtgcagaccgccttccacatcctgagcggccagggcgacgtgctgaacatcgaccccctgaagttctacacccacctgtacaagaccctgttcaagctgcacgccggcgccaccaacgagggcgtggagatcgtgctgcagtgcctggacgtgatgctgaccaagagaagaaagcaggtgagccagcagagagccctggccttcatcaagagactgtgcaccctggccctgcacgtgctgcccaacagcagcatcggcatcctggccaccaccagaatcctgatgcacaccttccccaagaccgacctgctgctggacagcgagagccagggcagcggcgtgttcctgcccgagctggacgagcccgagtactgcaacgcccagaacaccgccctgtgggagctgcacgccctgagaagacactaccaccccatcgtgcagagattcgccgcccacctgatcgccggcgcccccagcgagggcagcggcgccctgaagcccgagctgagcagaagaagcgccaccgagctgttcgaggcctacagcatggccgagatgaccttcaacccccccgtggagagcagcaaccccaagatcaaggtgaccaccaagggctag

SEQ ID NO: 91679 - DNA, 1551 bp, Artificial Sequence
  Description of Artificial Sequence: Synthetic coding sequence
atggagagagagcccggcgccgccggcgtgagaagagccctgggcagaagactggaggccgtgctggccagcagaagcgaggccaacgccgtgttcgacatcctggccgtgctgcagagcgaggaccaggaggagatccaggaggccgtgagaacctgcagcagactgttcggcgccctgctggagagaggcgagctgttcgtgggccagctgcccagcgaggagatggtgatgaccggcagccagggcgccaccagaaagtacaaggtgtggatgagacacagataccacagctgctgcaacagactgggcgagctgctgggccaccccagcttccaggtgaaggagctggccctgagcgccctgctgaagttcgtgcagctggagggcgcccaccccctggagaagagcaagtgggagggcaactacctgttccccagagagctgttcaagctggtggtgggcggcctgctgagccccgaggaggaccagagcctgctgctgagccagttcagagagtacctggactacgacgacaccagataccacaccatgcaggccgccgtggacgccgtggccagagtgaccggccagcaccccgaggtgccccccgccttctggaacaacgccttcaccctgctgagcgccgtgagcctgcccagaagagagcccaccgtgagcagcttctacgtgaagagagccgagctgtgggacacctggaaggtggcccacctgaaggagcacagaagagtgttccaggccatgtggctgagcttcctgaagcacaagctgcccctgagcctgtacaagaaggtgctgctgatcgtgcacgacgccatcctgccccagctggcccagcccaccctgatgatcgacttcctgaccagagcctgcgacctgggcggcgccctgagcctgctggccctgaacggcctgttcatcctgatccacaagcacaacctggagtaccccgacttctacagaaagctgtacggcctgctggaccccagcgtgttccacgtgaagtacagagccagattcttccacctggccgacctgttcctgagcagcagccacctgcccgcctacctggtggccgccttcgccaagagactggccagactggccctgaccgccccccccgaggccctgctgatggtgctgcccttcatctgcaacctgctgagaagacaccccgcctgcagagtgctggtgcacagaccccacggccccgagctggacgccgacccctacgaccccggcgaggaggaccccgcccagagcagagccctggagagcagcctgtgggagctgcaggccctgcagagacactaccaccccgaggtgagcaaggccgccagcgtgatcaaccaggccctgagcatgcccgaggtgagcatcgcccccctgctggagctgaccgcctacgagatcttcgagagagacctgaagaagaagggccccgagcccgtgcccctggagttcatccccgcccagggcctgctgggcagacccggcgagctgtgcgcccagcacttcaccctgagctag

SEQ ID NO: 91680 - DNA, 252 bp, Artificial Sequence
  Description of Artificial Sequence: Synthetic coding sequence
tgacccgaggagctgaccttcgccagcgcccaggccgaggccagagaggaggagagaagagtgagagagaccgtgagaagagacaagaccctgctgaaggagaagagaaagagaagagaggagctgttcatcgagcagaagaagagaaagctgctgcccgacaccatcctggagaagctgaccaccgccagccagaccaacatcaagaagagccccggcaaggtgaaggagggcatgaccatcctgatctag

SEQ ID NO: 91681 - DNA, 774 bp, Artificial Sequence
  Description of Artificial Sequence: Synthetic coding sequence
atggtgcagctgagacccagagccagcagagcccccgccagcgccgaggccatggtggacgagggccagctggccagcgaggaggaggaggccgagcacggcctgctgctgggccagcccagcagcggcgccgccgccgagcccctggaggaggacgaggagggcgacgacgagttcgacgacgaggcccccgaggagctgaccttcgccagcgcccaggccgaggccagagaggaggagagaagagtgagagagaccgtgagaagagacaagaccctgctgaaggagaagagaaagagaagagaggagctgttcatcgagcagaagaagagaaagctgctgcccgacaccatcctggagaagctgaccaccgccagccagaccaacatcaagaagagccccggcaaggtgaaggaggtgaacctgcagaagaagaacgaggactgcgagaagggcaacgacagcaagaaggtgaaggtgcagaaggtgcagagcgtgagccagaacaagagctacctggccgtgagactgaaggaccaggacctgagagacagcagacagcaggccgcccaggccttcatccacaacagcctgtacggccccggcaccaacagaaccaccgtgaacaagttcctgagcctggccaacaagagactgcccgtgaagagagccgccgtgcagttcctgaacaacgcctggggcatccagaagaagcagaacgccaagagattcaagagaagatggatggtgagaaagatgaagaccaagaagtag

SEQ ID NO: 91682 - DNA, 3300 bp, Artificial Sequence
  Description of Artificial Sequence: Synthetic coding sequence
atgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagagaaagatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctgcgacagcatcacccccagcaagagcagccccgtgcccgtgagcgacacccagaagctgaagaacctgcccttcaagaccagcggcctggagaccgccaagaagagaaacagcatcagcgacgacgacaccgacagcgaggacgagctgagaatgatgatcgccaaggaggagaacctgcagagaaccacccagcccagcatcaacgagagcgagagcgaccccttcgaggtggtgagagacgacttcaagagcggcgtgcacaagctgcacagcctgatcggcctgggcatcaagaacagagtgagctgccacgacagcgacgacgacatcatgagaaacgacagagagtacgacagcggcgacaccgacgagatcatcgccatgaagaagaacgtggccaaggtgaagaacagcaccgagttcagccagatggagaagagcaccaagaagaccagcttcaagaacagagagaactgcgagctgagcgaccactgcatcaagctgcagaagagaaagagcaacgtggagagcgccctgagccacggcctgaagagcctgaacagaaagagccccagccacagcagcagcagcgaggacgccgacagcgccagcgagctggccgacagcgagggcggcgaggagtacaacgccatgatgaagaactgcctgagagtgaacctgaccctggccgacctggagcagctggccggcagcgacctgaaggtgcccaacgaggacaccaagagcgacggccccgagaccaccacccagtgcaagttcgacagaggcagcaagagccccaagacccccaccggcctgagaagaggcagacagtgcatcagacccgccgagatcgtggccagcctgctggagggcgaggagaacacctgcggcaagcagaagcccaaggagaacaacctgaagcccaagttccaggccttcaagggcgtgggctgcctgtacgagaaggagagcatgaagaagagcctgaaggacagcgtggccagcaacaacaaggaccagaacagcatgaagcacgaggaccccagcatcatcagcatggaggacggcagcccctacgtgaacggcagcctgggcgaggtgaccccctgccagcacgccaagaaggccaacggccccaactacatccagccccagaagagacagaccaccttcgagagccaggacagaaaggccgtgagccccagcagcagcgagaagagaagcaagaaccccatcagcagacccctggagggcaagaagagcctgagcctgagcgccaagacccacaacatcggcttcgacaaggacagctgccacagcaccaccaagaccgaggccagccaggaggagagaagcgacagcagcggcctgaccagcctgaagaagagccccaaggtgagcagcaaggacaccagagagatcaagaccgacttcagcctgagcatcagcaacagcagcgacgtgagcgccaaggacaagcacgccgaggacaacgagaagagactggccgccctggaggccagacagaaggccaaggaggtgcagaagaagctggtgcacaacgccctggccaacctggacggccaccccgaggacaagcccacccacatcatcttcggcagcgacagcgagtgcgagaccgaggagaccagcacccaggagcagagccaccccggcgaggagtgggtgaaggagagcatgggcaagaccagcggcaagctgttcgacagcagcgacgacgacgagagcgacagcgaggacgacagcaacagattcaagatcaagccccagttcgagggcagagccggccagaagctgatggacctgcagagccacttcggcaccgacgacagattcagaatggacagcagattcctggagaccgacagcgaggaggagcaggaggaggtgaacgagaagaagaccgccgaggaggaggagctggccgaggagaagaagaaggccctgaacgtggtgcagagcgtgctgcagatcaacctgagcaacagcaccaacagaggcagcgtggccgccaagaagttcaaggacatcatccactacgaccccaccaagcaggaccacgccacctacgagagaaagagagacgacaagcccaaggagagcaaggccaagagaaagaagaagagagaggaggccgagaagctgcccgaggtgagcaaggagatgtactacaacatcgccatggacctgaaggagatcttccagaccaccaagtacaccagcgagaaggaggagggcaccccctggaacgaggactgcggcaaggagaagcccgaggagatccaggaccccgccgccctgaccagcgacgccgagcagcccagcggcttcaccttcagcttcttcgacagcgacaccaaggacatcaaggaggagacctacagagtggagaccgtgaagcccggcaagatcgtgtggcaggaggaccccagactgcaggacagcagcagcgaggaggaggacgtgaccgaggagaccgaccacagaaacagcagccccggcgaggccagcctgctggagaaggagaccaccagattcttcttcttcagcaagaacgacgagagactgcagggcagcgacctgttctggagaggcgtgggcagcaacatgagcagaaacagctgggaggccagaaccaccaacctgagaatggactgcagaaagaagcacaaggacgccaagagaaagatgaagcccaagtag

SEQ ID NO: 91683 - DNA, 3396 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagcacctgagaaacatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctgcgacagcatcacccccagcaagagcagccccgtgcccgtgagcgacacccagaagctgaagaacctgcccttcaagaccagcggcctggagaccgccaagaagagaaacagcatcagcgacgacgacaccgacagcgaggacgagctgagaatgatgatcgccaaggaggagaacctgcagagaaccacccagcccagcatcaacgagagcgagagcgaccccttcgaggtggtgagagacgacttcaagagcggcgtgcacaagctgcacagcctgatcggcctgggcatcaagaacagagtgagctgccacgacagcgacgacgacatcatgagaaacgacagagagtacgacagcggcgacaccgacgagatcatcgccatgaagaagaacgtggccaaggtgaagaacagcaccgagttcagccagatggagaagagcaccaagaagaccagcttcaagaacagagagaactgcgagctgagcgaccactgcatcaagctgcagaagagaaagagcaacgtggagagcgccctgagccacggcctgaagagcctgaacagaaagagccccagccacagcagcagcagcgaggacgccgacagcgccagcgagctggccgacagcgagggcggcgaggagtacaacgccatgatgaagaactgcctgagagtgaacctgaccctggccgacctggagcagctggccggcagcgacctgaaggtgcccaacgaggacaccaagagcgacggccccgagaccaccacccagtgcaagttcgacagaggcagcaagagccccaagacccccaccggcctgagaagaggcagacagtgcatcagacccgccgagatcgtggccagcctgctggagggcgaggagaacacctgcggcaagcagaagcccaaggagaacaacctgaagcccaagttccaggccttcaagggcgtgggctgcctgtacgagaaggagagcatgaagaagagcctgaaggacagcgtggccagcaacaacaaggaccagaacagcatgaagcacgaggaccccagcatcatcagcatggaggacggcagcccctacgtgaacggcagcctgggcgaggtgaccccctgccagcacgccaagaaggccaacggccccaactacatccagccccagaagagacagaccaccttcgagagccaggacagaaaggccgtgagccccagcagcagcgagaagagaagcaagaaccccatcagcagacccctggagggcaagaagagcctgagcctgagcgccaagacccacaacatcggcttcgacaaggacagctgccacagcaccaccaagaccgaggccagccaggaggagagaagcgacagcagcggcctgaccagcctgaagaagagccccaaggtgagcagcaaggacaccagagagatcaagaccgacttcagcctgagcatcagcaacagcagcgacgtgagcgccaaggacaagcacgccgaggacaacgagaagagactggccgccctggaggccagacagaaggccaaggaggtgcagaagaagctggtgcacaacgccctggccaacctggagagcatgggcaagaccagcggcaagctgttcgacagcagcgacgacgacgagagcgacagcgaggacgacagcaacagattcaagatcaagccccagttcgagggcagagccggccagaagctgatggacctgcagagccacttcggcaccgacgacagattcagaatggacagcagattcctggagaccgacagcgaggaggagcaggaggaggtgaacgagaagaagaccgccgaggaggaggagctggccgaggagaagaagaaggccctgaacgtggtgcagagcgtgctgcagatcaacctgagcaacagcaccaacagaggcagcgtggccgccaagaagttcaaggacatcatccactacgaccccaccaagcaggaccacgccacctacgagagaaagagagacgacaagcccaaggagagcaaggccaagagaaagaagaagagagaggaggccgagaagctgcccgaggtgagcaaggagatgtactacaacatcgccatggacctgaaggagatcttccagaccaccaagtacaccagcgagaaggaggagggcaccccctggaacgaggactgcggcaaggagaagcccgaggagatccaggaccccgccgccctgaccagcgacgccgagcagcccagcggcttcaccttcagcttcttcgacagcgacaccaaggacatcaaggaggagacctacagagtggagaccgtgaagcccggcaagatcgtgtggcaggaggaccccagactgcaggacagcagcagcgaggaggaggacgtgaccgaggagaccgaccacagaaacagcagccccggcgaggccagcctgctggagaaggagaccaccagattcttcttcttcagcaagaacgacgagagactgcagggcagcgacctgttctggagaggcgtgggcagcaacatgagcagaaacagctgggaggccagaaccaccaacctgagaatggactgcagaaagaagcacaaggacgccaagagaaagatgaagcccaagtag

SEQ ID NO: 91684 - DNA, 777 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagagaaagatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctag

SEQ ID NO: 91685 - DNA, 2913 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagagaaagatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctgcgacagcatcacccccagcaagagcagccccgtgcccgtgagcgacacccagaagctgaagaacctgcccttcaagaccagcggcctggagaccgccaagaagagaaacagcatcagcgacgacgacaccgacagcgaggacgagctgagaatgatgatcgccaaggaggagaacctgcagagaaccacccagcccagcatcaacgagagcgagagcgaccccttcgaggtggtgagagacgacttcaagagcggcgtgcacaagctgcacagcctgatcggcctgggcatcaagaacagagtgagctgccacgacagcgacgacgacatcatgagaaacgacagagagtacgacagcggcgacaccgacgagatcatcgccatgaagaagaacgtggccaaggtgaagaacagcaccgagttcagccagatggagaagagcaccaagaagaccagcttcaagaacagagagaactgcgagctgagcgaccactgcatcaagctgcagaagagaaagagcaacgtggagagcgccctgagccacggcctgaagagcctgaacagaaagagccccagccacagcagcagcagcgaggacgccgacagcgccagcgagctggccgacagcgagggcggcgaggagtacaacgccatgatgaagaactgcctgagagtgaacctgaccctggccgacctggagcagctggccggcagcgacctgaaggtgcccaacgaggacaccaagagcgacggccccgagaccaccacccagtgcaagttcgacagaggcagcaagagccccaagacccccaccggcctgagaagaggcagacagtgcatcagacccgccgagatcgtggccagcctgctggagggcgaggagaacacctgcggcaagcagaagcccaaggagaacaacctgaagcccaagttccaggccttcaagggcgtgggctgcctgtacgagaaggagagcatgaagaagagcctgaaggacagcgtggccagcaacaacaaggaccagaacagcatgaagcacgaggaccccagcatcatcagcatggaggacggcagcccctacgtgaacggcagcctgggcgaggtgaccccctgccagcacgccaagaaggccaacggccccaactacatccagccccagaagagacagaccaccttcgagagccaggacagaaaggccgtgagccccagcagcagcgagaagagaagcaagaaccccatcagcagacccctggagggcaagaagagcctgagcctgagcgccaagacccacaacatcggcttcgacaaggacagctgccacagcaccaccaagaccgaggccagccaggaggagagaagcgacagcagcggcctgaccagcctgaagaagagccccaaggtgagcagcaaggacaccagagagatcaagaccgacttcagcctgagcatcagcaacagcagcgacgtgagcgccaaggacaagcacgccgaggacaacgagaagagactggccgccctggaggccagacagaaggccaaggaggtgcagaagaagctggtgcacaacgccctggccaacctggacggccaccccgaggacaagcccacccacatcatcttcggcagcgacagcgagtgcgagaccgaggagaccagcacccaggagcagagccaccccggcgaggagtgggtgaaggagagcatgggcaagaccagcggcaagctgttcgacagcagcgacgacgacgagagcgacagcgaggacgacagcaacagattcaagatcaagccccagttcgagggcagagccggccagaagctgatggacctgcagagccacttcggcaccgacgacagattcagaatggacagcagattcctggagaccgacagcgaggaggagcaggaggaggtgaacgagaagaagaccgccgaggaggaggagctggccgaggagaagaagaaggccctgaacgtggtgcagagcgtgctgcagatcaacctgagcaacagcaccaacagaggcagcgtggccgccaagaagttcaaggacatcatccactacgaccccaccaagcaggaccacgccacctacgagagaaagagagacgacaagcccaaggagagcaaggcctag

SEQ ID NO: 91686 - DNA, 1242 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagagaaagatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctgcgacagcatcacccccagcaagagcagccccgtgcccgtgagcgacacccagaagctgaagaacctgcccttcaagaccagcggcctggagaccgccaagaagagaaacagcatcagcgacgacgacaccgacagcgaggacgagctgagaatgatgatcgccaaggaggagaacctgcagagaaccacccagcccagcatcaacgagagcgagagcgaccccttcgaggtggtgagagacgacttcaagagcggcgtgcacaagctgcacagcctgatcggcctgggcatcaagaacagagtgagctgccacgacagcgacgacgacatcatgagaaacgacagagagtacgacagcggcgacaccgacgagatcatcgccatgaagaagaacgtggccaaggtgaagaacagcaccgagttcagccagatggagaagagcaccaagaagaccagcttcaagtag

SEQ ID NO: 91687 - DNA, 3504 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagttcggcagagtgctgcccgtgctgcacctgaagaaccagcacaagagaaagatcatcaagtacgaccccagcaagtactgccacaacctgaagaagatcggcgaggacttcagcaacaccatccccatcagcagcctgacctgggagctggagggcggcaacgaccccatgagcaagaagagaagaggcgagttcagcgacttccacggcccccccaagaagatcatcaaggtgcagaaggacgagagcagcaccggcagcctggccatgagcaccagacccagaagagtgatcgagagaccccccctgacccagcagcaggccgcccagaagagaacctgcgacagcatcacccccagcaagagcagccccgtgcccgtgagcgacacccagaagctgaagaacctgcccttcaagaccagcggcctggagaccgccaagaagagaaacagcatcagcgacgacgacaccgacagcgaggacgagctgagaatgatgatcgccaaggaggagaacctgcagagaaccacccagcccagcatcaacgagagcgagagcgaccccttcgaggtggtgagagacgacttcaagagcggcgtgcacaagctgcacagcctgatcggcctgggcatcaagaacagagtgagctgccacgacagcgacgacgacatcatgagaaacgacagagagtacgacagcggcgacaccgacgagatcatcgccatgaagaagaacgtggccaaggtgaagaacagcaccgagttcagccagatggagaagagcaccaagaagaccagcttcaagaacagagagaactgcgagctgagcgaccactgcatcaagctgcagaagagaaagagcaacgtggagagcgccctgagccacggcctgaagagcctgaacagaaagagccccagccacagcagcagcagcgaggacgccgacagcgccagcgagctggccgacagcgagggcggcgaggagtacaacgccatgatgaagaactgcctgagagtgaacctgaccctggccgacctggagcagctggccggcagcgacctgaaggtgcccaacgaggacaccaagagcgacggccccgagaccaccacccagtgcaagttcgacagaggcagcaagagccccaagacccccaccggcctgagaagaggcagacagtgcatcagacccgccgagatcgtggccagcctgctggagggcgaggagaacacctgcggcaagcagaagcccaaggagaacaacctgaagcccaagttccaggccttcaagggcgtgggctgcctgtacgagaaggagagcatgaagaagagcctgaaggacagcgtggccagcaacaacaaggaccagaacagcatgaagcacgaggaccccagcatcatcagcatggaggacggcagcccctacgtgaacggcagcctgggcgaggtgaccccctgccagcacgccaagaaggccaacggccccaactacatccagccccagaagagacagaccaccttcgagagccaggacagaaaggccgtgagccccagcagcagcgagaagagaagcaagaaccccatcagcagacccctggagggcaagaagagcctgagcctgagcgccaagacccacaacatcggcttcgacaaggacagctgccacagcaccaccaagaccgaggccagccaggaggagagaagcgacagcagcggcctgaccagcctgaagaagagccccaaggtgagcagcaaggacaccagagagatcaagaccgacttcagcctgagcatcagcaacagcagcgacgtgagcgccaaggacaagcacgccgaggacaacgagaagagactggccgccctggaggccagacagaaggccaaggaggtgcagaagaagctggtgcacaacgccctggccaacctggacggccaccccgaggacaagcccacccacatcatcttcggcagcgacagcgagtgcgagaccgaggagaccagcacccaggagcagagccaccccggcgaggagtgggtgaaggagagcatgggcaagaccagcggcaagctgttcgacagcagcgacgacgacgagagcgacagcgaggacgacagcaacagattcaagatcaagccccagttcgagggcagagccggccagaagctgatggacctgcagagccacttcggcaccgacgacagattcagaatggacagcagattcctggagaccgacagcgaggaggagcaggaggaggtgaacgagaagaagaccgccgaggaggaggagctggccgaggagaagaagaaggccctgaacgtggtgcagagcgtgctgcagatcaacctgagcaacagcaccaacagaggcagcgtggccgccaagaagttcaaggacatcatccactacgaccccaccaagcaggaccacgccacctacgagagaaagagagacgacaagcccaaggagagcaaggccaagagaaagaagaagagagaggaggccgagaagctgcccgaggtgagcaaggagatgtactacaacatcgccatggacctgaaggagatcttccagaccaccaagtacaccagcgagaaggaggagggcaccccctggaacgaggactgcggcaaggagaagcccgaggagatccaggaccccgccgccctgaccagcgacgccgagcagcccagcggcttcaccttcagcttcttcgacagcgacaccaaggacatcaaggaggagacctacagagtggagaccgtgaagcccggcaagatcgtgtggcaggaggaccccagactgcaggacagcagcagcgaggaggaggacgtgaccgaggagaccgaccacagaaacagcagccccggcgaggccagcctgctggagaaggagaccaccagattcttcttcttcagcaagaacgacgagagactgcagggcagcgacctgttctggagaggcgtgggcagcaacatgagcagaaacagctgggaggccagaaccaccaacctgagaatggactgcagaaagaagcacaaggacgccaagagaaagatgaagcccaagtag

SEQ ID NO: 91688 - DNA, 438 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagtgcatgagcgtgctgaacaagaccaagtggaagggcggcaccctgcagatccagctggccaaggagagcttcctgcacagactggcccaggagagagaggccgccaaggccaagaaggaggagagcaccaccggcaacgccaacctgctggagaagaccggcggcgtggacttccacatgaaggccgtgcccggcaccgaggtgcccggccacaagaactgggtggtgagcaagtag

SEQ ID NO: 91689 - DNA, 3504 bp, Artificial Sequence; identical to SEQ ID NO: 91687
  Description of Artificial Sequence: Synthetic coding sequence

SEQ ID NO: 91690 - DNA, 261 bp, Artificial Sequence
  Description of Artificial Sequence: Synthetic coding sequence
atgaaggtgaacagagagaccaagagactgtacgtgggcggcctgagccaggacatcagcgaggccgacctgcagaaccagttcagcagattcggcgaggtgagcgacgtggagatcatcaccagaaaggacgaccagggcaacccccagaaggtgttcgcctacatcaacatcagcgtggccgaggccgacctgaagaagagcatcttccacgtgatccagagagacagcagcgacgaggagaacagcagcatcgtgtag

SEQ ID NO: 91691 - DNA, 3441 bp, Artificial Sequence
  Description of Artificial Sequence: Synthetic coding sequence
atgggccccgcccccgccggcgagcagctgagaggcgccaccggcgagcccgaggtgatggagcccgccctggagggcaccggcaaggagggcaagaaggccagcagcagaaagagaaccctggccgagccccccgccaagggcctgctgcagcccgtgaagctgagcagagccgagctgtacaaggagcccaccaacgaggagctgaacagactgagagagaccgagatcctgttccacagcagcctgctgagactgcaggtggaggagctgctgaaggaggtgagactgagcgagaagaagaaggacagaatcgacgccttcctgagagaggtgaaccagagagtggtgagagtgcccagcgtgcccgagaccgagctgaccgaccaggcctggctgcccgccggcgtgagagtgcccctgcaccaggtgccctacgccgtgaagggctgcttcagattcctgccccccgcccaggtgaccgtggtgggcagctacctgctgggcacctgcatcagacccgacatcaacgtggacgtggccctgaccatgcccagagagatcctgcaggacaaggacggcctgaaccagagatacttcagaaagagagccctgtacctggcccacctggcccaccacctggcccaggaccccctgttcggcagcgtgtgcttcagctacaccaacggctgccacctgaagcccagcctgctgctgagacccagaggcaaggacgagagactggtgaccgtgagactgcacccctgccccccccccgacttcttcagaccctgcagactgctgcccaccaagaacaacgtgagaagcgcctggtacagaggccagagccccgccggcgacggcagccccgagccccccacccccagatacaacacctgggtgctgcaggacaccgtgctggagagccacctgcagctgctgagcaccatcctgagcagcgcccagggcctgaaggacggcgtggccctgctgaaggtgtggctgagacagagagagctggacaagggccagggcggcttcaccggcttcctggtgagcatgctggtggtgttcctggtgagcaccagaaagatccacaccaccatgagcggctaccaggtgctgagaagcgtgctgcagttcctggccaccaccgacctgaccgtgaacggcatcagcctgtgcctgagcagcgaccccagcctgcccgccctggccgacttccaccaggccttcagcgtggtgttcctggacagcagcggccacctgaacctgtgcgccgacgtgaccgccagcacctaccaccaggtgcagcacgaggccagactgagcatgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggagaccagcagcaccggcgaggaggccctggtggccgccgtgagatgctacgacgacctgagcagactgctgtggggcctggagggcctgcccctgaccgtgagcgccgtgcagggcgcccaccccgtgctgagatacaccgaggtgttcccccccacccccgtgagacccgccttcagcttctacgagaccctgagagagagaagcagcctgctgcccagactggacaagccctgccccgcctacgtggagcccatgaccgtggtgtgccacctggagggcagcggccagtggccccaggacgccgaggccgtgcagagagtgagagccgccttccagctgagactggccgagctgctgacccagcagcacggcctgcagtgcagagccaccgccacccacaccgacgtgctgaaggacggcttcgtgttcagaatcagagtggcctaccagagagagccccagatcctgaaggaggtgcagagccccgagggcatgatcagcctgagagacaccgccgccagcctgagactggagagagacaccagacagctgcccctgctgaccagcgccctgcacggcctgcagcagcagcaccccgccttcagcggcgtggccagactggccaagagatgggtgagagcccagctgctgggcgagggcttcgccgacgagagcctggacctggtggccgccgccctgttcctgcaccccgagcccttcaccccccccagcagcccccaggtgggcttcctgagattcctgttcctggtgagcaccttcgactggaagaacaaccccctgttcgtgaacctgaacaacgagctgaccgtggaggagcaggtggagatcagaagcggcttcctggccgccagagcccagctgcccgtgatggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagaaccgtgttcagaccccccctggacatctacgacgtgctgatcagactgagccccagacacatccccagacacagacaggccgtggacagccccgccgccagcttctgcagaggcctgctgagccagcccggccccagcagcctgatgcccgtgctgggctacgaccccccccagctgtacctgacccagctgagagaggccttcggcgacctggccctgttcttctacgaccagcacggcggcgaggtgatcggcgtgctgtggaagcccaccagcttccagccccagcccttcaaggccagcagcaccaagggcagaatggtgatgagcagaggcggcgagctggtgatggtgcccaacgtggaggccatcctggaggacttcgccgtgctgggcgagggcctggtgcagaccgtggaggccagaagcgagagatggaccgtgtag

SEQ ID NO: 91692 - DNA, 3024 bp, Artificial Sequence
  Description of Artificial Sequence: Synthetic coding sequence
atgggccccgcccccgccggcgagcagctgagaggcgccaccggcgagcccgaggtgatggagcccgccctggagggcaccggcaaggagggcaagaaggccagcagcagaaagagaaccctggccgagccccccgccaagggcctgctgcagcccgtgaagctgagcagagccgagctgtacaaggagcccaccaacgaggagctgaacagactgagagagaccgagatcctgttccacagcagcctgctgagactgcaggtggaggagctgctgaaggaggtgagactgagcgagaagaagaaggacagaatcgacgccttcctgagagaggtgaaccagagagtggtgagagtgcccagcgtgcccgagaccgagctgaccgaccaggcctggctgcccgccggcgtgagagtgcccctgcaccaggtgccctacgccgtgaagggctgcttcagattcctgccccccgcccaggtgaccgtggtgggcagctacctgctgggcacctgcatcagacccgacatcaacgtggacgtggccctgaccatgcccagagagatcctgcaggacaaggacggcctgaaccagagatacttcagaaagagagccctgtacctggcccacctggcccaccacctggcccaggaccccctgttcggcagcgtgtgcttcagctacaccaacggctgccacctgaagcccagcctgctgctgagacccagaggcaaggacgagagactggtgaccgtgagactgcacccctgccccccccccgacttcttcagaccctgcagactgctgcccaccaagaacaacgtgagaagcgcctggtacagaggccagagccccgccggcgacggcagccccgagccccccacccccagatacaacacctgggtgctgcaggacaccgtgctggagagccacctgcagctgctgagcaccatcctgagcagcgcccagggcctgaaggacggcgtggccctgctgaaggtgtggctgagacagagagagctggacaagggccagggcggcttcaccggcttcctggtgagcatgctggtggtgttcctggtgagcaccagaaagatccacaccaccatgagcggctaccaggtgctgagaagcgtgctgcagttcctggccaccaccgacctgaccgtgaacggcatcagcctgtgcctgagcagcgaccccagcctgcccgccctggccgacttccaccaggccttcagcgtggtgttcctggacagcagcggccacctgaacctgtgcgccgacgtgaccgccagcacctaccaccaggtgcagcacgaggccagactgagcatgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggagaccagcagcaccggcgaggaggccctggtggccgccgtgagatgctacgacgacctgagcagactgctgtggggcctggagggcctgcccctgaccgtgagcgccgtgcagggcgcccaccccgtgctgagatacaccgaggtgttcccccccacccccgtgagacccgccttcagcttctacgagaccctgagagagagaagcagcctgctgcccagactggacaagccctgccccgcctacgtggagcccatgaccgtggtgtgccacctggagggcagcggccagtggccccaggacgccgaggccgtgcagagagtgagagccgccttccagctgagactggccgagctgctgacccagcagcacggcctgcagtgcagagccaccgccacccacaccgacgtgctgaaggacggcttcgtgttcagaatcagagtggcctaccagagagagccccagatcctgaaggaggtgcagagccccgagggcatgatcagcctgagagacaccgccgccagcctgagactggagagagacaccagacagctgcccctgctgaccagcgccctgcacggcctgcagcagcagcaccccgccttcagcggcgtggccagactggccaagagatgggtgagagcccagctgctgggcgagggcttcgccgacgagagcctggacctggtggccgccgccctgttcctgcaccccgagcccttcaccccccccagcagcccccaggtgggcttcctgagattcctgttcctggtgagcaccttcgactggaagaacaaccccctgttcgtgaacctgaacaacgagctgaccgtggaggagcaggtggagatcagaagcggcttcctggccgccagagcccagctgcccgtgatggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagatgggaccccgccaagatgtggcccttctag

SEQ ID NO: 91693 - DNA, 2100 bp, Artificial Sequence
  Description of Artificial Sequence: Synthetic coding sequence
atgggccccgcccccgccggcgagcagctgagaggcgccaccggcgagcccgaggtgatggagcccgccctggagggcaccggcaaggagggcaagaaggccagcagcagaaagagaaccctggccgagccccccgccaagggcctgctgcagcccgtgaagctgagcagagccgagctgtacaaggagcccaccaacgaggagctgaacagactgagagagaccgagatcctgttccacagcagcctgctgagactgcaggtggaggagctgctgaaggaggtgagactgagcgagaagaagaaggacagaatcgacgccttcctgagagaggtgaaccagagagtggtgagagtgcccagcgtgcccgagaccgagctgaccgaccaggcctggctgcccgccggcgtgagagtgcccctgcaccaggtgccctacgccgtgaagggctgcttcagattcctgccccccgcccaggtgaccgtggtgggcagctacctgctgggcacctgcatcagacccgacatcaacgtggacgtggccctgaccatgcccagagagatcctgcaggacaaggacggcctgaaccagagatacttcagaaagagagccctgtacctggcccacctggcccaccacctggcccaggaccccctgttcggcagcgtgtgcttcagctacaccaacggctgccacctgaagcccagcctgctgctgagacccagaggcaaggacgagagactggtgaccgtgagactgcacccctgccccccccccgacttcttcagaccctgcagactgctgcccaccaagaacaacgtgagaagcgcctggtacagaggccagagccccgccggcgacggcagccccgagccccccacccccagatacaacacctgggtgctgcaggacaccgtgctggagagccacctgcagctgctgagcaccatcctgagcagcgcccagggcctgaaggacggcgtggccctgctgaaggtgtggctgagacagagagagctggacaagggccagggcggcttcaccggcttcctggtgagcatgctggtggtgttcctggtgagcaccagaaagatccacaccaccatgagcggctaccaggtgctgagaagcgtgctgcagttcctggccaccaccgacctgaccgtgaacggcatcagcctgtgcctgagcagcgaccccagcctgcccgccctggccgacttccaccaggccttcagcgtggtgttcctggacagcagcggccacctgaacctgtgcgccgacgtgaccgccagcacctaccaccaggtgcagcacgaggccagactgagcatgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggaggccagcagcaccaagggcagaatggtgatgagcagaggcggcgagctggtgatggtgcccaacgtggaggccatcctggaggacttcgccgtgctgggcgagggcctggtgcagaccgtggaggccagaagcgagagatggaccgtgtag

SEQ ID NO: 91694 - DNA, 603 bp, Artificial Sequence
  Description of Artificial Sequence: Synthetic coding sequence
atggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagaaccgtgttcagaccccccctggacatctacgacgtgctgatcagactgagccccagacacatccccagacacagacaggccgtggacagccccgccgccagcttctgcagaggcctgctgagccagcccggccccagcagcctgatgcccgtgctgggctacgaccccccccagctgtacctgacccagctgagagaggccttcggcgacctggccctgttcttctacgaccagcacggcggcgaggtgatcggcgtgctgtggaagcccaccagcttccagccccagcccttcaaggccagcagcaccaagggcagaatggtgatgagcagaggcggcgagctggtgatggtgcccaacgtggaggccatcctggaggacttcgccgtgctgggcgagggcctggtgcagaccgtggaggccagaagcgagagatggaccgtgtag

SEQ ID NO: 91695 - DNA, 3072 bp, Artificial Sequence
  Description of Artificial Sequence: Synthetic coding sequence
atgggccccgcccccgccggcgagcagctgagaggcgccaccggcgagcccgaggtgatggagcccgccctggagggcaccggcaaggagggcaagaaggccagcagcagaaagagaaccctggccgagccccccgccaagggcctgctgcagcccgtgaagctgagcagagccgagctgtacaaggagcccaccaacgaggagctgaacagactgagagagaccgagatcctgttccacagcagcctgctgagactgcaggtggaggagctgctgaaggaggtgagactgagcgagaagaagaaggacagaatcgacgccttcctgagagaggtgaaccagagagtggtgagagtgcccagcgtgcccgagaccgagctgaccgaccaggcctggctgcccgccggcgtgagagtgcccctgcaccaggtgccctacgccgtgaagggctgcttcagattcctgccccccgcccaggtgaccgtggtgggcagctacctgctgggcacctgcatcagacccgacatcaacgtggacgtggccctgaccatgcccagagagatcctgcaggacaaggacggcctgaaccagagatacttcagaaagagagccctgtacctggcccacctggcccaccacctggcccaggaccccctgttcggcagcgtgtgcttcagctacaccaacggctgccacctgaagcccagcctgctgctgagacccagaggcaaggacgagagactggtgaccgtgagactgcacccctgccccccccccgacttcttcagaccctgcagactgctgcccaccaagaacaacgtgagaagcgcctggtacagaggccagagccccgccggcgacggcagccccgagccccccacccccagatacaacacctgggtgctgcaggacaccgtgctggagagccacctgcagctgctgagcaccatcctgagcagcgcccagggcctgaaggacggcgtggccctgctgaaggtgtggctgagacagagagagctggacaagggccagggcggcttcaccggcttcctggtgagcatgctggtggtgttcctggtgagcaccagaaagatccacaccaccatgagcggctaccaggtgctgagaagcgtgctgcagttcctggccaccaccgacctgaccgtgaacggcatcagcctgtgcctgagcagcgaccccagcctgcccgccctggccgacttccaccaggccttcagcgtggtgttcctggacagcagcggccacctgaacctgtgcgccgacgtgaccgccagcacctaccaccaggtgcagcacgaggccagactgagcatgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggagaccagcagcaccggcgaggaggccctggtggccgccgtgagatgctacgacgacctgagcagactgctgtggggcctggagggcctgcccctgaccgtgagcgccgtgcagggcgcccaccccgtgctgagatacaccgaggtgttcccccccacccccgtgagacccgccttcagcttctacgagaccctgagagagagaagcagcctgctgcccagactggacaagccctgccccgcctacgtggagcccatgaccgtggtgtgccacctggagggcagcggccagtggccccaggacgccgaggccgtgcagagagtgagagccgccttccagctgagactggccgagctgctgacccagcagcacggcctgcagtgcagagccaccgccacccacaccgacgtgctgaaggacggcttcgtgttcagaatcagagtggcctaccagagagagccccagatcctgaaggaggtgcagagccccgagggcatgatcagcctgagagacaccgccgccagcctgagactggagagagacaccagacagctgcccctgctgaccagcgccctgcacggcctgcagcagcagcaccccgccttcagcggcgtggccagactggccaagagatgggtgagagcccagctgctgggcgagggcttcgccgacgagagcctggacctggtggccgccgccctgttcctgcaccccgagcccttcaccccccccagcagcccccaggtgggcttcctgagattcctgttcctggtgagcaccttcgactggaagaacaaccccctgttcgtgaacctgaacaacgagctgaccgtggaggagcaggtggagatcagaagcggcttcctggccgccagagcccagctgcccgtgatggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagaatgggccccagcgagaacgtggccctgctgagccacatcaccgacaccgagcagtggaagggcgccatctgcgtgtag

SEQ ID NO: 91696 - DNA, 3285 bp, Artificial Sequence
  Description of Artificial Sequence: Synthetic coding sequence
atgggccccgcccccgccggcgagcagctgagaggcgccaccggcgagcccgaggtgatggagcccgccctggagggcaccggcaaggagggcaagaaggccagcagcagaaagagaaccctggccgagccccccgccaagggcctgctgcagcccgtgaagctgagcagagccgagctgtacaaggagcccaccaacgaggagctgaacagactgagagagaccgagatcctgttccacagcagcctgctgagactgcaggtggaggagctgctgaaggaggtgagactgagcgagaagaagaaggacagaatcgacgccttcctgagagaggtgaaccagagagtggtgagagtgcccagcgtgcccgagaccgaggagatcctgcaggacaaggacggcctgaaccagagatacttcagaaagagagccctgtacctggcccacctggcccaccacctggcccaggaccccctgttcggcagcgtgtgcttcagctacaccaacggctgccacctgaagcccagcctgctgctgagacccagaggcaaggacgagagactggtgaccgtgagactgcacccctgccccccccccgacttcttcagaccctgcagactgctgcccaccaagaacaacgtgagaagcgcctggtacagaggccagagccccgccggcgacggcagccccgagccccccacccccagatacaacacctgggtgctgcaggacaccgtgctggagagccacctgcagctgctgagcaccatcctgagcagcgcccagggcctgaaggacggcgtggccctgctgaaggtgtggctgagacagagagagctggacaagggccagggcggcttcaccggcttcctggtgagcatgctggtggtgttcctggtgagcaccagaaagatccacaccaccatgagcggctaccaggtgctgagaagcgtgctgcagttcctggccaccaccgacctgaccgtgaacggcatcagcctgtgcctgagcagcgaccccagcctgcccgccctggccgacttccaccaggccttcagcgtggtgttcctggacagcagcggccacctgaacctgtgcgccgacgtgaccgccagcacctaccaccagggctggagcctgctgtggctgcaggtgcagcacgaggccagactgagcatgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggagaccagcagcaccggcgaggaggccctggtggccgccgtgagatgctacgacgacctgagcagactgctgtggggcctggagggcctgcccctgaccgtgagcgccgtgcagggcgcccaccccgtgctgagatacaccgaggtgttcccccccacccccgtgagacccgccttcagcttctacgagaccctgagagagagaagcagcctgctgcccagactggacaagccctgccccgcctacgtggagcccatgaccgtggtgtgccacctggagggcagcggccagtggccccaggacgccgaggccgtgcagagagtgagagccgccttccagctgagactggccgagctgctgacccagcagcacggcctgcagtgcagagccaccgccacccacaccgacgtgctgaaggacggcttcgtgttcagaatcagagtggcctaccagagagagccccagatcctgaaggaggtgcagagccccgagggcatgatcagcctgagagacaccgccgccagcctgagactggagagagacaccagacagctgcccctgctgaccagcgccctgcacggcctgcagcagcagcaccccgccttcagcggcgtggccagactggccaagagatgggtgagagcccagctgctgggcgagggcttcgccgacgagagcctggacctggtggccgccgccctgttcctgcaccccgagcccttcaccccccccagcagcccccaggtgggcttcctgagattcctgttcctggtgagcaccttcgactggaagaacaaccccctgttcgtgaacctgaacaacgagctgaccgtggaggagcaggtggagatcagaagcggcttcctggccgccagagcccagctgcccgtgatggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagaaccgtgttcagaccccccctggacatctacgacgtgctgatcagactgagccccagacacatccccagacacagacaggccgtggacagccccgccgccagcttctgcagaggcctgctgagccagcccggccccagcagcctgatgcccgtgctgggctacgaccccccccagctgtacctgacccagctgagagaggccttcggcgacctggccctgttcttctacgaccagcacggcggcgaggtgatcggcgtgctgtggaagcccaccagcttccagccccagcccttcaaggccagcagcaccaagggcagaatggtgatgagcagaggcggcgagctggtgatggtgcccaacgtggaggccatcctggaggacttcgccgtgctgggcgagggcctggtgcagaccgtggaggccagaagcgagagatggaccgtgtag

SEQ ID NO: 91697 - DNA, 2109 bp, Artificial Sequence
  Description of Artificial Sequence: Synthetic coding sequence
atgatgctgctggacagcagagccgacgacggcttccacctgctgctgatgacccccaagcccatgatcagagccttcgaccacgtgctgcacctgagacccctgagcagactgcaggccgcctgccacagactgaagctgtggcccgagctgcaggacaacggcggcgactacgtgagcgccgccctgggccccctgaccaccctgctggagcagggcctgggcgccagactgaacctgctggcccacagcagaccccccgtgcccgagtgggacatcagccaggacccccccaagcacaaggacagcggcaccctgaccctgggcctgctgctgagacccgagggcctgaccagcgtgctggagctgggccccgaggccgaccagcccgaggccgccaagttcagacagttctggggcagcagaagcgagctgagaagattccaggacggcgccatcagagaggccgtggtgtgggaggccgccagcatgagccagaagagactgatcccccaccaggtggtgacccacctgctggccctgcacgccgacatccccgagacctgcgtgcactacgtgggcggccccctggacgccctgatccagggcctgaaggagaccagcagcaccggcgaggaggccctggtggccgccgtgagatgctacgacgacctgagcagactgctgtggggcctggagggcctgcccctgaccgtgagcgccgtgcagggcgcccaccccgtgctgagatacaccgaggtgttcccccccacccccgtgagacccgccttcagcttctacgagaccctgagagagagaagcagcctgctgcccagactggacaagccctgccccgcctacgtggagcccatgaccgtggtgtgccacctggagggcagcggccagtggccccaggacgccgaggccgtgcagagagtgagagccgccttccagctgagactggccgagctgctgacccagcagcacggcctgcagtgcagagccaccgccacccacaccgacgtgctgaaggacggcttcgtgttcagaatcagagtggcctaccagagagagccccagatcctgaaggaggtgcagagccccgagggcatgatcagcctgagagacaccgccgccagcctgagactggagagagacaccagacagctgcccctgctgaccagcgccctgcacggcctgcagcagcagcaccccgccttcagcggcgtggccagactggccaagagatgggtgagagcccagctgctgggcgagggcttcgccgacgagagcctggacctggtggccgccgccctgttcctgcaccccgagcccttcaccccccccagcagcccccaggtgggcttcctgagattcctgttcctggtgagcaccttcgactggaagaacaaccccctgttcgtgaacctgaacaacgagctgaccgtggaggagcaggtggagatcagaagcggcttcctggccgccagagcccagctgcccgtgatggtgatcgtgaccccccaggacagaaagaacagcgtgtggacccaggacggccccagcgcccagatcctgcagcagctggtggtgctggccgccgaggccctgcccatgctggagaagcagctgatggaccccagaggccccggcgacatcagaaccgtgttcagaccccccctggacatctacgacgtgctgatcagactgagccccagacacatccccagacacagacaggccgtggacagccccgccgccagcttctgcagaggcctgctgagccagcccggccccagcagcctgatgcccgtgctgggctacgaccccccccagctgtacctgacccagctgagagaggccttcggcgacctggccctgttcttctacgaccagcacggcggcgaggtgatcggcgtgctgtggaagcccaccagcttccagccccagcccttcaaggccagcagcaccaagggcagaatggtgatgagcagaggcggcgagctggtgatggtgcccaacgtggaggccatcctggaggacttcgccgtgctgggcgagggcctggtgcagaccgtggaggccagaagcgagagatggaccgtgtag

SEQ ID NO: 91698 - DNA, 645 bp, Artificial Sequence
  Description of Artificial Sequence: Synthetic coding sequence
atgaacctgagcagcgccagcagcaccgaggagaaggccgtgaccaccgtgctgtggggctgcgagctgagccaggagagaagaacctggaccttcagaccccagctggagggcaagcagagctgcagactgctgctgcacaccatctgcctgggcgagaaggccaaggaggagatgcacagagtggagatcctgccccccgccaaccaggaggacaagaagatgcagcccgtgaccatcgccagcctgcaggccagcgtgctgcccatggtgagcatggtgggcgtgcagctgagcccccccgtgaccttccagctgagagccggcagcggccccgtgttcctgagcggccaggagagatacgaggccagcgacctgacctgggaggaggaggaggaggaggagggcgaggaggaggaggaggaggaggaggacgacgaggacgaggacgccgacatcagcctggaggagcagagccccgtgaagcaggtgaagagactggtgccccagaagcaggccagcgtggccaagaagaagaagctggagaaggaggaggaggagatcagagccagcgtgagagacaagagccccgtgaagaaggccaaggccaccgccagagccaagaagcccggcttcaagaagtag

SEQ ID NO: 91699 - DNA, 411 bp, Artificial Sequence
  Description of Artificial Sequence: Synthetic coding sequence
atgaacctgagcagcgccagcagcaccgaggagaaggccgtgaccaccgtgctgtggggctgcgagctgagccaggagagaagaacctggaccttcagaccccagctggagggcaagcagagctgcagactgctgctgcacaccatctgcctgggcgagaaggccaaggaggagatgcacagagtggagatcctgccccccgccaaccaggaggacaagaagatgcagcccgtgaccatcgccagcctgcaggccagcgtgctgcccatggtgagcatggtgggcgtgcagctgagcccccccgtgaccttccagctgagagccggcagcggccccgtgttcctgagcggccaggagagatacgagaagaaggccggcaagagaagaagaggcaacaagagccagagatag

SEQ ID NO: 91700 - DNA, 645 bp, Artificial Sequence; identical to SEQ ID NO: 91698
  Description of Artificial Sequence: Synthetic coding sequence

SEQ ID NO: 91701 - DNA, 645 bp, Artificial Sequence; identical to SEQ ID NO: 91698
  Description of Artificial Sequence: Synthetic coding sequence

SEQ ID NO: 91702 - DNA, 645 bp, Artificial Sequence; identical to SEQ ID NO: 91698
  Description of Artificial Sequence: Synthetic coding sequence

SEQ ID NO: 91703 - DNA, 537 bp, Artificial Sequence
  Description of Artificial Sequence: Synthetic coding sequence
atggccgccggcaccgccgccgccctggccttcctgagccaggagagcagaaccagagccggcggcgtgggcggcctgagagtgcccgcccccgtgaccatggacagcttcttcttcggctgcgagctgagcggccacaccagaagcttcaccttcaaggtggaggaggaggacgacgccgagcacgtgctggccctgaccatgctgtgcctgaccgagggcgccaaggacgagtgcaacgtggtggaggtggtggccagaaaccacgaccaccaggagatcgccgtgcccgtggccaacctgaagctgagctgccagcccatgctgagcctggacgacttccagctgcagccccccgtgaccttcagactgaagagcggcagcggccccgtgagaatcaccggcagacaccagatcgtgaccatgagcaacgacgtgagcgaggaggagagcgaggaggaggaggaggacagcgacgaggaggaggtggagctgtgccccatcctgcccgccaagaagcagggcggcagaccctag

SEQ ID NO: 91704 - DNA, 501 bp, Artificial Sequence
  Description of Artificial Sequence: Synthetic coding sequence
atgaagtacaccagctacatcctggccttccagctgtgcatcgtgctgggcagcctgggctgctactgccaggacccctacgtgaaggaggccgagaacctgaagaagtacttcaacgccggccacagcgacgtggccgacaacggcaccctgttcctgggcatcctgaagaactggaaggaggagagcgacagaaagatcatgcagagccagatcgtgagcttctacttcaagctgttcaagaacttcaaggacgaccagagcatccagaagagcgtggagaccatcaaggaggacatgaacgtgaagttcttcaacagcaacaagaagaagagagacgacttcgagaagctgaccaactacagcgtgaccgacctgaacgtgcagagaaaggccatccacgagctgatccaggtgatggccgagctgagccccgccgccaagaccggcaagagaaagagaagccagatgctgttcagaggcagaagagccagccagtag

SEQ ID NO: 91705 - DNA, 2061 bp, Artificial Sequence
  Description of Artificial Sequence: Synthetic coding sequence
atgagcatgttcagcgacttcctgcagagcttcctgaagcacagcagcagcaccgtgttcgacctggtggaggagtacgagaacatctgcggcagccaggtgaacatcctgagcaagatcgtgagcagagccacccccggcctgcagaagttcagcaagaccgccagcatgctgtggctgctgcagcaggagatggtgacctggagactgctggccagcctgtacagagacagaatccagagcgccctggaggaggagagcgtgttcgccgtgaccgccgtgaacgccagcgagaagaccgtggtggaggccctgttccagagagacagcctggtgagacagagccagctggtggtggactggctggagagcatcgccaaggacgagatcggcgagttcagcgacaacatcgagttctacgccaagagcgtgtactgggagaacaccctgcacaccctgaagcagagacagctgaccagctacgtgggcagcgtgagacccctggtgaccgagctggaccccgacgcccccatcagacagaagatgcccctggacgacctggacagagaggacgaggtgagactgctgaagtacctgttcaccctgatcagagccggcatgaccgaggaggcccagagactgtgcaagagatgcggccaggcctggagagccgccaccctggagggctggaagctgtaccacgaccccaacgtgaacggcggcaccgagctggagcccgtggagggcaacccctacagaagaatctggaagatcagctgctggagaatggccgaggacgagctgttcaacagatacgagagagccatctacgccgccctgagcggcaacctgaagcagctgctgcccgtgtgcgacacctgggaggacaccgtgtgggcctacttcagagtgatggtggacagcctggtggagcaggagatccagaccagcgtggccaccctggacgagaccgaggagctgcccagagagtacctgggcgccaactggaccctggagaaggtgttcgaggagctgcaggccaccgacaagaagagagtgctggaggagaaccaggagcactaccacatcgtgcagaagttcctgatcctgggcgacatcgacggcctgatggacgagttcagcaagtggctgagcaagagcagaaacaacctgcccggccacctgctgagattcatgacccacctgatcctgttcttcagaaccctgggcctgcagaccaaggaggaggtgagcatcgaggtgctgaagacctacatccaggaggacagactgaagatcgacgtgatcgactggctggtgttcgaccccgcccagagagccgaggccctgaagcagggcaacgccatcatgagaaagttcctggccagcaagaagcacgaggccgccaaggaggtgttcgtgaagatcccccaggacagcatcgccgagatctacaaccagtgcgaggagcagggcatggagagccccctgcccgccgaggacgacaacgccatcagagagcacctgtgcatcagagcctacctggaggcccacgagaccttcaacgagtggttcaagcacatgaacagcgtgccccagaagcccgccctgatcccccagcccaccttcaccgagaaggtggcccacgagcacaaggagaagaagtacgagatggacttcggcatctggaagggccacctggacgccctgaccgccgacgtgaaggagaagatgtacaacgtgctgctgttcgtggacggcggctggatggtggacgtgagagaggacgccaaggaggaccacgagagaacccaccagatggtgctgctgagaaagctgtgcctgcccatgctgtgcttcctgctgcacaccatcctgcacagcaccggccagtaccaggagtgcctgcagctggccgacatggtgagcagcgagagacacaagctgtacctggtgttcagcaaggaggagctgagaaagctgctgcagaagctgagagagagcagcctgatgctgctggaccagggcctggaccccctgggctacgagatccagctgtag

SEQ ID NO: 91706 - DNA, 2691 bp, Artificial Sequence
  Description of Artificial Sequence: Synthetic coding sequence
atgaagatcctggtgatcctgcaccaggagaccagactgagcctggagctgctggcccacttcgacagcctggtgctgagcaccaacctgctgttcatcgtgacccccaccagcagaagcctgctgagacagcccgacatcagctgcatcctgggcaccggcggcaagagccccagactgacccagagcagcggcttcttcggcaacctgagcatggtgaccaacctggacgacagcaactgggccgccgccttcagcagccagagaagcggcctgttcaccaacaccgagccccacagcatcaccgaggacgtgaccatcagcgccgtgatgctgagagaggacgaccccggcgaggccgccagcatgagcatgttcagcgacttcctgcagagcttcctgaagcacagcagcagcaccgtgttcgacctggtggaggagtacgagaacatctgcggcagccaggtgaacatcctgagcaagatcgtgagcagagccacccccggcctgcagaagttcagcaagaccgccagcatgctgtggctgctgcagcaggagatggtgacctggagactgctggccagcctgtacagagacagaatccagagcgccctggaggaggagagcgtgttcgccgtgaccgccgtgaacgccagcgagaagaccgtggtggaggccctgttccagagagacagcctggtgagacagagccagctggtggtggactggctggagagcatcgccaaggacgagatcggcgagttcagcgacaacatcgagttctacgccaagagcgtgtactgggagaacaccctgcacaccctgaagcagagacagctgaccagctacgtgggcagcgtgagacccctggtgaccgagctggaccccgacgcccccatcagacagaagatgcccctggacgacctggacagagaggacgaggtgagactgctgaagtacctgttcaccctgatcagagccggcatgaccgaggaggcccagagactgtgcaagagatgcggccaggcctggagagccgccaccctggagggctggaagctgtaccacgaccccaacgtgaacggcggcaccgagctggagcccgtggagggcaacccctacagaagaatctggaagatcagctgctggagaatggccgaggacgagctgttcaacagatacgagagagccatctacgccgccctgagcggcaacctgaagcagctgctgcccgtgtgcgacacctgggaggacaccgtgtgggcctacttcagagtgatggtggacagcctggtggagcaggagatccagaccagcgtggccaccctggacgagaccgaggagctgcccagagagtacctgggcgccaactggaccctggagaaggtgttcgaggagctgcaggccaccgacaagaagagagtgctggaggagaaccaggagcactaccacatcgtgcagaagttcctgatcctgggcgacatcgacggcctgatggacgagttcagcaagtggctgagcaagagcagaaacaacctgcccggccacctgctgagattcatgacccacctgatcctgttcttcagaaccctgggcctgcagaccaaggaggaggtgagcatcgaggtgctgaagacctacatccagctgctgatcagagagaagcacaccaacctgatcgccttctacacctgccacctgccccaggacctggccgtggcccagtacgccctgttcctggagagcgtgaccgagttcgagcagagacaccactgcctggagctggccaaggaggccgacctggacgtggccaccatcaccaagaccgtggtggagaacatcagaaagaaggacaacggcgagttcagccaccacgacctggcccccgccctggacaccggcaccaccgaggaggacagactgaagatcgacgtgatcgactggctggtgttcgaccccgcccagagagccgaggccctgaagcagggcaacgccatcatgagaaagttcctggccagcaagaagcacgaggccgccaaggaggtgttcgtgaagatcccccaggacagcatcgccgagatctacaaccagtgcgaggagcagggcatggagagccccctgcccgccgaggacgacaacgccatcagagagcacctgtgcatcagagcctacctggaggcccacgagaccttcaacgagtggttcaagcacatgaacagcgtgccccagaagcccgccctgatcccccagcccaccttcaccgagaaggtggcccacgagcacaaggagaagaagtacgagatggacttcggcatctggaagggccacctggacgccctgaccgccgacgtgaaggagaagatgtacaacgtgctgctgttcgtggacggcggctggatggtggacgtgagagaggacgccaaggaggaccacgagagaacccaccagatggtgctgctgagaaagctgtgcctgcccatgctgtgcttcctgctgcacaccatcctgcacagcaccggccagtaccaggagtgcctgcagctggccgacatggtgagcagcgagagacacaagctgtacctggtgttcagcaaggaggagctgagaaagctgctgcagaagctgagagagagcagcctgatgctgctggaccagggcctggaccccctgggctacgagatccagctgtag

SEQ ID NO: 91707 - DNA, 3471 bp, Artificial Sequence
  Description of Artificial Sequence: Synthetic coding sequence
atgttccccgccgcccccagccccagaacccccggcaccggcagcagaagaggccccctggccggcctgggccccggcagcacccccagaaccgccagcagaaagggcctgcccctgggcagcgccgtgagcagccccgtgctgttcagccccgtgggcagaagaagcagcctgagcagcagaggcacccccaccagaatgttcccccaccacagcatcaccgagagcgtgaactacgacgtgaagaccttcggcagcagcctgcccgtgaaggtgatggaggccctgaccctggccgaggtggacgaccagctgaccatcaacatcgacgagggcggctgggcctgcctggtgtgcaaggagaagctgatcatctggaagatcgccctgagccccatcaccaagctgagcgtgtgcaaggagctgcagctgccccccagcgacttccactggagcgccgacctggtggccctgagctacagcagccccagcggcgaggcccacagcacccaggccgtggccgtgatggtggccaccagagagggcagcatcagatactggcccagcctggccggcgaggacacctacaccgaggccttcgtggacagcggcggcgacaagacctacagcttcctgaccgccgtgcagggcggcagcttcatcctgagcagcagcggcagccagctgatcagactgatccccgagagcagcggcaagatccaccagcacatcctgccccagggccagggcatgctgagcggcatcggcagaaaggtgagcagcctgttcggcatcctgagccccagcagcgacctgaccctgagcagcgtgctgtgggacagagagagaagcagcttctacagcctgaccagcagcaacatcagcaagtgggagctggacgacagcagcgagaagcacgcctacagctgggacatcaacagagccctgaaggagaacatcaccgacgccatctggggcagcgagagcaactacgaggccatcaaggagggcgtgaacatcagatacctggacctgaagcagaactgcgacggcctggtgatcctggccgccgcctggcacagcgccgacaacccctgcctgatctactacagcctgatcaccatcgaggacaacggctgccagatgagcgacgccgtgaccgtggaggtgacccagtacaacccccccttccagagcgaggacctgatcctgtgccagctgaccgtgcccaacttcagcaaccagaccgcctacctgtacaacgagagcgccgtgtacgtgtgcagcaccggcaccggcaagttcagcctgccccaggagaagatcgtgttcaacgcccagggcgacagcgtgctgggcgccggcgcctgcggcggcgtgcccatcatcttcagcagaaacagcggcctggtgagcatcaccagcagagagaacgtgagcatcctggccgaggacctggagggcagcctggccagcagcgtggccggccccaacagcgagagcatgatcttcgagaccaccaccaagaacgagaccatcgcccaggaggacaagatcaagctgctgaaggccgccttcctgcagtactgcagaaaggacctgggccacgcccagatggtggtggacgagctgttcagcagccacagcgacctggacagcgacagcgagctggacagagccgtgacccagatcagcgtggacctgatggacgactaccccgccagcgaccccagatgggccgagagcgtgcccgaggaggcccccggcttcagcaacaccagcctgatcatcctgcaccagctggaggacaagatgaaggcccacagcttcctgatggacttcatccaccaggtgggcctgttcggcagactgggcagcttccccgtgagaggcacccccatggccaccagactgctgctgtgcgagcacgccgagaagctgagcgccgccatcgtgctgaagaaccaccacagcagactgagcgacctggtgaacaccgccatcctgatcgccctgaacaagagagagtacgagatccccagcaacctgacccccgccgacgtgttcttcagagaggtgagccaggtggacaccatctgcgagtgcctgctggagcacgaggagcaggtgctgagagacgcccccatggacagcatcgagtgggccgaggtggtgatcaacgtgaacaacatcctgaaggacatgctgcaggccgccagccactacagacagaacagaaacagcctgtacagaagagaggagagcctggagaaggagcccgagtacgtgccctggaccgccaccagcggccccggcggcatcagaaccgtgatcatcagacagcacgagatcgtgctgaaggtggcctacccccaggccgacagcaacctgagaaacatcgtgaccgagcagctggtggccctgatcgactgcttcctggacggctacgtgagccagctgaagagcgtggacaagagcagcaacagagagagatacgacaacctggagatggagtacctgcagaagagaagcgacctgctgagccccctgctgagcctgggccagtacctgtgggccgccagcctggccgagaagtactgcgacttcgacatcctggtgcagatgtgcgagcagaccgacaaccagagcagactgcagagatacatgacccagttcgccgaccagaacttcagcgacttcctgttcagatggtacctggagaagggcaagagaggcaagctgctgagccagcccatcagccagcacggccagctggccaacttcctgcaggcccacgagcacctgagctggctgcacgagatcaacagccaggagctggagaaggcccacgccaccctgctgggcctggccaacatggagaccagatacttcgccaagaagaagaccctgctgggcctgagcaagctggccgccctggccagcgacttcagcgaggacatgctgcaggagaagatcgaggagatggccgagcaggagagattcctgctgcaccaggagaccctgcccgagcagctgctggccgagaagcagctgaacctgagcgccatgcccgtgctgaccgccccccagctgatcggcctgtacatctgcgaggagaacagaagagccaacgagtacgacttcaagaaggccctggacctgctggagtacatcgacgaggaggaggacatcaacatcaacgacctgaagctggagatcctgtgcaaggccctgcagagagacaactggagcagcagcgacggcaaggacgaccccatcgaggtgagcaaggacagcatcttcgtgaagatcctgcagaagctgctgaaggacggcatccagctgagcgagtacctgcccgaggtgaaggacctgctgcaggccgaccagctgggcagcctgaagagcaacccctacttcgagttcgtgctgaaggccaactacgagtactacgtgcagggccagatctag

SEQ ID NO: 91708 - DNA, 675 bp, Artificial Sequence
  Description of Artificial Sequence: Synthetic coding sequence
atgttccccgccgcccccagccccagaacccccggcaccggcagcagaagaggccccctggccggcctgggccccggcagcacccccagaaccgccagcagaaagggcctgcccctgggcagcgccgtgagcagccccgtgctgttcagccccgtgggcagaagaagcagcctgagcagcagaggcacccccaccagaatgttcccccaccacagcatcaccgagagcgtgaactacgacgtgaagaccttcggcagcagcctgcccgtgaaggtgatggaggccctgaccctggccgaggtggacgaccagctgaccatcaacatcgacgagggcggctgggcctgcctggtgtgcaaggagaagctgatcatctggaagatcgccctgagccccatcaccaagctgagcgtgtgcaaggagctgcagctgccccccagcgacttccactggagcgccgacctggtggccctgagctacagcagccccagcggcgaggcccacagcacccaggccgtggccgtgatggtggccaccagagagggcagcatcagatactggcccagcctggccggcgaggacacctacaccgaggccttcgtggacagcggcggcgacaagacctacagcttcctgaccgccgtgcaggtgcacaaggagaccaagagcggctag

SEQ ID NO: 91709 - DNA, 3207 bp, Artificial Sequence
  Description of Artificial Sequence: Synthetic coding sequence
atgttccccgccgcccccagccccagaacccccggcaccggcagcagaagaggccccctggccggcctgggccccggcagcacccccagaaccgccagcagaaagggcctgcccctgggcagcgccgtgagcagccccgtgctgttcagccccgtgggcagaagaagcagcctgagcagcagaggcacccccaccagaatgttcccccaccacagcatcaccgagagcgtgaactacgacgtgaagaccttcggcagcagcctgcccgtgaaggtgatggaggccctgaccctggccgaggtggacgaccagctgaccatcaacatcgacgagggcggctgggcctgcctggtgtgcaaggagaagctgatcatctggaagatcgccctgagccccatcaccaagctgagcgtgtgcaaggagctgcagctgccccccagcgacttccactggagcgccgacctggtggccctgagctacagcagccccagcggcgaggcccacagcacccaggccgtggccgtgatggtggccaccagagagggcagcatcagatactggcccagcctggccggcgaggacacctacaccgaggccttcgtggacagcggcggcgacaagacctacagcttcctgaccgccgtgcagggcggcagcttcatcctgagcagcagcggcagccagctgatcagactgatccccgagagcagcggcaagatccaccagcacatcctgccccagggccagggcatgctgagcggcatcggcagaaaggtgagcagcctgttcggcatcctgagccccagcagcgacctgaccctgagcagcgtgctgtgggacagagagagaagcagcttctacagcctgaccagcagcaacatcagcaagtgggagctggacgacagcagcgagaagcacgcctacagctgggacatcaacagagccctgaaggagaacatcaccgacgccatctggggcagcgagagcaactacgaggccatcaaggagggcgtgaacatcagatacctggacctgaagcagaactgcgacggcctggtgatcctggccgccgcctggcacagcgccgacaacccctgcctgatctactacagcctgatcaccatcgaggacaacggctgccagatgagcgacgccgtgaccgtggaggtgacccagtacaacccccccttccagagcgaggacctgatcctgtgccagctgaccgtgcccaacttcagcaaccagaccgcctacctgtacaacgagagcgccgtgtacgtgtgcagcaccggcaccggcaagttcagcctgccccaggagaagatcgtgttcaacgcccagggcgacagcgtgctgggcgccggcgcctgcggcggcgtgcccatcatcttcagcagaaacagcggcctggtgagcatcaccagcagagagaacgtgagcatcctggccgaggacctggagggcagcctggccagcagcgtggccggccccaacagcgagagcatgatcttcgagaccaccaccaagaacgagaccatcgcccaggaggacaagatcaagctgctgaaggccgccttcctgcagtactgcagaaaggacctgggccacgcccagatggtggtggacgagctgttcagcagccacagcgacctggacagcgacagcgagctggacagagccgtgacccagatcagcgtggacctgatggacgactaccccgccagcgaccccagatgggccgagagcgtgcccgaggaggcccccggcttcagcaacaccagcctgatcatcctgcaccagctggaggacaagatgaaggcccacagcttcctgatggacttcatccaccaggtgggcctgttcggcagactgggcagcttccccgtgagaggcacccccatggccaccagactgctgctgtgcgagcacgccgagaagctgagcgccgccatcgtgctgaagaaccaccacagcagactgagcgacctggtgaacaccgccatcctgatcgccctgaacaagagagagtacgagatccccagcaacctgacccccgccgacgtgttcttcagagaggtgagccaggtggacaccatctgcgagtgcctgctggagcacgaggagcaggtgctgagagacgcccccatggacagcatcgagtgggccgaggtggtgatcaacgtgaacaacatcctgaaggacatgctgcaggccgccagccactacagacagaacagaaacagcctgtacagaagagaggagagcctggagaaggagcccgagtacgtgccctggaccgccaccagcggccccggcggcatcagaaccgtgatcatcagacagcacgagatcgtgctgaaggtggcctacccccaggccgacagcaacctgagaaacatcgtgaccgagcagctggtggccctgatcgactgcttcctggacggctacgtgagccagctgaagagcgtggacaagagcagcaacagagagagatacgacaacctggagaagggcaagagaggcaagctgctgagccagcccatcagccagcacggccagctggccaacttcctgcaggcccacgagcacctgagctggctgcacgagatcaacagccaggagctggagaaggcccacgccaccctgctgggcctggccaacatggagaccagatacttcgccaagaagaagaccctgctgggcctgagcaagctggccgccctggccagcgacttcagcgaggacatgctgcaggagaagatcgaggagatggccgagcaggagagattcctgctgcaccaggagaccctgcccgagcagctgctggccgagaagcagctgaacctgagcgccatgcccgtgctgaccgccccccagctgatcggcctgtacatctgcgaggagaacagaagagccaacgagtacgacttcaagaaggccctggacctgctggagtacatcgacgaggaggaggacatcaacatcaacgacctgaagctggagatcctgtgcaaggccctgcagagagacaactggagcagcagcgacggcaaggacgaccccatcgaggtgagcaaggacagcatcttcgtgaagatcctgcagaagctgctgaaggacggcatccagctgagcgagtacctgcccgaggtgaaggacctgctgcaggccgaccagctgggcagcatcaacgtgaacttctgctag

SEQ ID NO: 91710 - DNA, 3258 bp, Artificial Sequence
  Description of Artificial Sequence: Synthetic coding sequence
atgttccccgccgcccccagccccagaacccccggcaccggcagcagaagaggccccctggccggcctgggccccggcagcacccccagaaccgccagcagaaagggcctgcccctgggcagcgccgtgagcagccccgtgctgttcagccccgtgggcagaagaagcagcctgagcagcagaggcacccccaccagaatgttcccccaccacagcatcaccgagagcgtgaactacgacgtgaagaccttcggcagcagcctgcccgtgaaggtgatggaggccctgaccctggccgaggtggacgaccagctgaccatcaacatcgacgagggcggctgggcctgcctggtgtgcaaggagaagctgatcatctggaagatcgccctgagccccatcaccaagctgagcgtgtgcaaggagctgcagctgccccccagcgacttccactggagcgccgacctggtggccctgagctacagcagccccagcggcgaggcccacagcacccaggccgtggccgtgatggtggccaccagagagggcagcatcagatactggcccagcctggccggcgaggacacctacaccgaggccttcgtggacagcggcggcgacaagacctacagcttcctgaccgccgtgcagggcggcagcttcatcctgagcagcagcggcagccagctgatcagactgatccccgagagcagcggcaagatccaccagcacatcctgccccagggccagggcatgctgagcggcatcggcagaaaggtgagcagcctgttcggcatcctgagccccagcagcgacctgaccctgagcagcgtgctgtgggacagagagagaagcagcttctacagcctgaccagcagcaacatcagcaagtgggagctggacgacagcagcgagaagcacgcctacagctgggacatcaacagagccctgaaggagaacatcaccgacgccatctggggcagcgagagcaactacgaggccatcaaggagggcgtgaacatcagatacctggacctgaagcagaactgcgacggcctggtgatcctggccgccgcctggcacagcgccgacaacccctgcctgatctactacagcctgatcaccatcgaggacaacggctgccagatgagcgacgccgtgaccgtggaggtgacccagtacaacccccccttccagagcgaggacctgatcctgtgccagctgaccgtgcccaacttcagcaaccagaccgcctacctgtacaacgagagcgccgtgtacgtgtgcagcaccggcaccggcaagttcagcctgccccaggagaagatcgtgttcaacgcccagggcgacagcgtgctgggcgccggcgcctgcggcggcgtgcccatcatcttcagcagaaacagcggcctggtgagcatcaccagcagagagaacgtgagcatcctggccgaggacctggagggcagcctggccagcagcgtggccggccccaacagcgagagcatgatcttcgagaccaccaccaagaacgagaccatcgcccaggaggacaagatcaagctgctgaaggccgccttcctgcagtactgcagaaaggacctgggccacgcccagatggtggtggacgagctgttcagcagccacagcgacctggacagcgacagcgagctggacagagccgtgacccagatcagcgtggacctgatggacgactaccccgccagcgaccccagatgggccgagagcgtgcccgaggaggcccccggcttcagcaacaccagcctgatcatcctgcaccagctggaggacaagatgaaggcccacagcttcctgatggacttcatccaccaggtgggcctgttcggcagactgggcagcttccccgtgagaggcacccccatggccaccagactgctgctgtgcgagcacgccgagaagctgagcgccgccatcgtgctgaagaaccaccacagcagactgagcgacctggtgaacaccgccatcctgatcgccctgaacaagagagagtacgagatccccagcaacctgacccccgccgacgtgttcttcagagaggtgagccaggtggacaccatctgcgagtgcctgctggagcacgaggagcaggtgctgagagacgcccccatggacagcatcgagtgggccgaggtggtgatcaacgtgaacaacatcctgaaggacatgctgcaggccgccagccactacagacagaacagaaacagcctgtacagaagagaggagagcctggagaaggagcccgagtacgtgccctggaccgccaccagcggccccggcggcatcagaaccgtgatcatcagacagcacgagatcgtgctgaaggtggcctacccccaggccgacagcaacctgagaaacatcgtgaccgagcagctggtggccctgatcgactgcttcctggacggctacgtgagccagctgaagagcgtggacaagagcagcaacagagagagatacgacaacctggagaagggcaagagaggcaagctgctgagccagcccatcagccagcacggccagctggccaacttcctgcaggcccacgagcacctgagctggctgcacgagatcaacagccaggagctggagaaggcccacgccaccctgctgggcctggccaacatggagaccagatacttcgccaagaagaagaccctgctgggcctgagcaagctggccgccctggccagcgacttcagcgaggacatgctgcaggagaagatcgaggagatggccgagcaggagagattcctgctgcaccaggagaccctgcccgagcagctgctggccgagaagcagctgaacctgagcgccatgcccgtgctgaccgccccccagctgatcggcctgtacatctgcgaggagaacagaagagccaacgagtacgacttcaagaaggccctggacctgctggagtacatcgacgaggaggaggacatcaacatcaacgacctgaagctggagatcctgtgcaaggccctgcagagagacaactggagcagcagcgacggcaaggacgaccccatcgaggtgagcaaggacagcatcttcgtgaagatcctgcagaagctgctgaaggacggcatccagctgagcgagtacctgcccgaggtgaaggacctgctgcaggccgaccagctgggcagcctgaagagcaacccctacttcgagttcgtgctgaaggccaactacgagtactacgtgcagggccagatctag

SEQ ID NO: 91711 - DNA, 3423 bp, Artificial Sequence
  Description of Artificial Sequence: Synthetic coding sequence
atgggccccctggccggcctgggccccggcagcacccccagaaccgccagcagaaagggcctgcccctgggcagcgccgtgagcagccccgtgctgttcagccccgtgggcagaagaagcagcctgagcagcagaggcacccccaccagaatgttcccccaccacagcatcaccgagagcgtgaactacgacgtgaagaccttcggcagcagcctgcccgtgaaggtgatggaggccctgaccctggccgaggtggacgaccagctgaccatcaacatcgacgagggcggctgggcctgcctggtgtgcaaggagaagctgatcatctggaagatcgccctgagccccatcaccaagctgagcgtgtgcaaggagctgcagctgccccccagcgacttccactggagcgccgacctggtggccctgagctacagcagccccagcggcgaggcccacagcacccaggccgtggccgtgatggtggccaccagagagggcagcatcagatactggcccagcctggccggcgaggacacctacaccgaggccttcgtggacagcggcggcgacaagacctacagcttcctgaccgccgtgcagggcggcagcttcatcctgagcagcagcggcagccagctgatcagactgatccccgagagcagcggcaagatccaccagcacatcctgccccagggccagggcatgctgagcggcatcggcagaaaggtgagcagcctgttcggcatcctgagccccagcagcgacctgaccctgagcagcgtgctgtgggacagagagagaagcagcttctacagcctgaccagcagcaacatcagcaagtgggagctggacgacagcagcgagaagcacgcctacagctgggacatcaacagagccctgaaggagaacatcaccgacgccatctggggcagcgagagcaactacgaggccatcaaggagggcgtgaacatcagatacctggacctgaagcagaactgcgacggcctggtgatcctggccgccgcctggcacagcgccgacaacccctgcctgatctactacagcctgatcaccatcgaggacaacggctgccagatgagcgacgccgtgaccgtggaggtgacccagtacaacccccccttccagagcgaggacctgatcctgtgccagctgaccgtgcccaacttcagcaaccagaccgcctacctgtacaacgagagcgccgtgtacgtgtgcagcaccggcaccggcaagttcagcctgccccaggagaagatcgtgttcaacgcccagggcgacagcgtgctgggcgccggcgcctgcggcggcgtgcccatcatcttcagcagaaacagcggcctggtgagcatcaccagcagagagaacgtgagcatcctggccgaggacctggagggcagcctggccagcagcgtggccggccccaacagcgagagcatgatcttcgagaccaccaccaagaacgagaccatcgcccaggaggacaagatcaagctgctgaaggccgccttcctgcagtactgcagaaaggacctgggccacgcccagatggtggtggacgagctgttcagcagccacagcgacctggacagcgacagcgagctggacagagccgtgacccagatcagcgtggacctgatggacgactaccccgccagcgaccccagatgggccgagagcgtgcccgaggaggcccccggcttcagcaacaccagcctgatcatcctgcaccagctggaggacaagatgaaggcccacagcttcctgatggacttcatccaccaggtgggcctgttcggcagactgggcagcttccccgtgagaggcacccccatggccaccagactgctgctgtgcgagcacgccgagaagctgagcgccgccatcgtgctgaagaaccaccacagcagactgagcgacctggtgaacaccgccatcctgatcgccctgaacaagagagagtacgagatccccagcaacctgacccccgccgacgtgttcttcagagaggtgagccaggtggacaccatctgcgagtgcctgctggagcacgaggagcaggtgctgagagacgcccccatggacagcatcgagtgggccgaggtggtgatcaacgtgaacaacatcctgaaggacatgctgcaggccgccagccactacagacagaacagaaacagcctgtacagaagagaggagagcctggagaaggagcccgagtacgtgccctggaccgccaccagcggccccggcggcatcagaaccgtgatcatcagacagcacgagatcgtgctgaaggtggcctacccccaggccgacagcaacctgagaaacatcgtgaccgagcagctggtggccctgatcgactgcttcctggacggctacgtgagccagctgaagagcgtggacaagagcagcaacagagagagatacgacaacctggagatggagtacctgcagaagagaagcgacctgctgagccccctgctgagcctgggccagtacctgtgggccgccagcctggccgagaagtactgcgacttcgacatcctggtgcagatgtgcgagcagaccgacaaccagagcagactgcagagatacatgacccagttcgccgaccagaacttcagcgacttcctgttcagatggtacctggagaagggcaagagaggcaagctgctgagccagcccatcagccagcacggccagctggccaacttcctgcaggcccacgagcacctgagctggctgcacgagatcaacagccaggagctggagaaggcccacgccaccctgctgggcctggccaacatggagaccagatacttcgccaagaagaagaccctgctgggcctgagcaagctggccgccctggccagcgacttcagcgaggacatgctgcaggagaagatcgaggagatggccgagcaggagagattcctgctgcaccaggagaccctgcccgagcagctgctggccgagaagcagctgaacctgagcgccatgcccgtgctgaccgccccccagctgatcggcctgtacatctgcgaggagaacagaagagccaacgagtacgacttcaagaaggccctggacctgctggagtacatcgacgaggaggaggacatcaacatcaacgacctgaagctggagatcctgtgcaaggccctgcagagagacaactggagcagcagcgacggcaaggacgaccccatcgaggtgagcaaggacagcatcttcgtgaagatcctgcagaagctgctgaaggacggcatccagctgagcgagtacctgcccgaggtgaaggacctgctgcaggccgaccagctgggcagcctgaagagcaacccctacttcgagttcgtgctgaaggccaactacgagtactacgtgcagggccagatctag

SEQ ID NO: 91712 - DNA, 4428 bp, Artificial Sequence
  Description of Artificial Sequence: Synthetic coding sequence
atggccagcggcgccggcggcgtgggcggcggcggcggcggcaagatcagaaccagaagatgccaccagggccccatcaagccctaccagcagggcagacagcagcaccagggcatcctgagcagagtgaccgagagcgtgaagaacatcgtgcccggctggctgcagagatacttcaacaagaacgaggacgtgtgcagctgcagcaccgacaccagcgaggtgcccagatggcccgagaacaaggaggaccacctggtgtacgccgacgaggagagcagcaacatcaccgacggcagaatcacccccgagcccgccgtgagcaacaccgaggagcccagcaccaccagcaccgccagcaactaccccgacgtgctgaccagacccagcctgcacagaagccacctgaacttcagcatgctggagagccccgccctgcactgccagcccagcaccagcagcgccttccccatcggcagcagcggcttcagcctggtgaaggagatcaaggacagcaccagccagcacgacgacgacaacatcagcaccaccagcggcttcagcagcagagccagcgacaaggacatcaccgtgagcaagaacaccagcctgccccccctgtggagccccgaggccgagagaagccacagcctgagccagcacaccgccaccagcagcaagaagcccgccttcaacctgagcgccttcggcaccctgagccccagcctgggcaacagcagcatcctgaagaccagccagctgggcgacagccccttctaccccggcaagaccacctacggcggcgccgccgccgccgtgagacagagcaagctgagaaacaccccctaccaggcccccgtgagaagacagatgaaggccaagcagctgagcgcccagagctacggcgtgaccagcagcaccgccagaagaatcctgcagagcctggagaagatgagcagccccctggccgacgccaagagaatccccagcatcgtgagcagccccctgaacagccccctggacagaagcggcatcgacatcaccgacttccaggccaagagagagaaggtggacagccagtacccccccgtgcagagactgatgacccccaagcccgtgagcatcgccaccaacagaagcgtgtacttcaagcccagcctgacccccagcggcgagttcagaaagaccaaccagagaatcgacaacaagtgcagcaccggctacgagaagaacatgacccccggccagaacagagagcagagagagagcggcttcagctaccccaacttcagcctgcccgccgccaacggcctgagcagcggcgtgggcggcggcggcggcaagatgagaagagagagaaccagattcgtggccagcaagcccctggaggaggaggagatggaggtgcccgtgctgcccaagatcagcctgcccatcaccagcagcagcctgcccaccttcaacttcagcagccccgagatcaccaccagcagccccagccccatcaacagcagccaggccctgaccaacaaggtgcagatgaccagccccagcagcaccggcagccccatgttcaagttcagcagccccatcgtgaagagcaccgaggccaacgtgctgccccccagcagcatcggcttcaccttcagcgtgcccgtggccaagaccgccgagctgagcggcagcagcagcaccctggagcccatcatcagcagcagcgcccaccacgtgaccaccgtgaacagcaccaactgcaagaagaccccccccgaggactgcgagggccccttcagacccgccgagatcctgaaggagggcagcgtgctggacatcctgaagagccccggcttcgccagccccaagatcgacagcgtggccgcccagcccaccgccaccagccccgtggtgtacaccagacccgccatcagcagcttcagcagcagcggcatcggcttcggcgagagcctgaaggccggcagcagctggcagtgcgacacctgcctgctgcagaacaaggtgaccgacaacaagtgcatcgcctgccaggccgccaagctgagccccagagacaccgccaagcagaccggcatcgagacccccaacaagagcggcaagaccaccctgagcgccagcggcaccggcttcggcgacaagttcaagcccgtgatcggcacctgggactgcgacacctgcctggtgcagaacaagcccgaggccatcaagtgcgtggcctgcgagacccccaagcccggcacctgcgtgaagagagccctgaccctgaccgtggtgagcgagagcgccgagaccatgaccgccagcagcagcagctgcaccgtgaccaccggcaccctgggcttcggcgacaagttcaagagacccatcggcagctgggagtgcagcgtgtgctgcgtgagcaacaacgccgaggacaacaagtgcgtgagctgcatgagcgagaagcccggcagcagcgtgcccgccagcagcagcagcaccgtgcccgtgagcctgcccagcggcggcagcctgggcctggagaagttcaagaagcccgagggcagctgggactgcgagctgtgcctggtgcagaacaaggccgacagcaccaagtgcctggcctgcgagagcgccaagcccggcaccaagagcggcttcaagggcttcgacaccagcagcagcagcagcaacagcgccgccagcagcagcttcaagttcggcgtgagcagcagcagcagcggccccagccagaccctgaccagcaccggcaacttcaagttcggcgaccagggcggcttcaagatcggcgtgagcagcgacagcggcagcatcaaccccatgagcgagggcttcaagttcagcaagcccatcggcgacttcaagttcggcgtgagcagcgagagcaagcccgaggaggtgaagaaggacagcaagaacgacaacttcaagttcggcctgagcagcggcctgagcaaccccgtgagcctgacccccttccagttcggcgtgagcaacctgggccaggaggagaagaaggaggagctgcccaagagcagcagcgccggcttcagcttcggcaccggcgtgatcaacagcacccccgcccccgccaacaccatcgtgaccagcgagaacaagagcagcttcaacctgggcaccatcgagaccaagagcgccagcgtggcccccttcacctgcaagaccagcgaggccaagaaggaggagatgcccgccaccaagggcggcttcagcttcggcaacgtggagcccgccagcctgcccagcgccagcgtgttcgtgctgggcagaaccgaggagaagcagcaggagcccgtgaccagcaccagcctggtgttcggcaagaaggccgacaacgaggagcccaagtgccagcccgtgttcagcttcggcaacagcgagcagaccaaggacgagaacagcagcaagagcaccttcagcttcagcatgaccaagcccagcgagaaggagagcgagcagcccgccaaggccaccttcgccttcggcgcccagaccagcaccaccgccgaccagggcgccgccaagcccgtgttcagcttcctgaacaacagcagcagcagcagcagcacccccgccaccagcgccggcggcggcatcttcggcagcagcaccagcagcagcaacccccccgtggccaccttcgtgttcggccagagcagcaaccccgtgagcagcagcgccttcggcaacaccgccgagagcagcaccagccagagcctgctgttcagccaggacagcaagctggccaccaccagcagcaccggcaccgccgtgacccccttcgtgttcggccccggcgccagcagcaacaacaccaccaccagcggcttcggcttcggcgccaccaccaccagcagcagcgccggcagcagcttcgtgttcggcaccggccccagcgcccccagcgccagccccgccttcggcgccaaccagacccccaccttcggccagagccagggcgccagccagcccaacccccccggcttcggcagcatcagcagcagcaccgccctgttccccaccggcagccagcccgccccccccaccttcggcaccgtgagcagcagcagccagccccccgtgttcggccagcagcccagccagagcgccttcggcagcggcaccacccccaacagcagcagcgccttccagttcggcagcagcaccaccaacttcaacttcaccaacaacagccccagcggcgtgttcaccttcggcgccaacagcagcacccccgccgccagcgcccagcccagcggcagcggcggcttccccttcaaccagagccccgccgccttcaccgtgggcagcaacggcaagaacgtgttcagcagcagcggcaccagcttcagcggcagaaagatcaagaccgccgtgagaagaagaaagtag

SEQ ID NO: 91713 - DNA, 4368 bp, Artificial Sequence
  Description of Artificial Sequence: Synthetic coding sequence
ggcctgagactgtgcctgagcagacccctgaccagacccggcgccggcagcggcggcggcagcgccatggccagcggcgccggcggcgtgggcggcggcggcggcggcaagatcagaaccagaagatgccaccagggccccatcaagccctaccagcagggcagacagcagcaccagggcatcctgagcagagtgaccgagagcgtgaagaacatcgtgcccggctggctgcagagatacttcaacaagaacgaggacgtgtgcagctgcagcaccgacaccagcgaggtgcccagatggcccgagaacaaggaggaccacctggtgtacgccgacgaggagagcagcaacatcaccgacggcagaatcacccccgagcccgccgtgagcaacaccgaggagcccagcaccaccagcaccgccagcaactaccccgacgtgctgaccagacccagcctgcacagaagccacctgaacttcagcatgctggagagccccgccctgcactgccagcccagcaccagcagcgccttccccatcggcagcagcggcttcagcctggtgaaggagatcaaggacagcaccagccagcacgacgacgacaacatcagcaccaccagcggcttcagcagcagagccagcgacaaggacatcaccgtgagcaagaacaccagcctgccccccctgtggagccccgaggccgagagaagccacagcctgagccagcacaccgccaccagcagcaagaagcccgccttcaacctgagcgccttcggcaccctgagccccagcctgggcaacagcagcatcctgaagaccagccagctgggcgacagccccttctaccccggcaagaccacctacggcggcgccgccgccgccgtgagacagagcaagctgagaaacaccccctaccaggcccccgtgagaagacagatgaaggccaagcagctgagcgcccagagctacggcgtgaccagcagcaccgccagaagaatcctgcagagcctggagaagatgagcagccccctggccgacgccaagagaatccccagcatcgtgagcagccccctgaacagccccctggacagaagcggcatcgacatcaccgacttccaggccaagagagagaaggtggacagccagtacccccccgtgcagagactgatgacccccaagcccgtgagcatcgccaccaacagaagcgtgtacttcaagcccagcctgacccccagcggcgagttcagaaagaccaaccagagaatcgacaacaagtgcagcaccggctacgagaagaacatgacccccggccagaacagagagcagagagagagcggcttcagctaccccaacttcagcctgcccgccgccaacggcctgagcagcggcgtgggcggcggcggcggcaagatgagaagagagagaaccagattcgtggccagcaagcccctggaggaggaggagatggaggtgcccgtgctgcccaagatcagcctgcccatcaccagcagcagcctgcccaccttcaacttcagcagccccgagatcaccaccagcagccccagccccatcaacagcagccaggccctgaccaacaaggtgcagatgaccagccccagcagcaccggcagccccatgttcaagttcagcagccccatcgtgaagagcaccgaggccaacgtgctgccccccagcagcatcggcttcaccttcagcgtgcccgtggccaagaccgccgagctgagcggcagcagcagcaccctggagcccatcatcagcagcagcggcttcgccagccccaagatcgacagcgtggccgcccagcccaccgccaccagccccgtggtgtacaccagacccgccatcagcagcttcagcagcagcggcatcggcttcggcgagagcctgaaggccggcagcagctggcagtgcgacacctgcctgctgcagaacaaggtgaccgacaacaagtgcatcgcctgccaggccgccaagctgagccccagagacaccgccaagcagaccggcatcgagacccccaacaagagcggcaagaccaccctgagcgccagcggcaccggcttcggcgacaagttcaagcccgtgatcggcacctgggactgcgacacctgcctggtgcagaacaagcccgaggccatcaagtgcgtggcctgcgagacccccaagcccggcacctgcgtgaagagagccctgaccctgaccgtggtgagcgagagcgccgagaccatgaccgccagcagcagcagctgcaccgtgaccaccggcaccctgggcttcggcgacaagttcaagagacccatcggcagctgggagtgcagcgtgtgctgcgtgagcaacaacgccgaggacaacaagtgcgtgagctgcatgagcgagaagcccggcagcagcgtgcccgccagcagcagcagcaccgtgcccgtgagcctgcccagcggcggcagcctgggcctggagaagttcaagaagcccgagggcagctgggactgcgagctgtgcctggtgcagaacaaggccgacagcaccaagtgcctggcctgcgagagcgccaagcccggcaccaagagcggcttcaagggcttcgacaccagcagcagcagcagcaacagcgccgccagcagcagcttcaagttcggcgtgagcagcagcagcagcggccccagccagaccctgaccagcaccggcaacttcaagttcggcgaccagggcggcttcaagatcggcgtgagcagcgacagcggcagcatcaaccccatgagcgagggcttcaagttcagcaagcccatcggcgacttcaagttcggcgtgagcagcgagagcaagcccgaggaggtgaagaaggacagcaagaacgacaacttcaagttcggcctgagcagcggcctgagcaaccccgtgagcctgacccccttccagttcggcgtgagcaacctgggccaggaggagaagaaggaggagctgcccaagagcagcagcgccggcttcagcttcggcaccggcgtgatcaacagcacccccgcccccgccaacaccatcgtgaccagcgagaacaagagcagcttcaacctgggcaccatcgagaccaagagcgccagcgtggcccccttcacctgcaagaccagcgaggccaagaaggaggagatgcccgccaccaagggcggcttcagcttcggcaacgtggagcccgccagcctgcccagcgccagcgtgttcgtgctgggcagaaccgaggagaagcagcaggagcccgtgaccagcaccagcctggtgttcggcaagaaggccgacaacgaggagcccaagtgccagcccgtgttcagcttcggcaacagcgagcagaccaaggacgagaacagcagcaagagcaccttcagcttcagcatgaccaagcccagcgagaaggagagcgagcagcccgccaaggccaccttcgccttcggcgcccagaccagcaccaccgccgaccagggcgccgccaagcccgtgttcagcttcctgaacaacagcagcagcagcagcagcacccccgccaccagcgccggcggcggcatcttcggcagcagcaccagcagcagcaacccccccgtggccaccttcgtgttcggccagagcagcaaccccgtgagcagcagcgccttcggcaacaccgccgagagcagcaccagccagagcctgctgttcagccaggacagcaagctggccaccaccagcagcaccggcaccgccgtgacccccttcgtgttcggccccggcgccagcagcaacaacaccaccaccagcggcttcggcttcggcgccaccaccaccagcagcagcgccggcagcagcttcgtgttcggcaccggccccagcgcccccagcgccagccccgccttcggcgccaaccagacccccaccttcggccagagccagggcgccagccagcccaacccccccggcttcggcagcatcagcagcagcaccgccctgttccccaccggcagccagcccgccccccccaccttcggcaccgtgagcagcagcagccagccccccgtgttcggccagcagcccagccagagcgccttcggcagcggcaccacccccaacagcagcagcgccttccagttcggcagcagcaccaccaacttcaacttcaccaacaacagccccagcggcgtgttcaccttcggcgccaacagcagcacccccgccgccagcgcccagcccagcggcagcggcggcttccccttcaaccagagccccgccgccttcaccgtgggcagcaacggcaagaacgtgttcagcagcagcggcaccagcttcagcggcagaaagatcaagaccgccgtgagaagaagaaagtag

SEQ ID NO: 91714 - DNA, 4521 bp, Artificial Sequence
  Description of Artificial Sequence: Synthetic coding sequence
atggccagcggcgccggcggcgtgggcggcggcggcggcggcaagatcagaaccagaagatgccaccagggccccatcaagccctaccagcagggcagacagcagcaccagggcatcctgagcagagtgaccgagagcgtgaagaacatcgtgcccggctggctgcagagatacttcaacaagaacgaggacgtgtgcagctgcagcaccgacaccagcgaggtgcccagatggcccgagaacaaggaggaccacctggtgtacgccgacgaggagagcagcaacatcaccgacggcagaatcacccccgagcccgccgtgagcaacaccgaggagcccagcaccaccagcaccgccagcaactaccccgacgtgctgaccagacccagcctgcacagaagccacctgaacttcagcatgctggagagccccgccctgcactgccagcccagcaccagcagcgccttccccatcggcagcagcggcttcagcctggtgaaggagatcaaggacagcaccagccagcacgacgacgacaacatcagcaccaccagcggcttcagcagcagagccagcgacaaggacatcaccgtgagcaagaacaccagcctgccccccctgtggagccccgaggccgagagaagccacagcctgagccagcacaccgccaccagcagcaagaagcccgccttcaacctgagcgccttcggcaccctgagccccagcctgggcaacagcagcatcctgaagaccagccagctgggcgacagccccttctaccccggcaagaccacctacggcggcgccgccgccgccgtgagacagagcaagctgagaaacaccccctaccaggcccccgtgagaagacagatgaaggccaagcagctgagcgcccagagctacggcgtgaccagcagcaccgccagaagaatcctgcagagcctggagaagatgagcagccccctggccgacgccaagagaatccccagcatcgtgagcagccccctgaacagccccctggacagaagcggcatcgacatcaccgacttccaggccaagagagagaaggtggacagccagtacccccccgtgcagagactgatgacccccaagcccgtgagcatcgccaccaacagaagcgtgtacttcaagcccagcctgacccccagcggcgagttcagaaagaccaaccagagaatcgacaacaagtgcagcaccggctacgagaagaacatgacccccggccagaacagagagcagagagagagcggcttcagctaccccaacttcagcctgcccgccgccaacggcctgagcagcggcgtgggcggcggcggcggcaagatgagaagagagagaaccagattcgtggccagcaagcccctggaggaggagagacagggcctgaccgtgctgcccaagctgatcagcagcagctgcgcccaggccatcatccccagctggcccctgaaggtgctgagactgcaggagatggaggtgcccgtgctgcccaagatcagcctgcccatcaccagcagcagcctgcccaccttcaacttcagcagccccgagatcaccaccagcagccccagccccatcaacagcagccaggccctgaccaacaaggtgcagatgaccagccccagcagcaccggcagccccatgttcaagttcagcagccccatcgtgaagagcaccgaggccaacgtgctgccccccagcagcatcggcttcaccttcagcgtgcccgtggccaagaccgccgagctgagcggcagcagcagcaccctggagcccatcatcagcagcagcgcccaccacgtgaccaccgtgaacagcaccaactgcaagaagaccccccccgaggactgcgagggccccttcagacccgccgagatcctgaaggagggcagcgtgctggacatcctgaagagccccggcttcgccagccccaagatcgacagcgtggccgcccagcccaccgccaccagccccgtggtgtacaccagacccgccatcagcagcttcagcagcagcggcatcggcttcggcgagagcctgaaggccggcagcagctggcagtgcgacacctgcctgctgcagaacaaggtgaccgacaacaagtgcatcgcctgccaggccgccaagctgagccccagagacaccgccaagcagaccggcatcgagacccccaacaagagcggcaagaccaccctgagcgccagcggcaccggcttcggcgacaagttcaagcccgtgatcggcacctgggactgcgacacctgcctggtgcagaacaagcccgaggccatcaagtgcgtggcctgcgagacccccaagcccggcacctgcgtgaagagagccctgaccctgaccgtggtgagcgagagcgccgagaccatgaccgccagcagcagcagctgcaccgtgaccaccggcaccctgggcttcggcgacaagttcaagagacccatcggcagctgggagtgcagcgtgtgctgcgtgagcaacaacgccgaggacaacaagtgcgtgagctgcatgagcgagaagcccggcagcagcgtgcccgccagcagcagcagcaccgtgcccgtgagcctgcccagcggcggcagcctgggcctggagaagttcaagaagcccgagggcagctgggactgcgagctgtgcctggtgcagaacaaggccgacagcaccaagtgcctggcctgcgagagcgccaagcccggcaccaagagcggcttcaagggcttcgacaccagcagcagcagcagcaacagcgccgccagcagcagcttcaagttcggcgtgagcagcagcagcagcggccccagccagaccctgaccagcaccggcaacttcaagttcggcgaccagggcggcttcaagatcggcgtgagcagcgacagcggcagcatcaaccccatgagcgagggcttcaagttcagcaagcccatcggcgacttcaagttcggcgtgagcagcgagagcaagcccgaggaggtgaagaaggacagcaagaacgacaacttcaagttcggcctgagcagcggcctgagcaaccccgtgagcctgacccccttccagttcggcgtgagcaacctgggccaggaggagaagaaggaggagctgcccaagagcagcagcgccggcttcagcttcggcaccggcgtgatcaacagcacccccgcccccgccaacaccatcgtgaccagcgagaacaagagcagcttcaacctgggcaccatcgagaccaagagcgccagcgtggcccccttcacctgcaagaccagcgaggccaagaaggaggagatgcccgccaccaagggcggcttcagcttcggcaacgtggagcccgccagcctgcccagcgccagcgtgttcgtgctgggcagaaccgaggagaagcagcaggagcccgtgaccagcaccagcctggtgttcggcaagaaggccgacaacgaggagcccaagtgccagcccgtgttcagcttcggcaacagcgagcagaccaaggacgagaacagcagcaagagcaccttcagcttcagcatgaccaagcccagcgagaaggagagcgagcagcccgccaaggccaccttcgccttcggcgcccagaccagcaccaccgccgaccagggcgccgccaagcccgtgttcagcttcctgaacaacagcagcagcagcagcagcacccccgccaccagcgccggcggcggcatcttcggcagcagcaccagcagcagcaacccccccgtggccaccttcgtgttcggccagagcagcaaccccgtgagcagcagcgccttcggcaacaccgccgagagcagcaccagccagagcctgctgttcagccaggacagcaagctggccaccaccagcagcaccggcaccgccgtgacccccttcgtgttcggccccggcgccagcagcaacaacaccaccaccagcggcttcggcttcggcgccaccaccaccagcagcagcgccggcagcagcttcgtgttcggcaccggccccagcgcccccagcgccagccccgccttcggcgccaaccagacccccaccttcggccagagccagggcgccagccagcccaacccccccggcttcggcagcatcagcagcagcaccgccctgttccccaccggcagccagcccgccccccccaccttcggcaccgtgagcagcagcagccagccccccgtgttcggccagcagcccagccagagcgccttcggcagcggcaccacccccaacagcagcagcgccttccagttcggcagcagcaccaccaacttcaacttcaccaacaacagccccagcggcgtgttcaccttcggcgccaacagcagcacccccgccgccagcgcccagcccagcggcagcggcggcttccccttcaaccagagccccgccgccttcaccgtgggcagcaacggcaagaacgtgttcagcagcagcggcaccagcttcagcggcagaaagatcaagaccgccgtgagaagaagaaagtag

SEQ ID NO: 91715 - DNA, 3555 bp, Artificial Sequence
  Description of Artificial Sequence: Synthetic coding sequence
atgatgcagctgctgcagctgctgctgggcctgctgggccccggcggctacctgttcctgctgggcgactgccaggaggtgaccaccctgaccgtgaagtaccaggtgagcgaggaggtgcccagcggcaccgtgatcggcaagctgagccaggagctgggcagagaggagagaagaagacaggccggcgccgccttccaggtgctgcagctgccccaggccctgcccatccaggtggacagcgaggagggcctgctgagcaccggcagaagactggacagagagcagctgtgcagacagtgggacccctgcctggtgagcttcgacgtgctggccaccggcgacctggccctgatccacgtggagatccaggtgctggacatcaacgaccaccagcccagattccccaagggcgagcaggagctggagatcagcgagagcgccagcctgagaaccagaatccccctggacagagccctggaccccgacaccggccccaacaccctgcacacctacaccctgagccccagcgagcacttcgccctggacgtgatcgtgggccccgacgagaccaagcacgccgagctgatcgtggtgaaggagctggacagagagatccacagcttcttcgacctggtgctgaccgcctacgacaacggcaacccccccaagagcggcaccagcctggtgaaggtgaacgtgctggacagcaacgacaacagccccgccttcgccgagagcagcctggccctggagatccaggaggacgccgcccccggcaccctgctgatcaagctgaccgccaccgaccccgaccagggccccaacggcgaggtggagttcttcctgagcaagcacatgccccccgaggtgctggacaccttcagcatcgacgccaagaccggccaggtgatcctgagaagacccctggactacgagaagaaccccgcctacgaggtggacgtgcaggccagagacctgggccccaaccccatccccgcccactgcaaggtgctgatcaaggtgctggacgtgaacgacaacatccccagcatccacgtgacctgggccagccagcccagcctggtgagcgaggccctgcccaaggacagcttcatcgccctggtgatggccgacgacctggacagcggccacaacggcctggtgcactgctggctgagccaggagctgggccacttcagactgaagagaaccaacggcaacacctacatgctgctgaccaacgccaccctggacagagagcagtggcccaagtacaccctgaccctgctggcccaggaccagggcctgcagcccctgagcgccaagaagcagctgagcatccagatcagcgacatcaacgacaacgcccccgtgttcgagaagagcagatacgaggtgagcaccagagagaacaacctgcccagcctgcacctgatcaccatcaaggcccacgacgccgacctgggcatcaacggcaaggtgagctacagaatccaggacagccccgtggcccacctggtggccatcgacagcaacaccggcgaggtgaccgcccagagaagcctgaactacgaggagatggccggcttcgagttccaggtgatcgccgaggacagcggccagcccatgctggccagcagcgtgagcgtgtgggtgagcctgctggacgccaacgacaacgcccccgaggtggtgcagcccgtgctgagcgacggcaaggccagcctgagcgtgctggtgaacgccagcaccggccacctgctggtgcccatcgagacccccaacggcctgggccccgccggcaccgacaccccccccctggccacccacagcagcagacccttcctgctgaccaccatcgtggccagagacgccgacagcggcgccaacggcgagcccctgtacagcatcagaagcggcaacgaggcccacctgttcatcctgaacccccacaccggccagctgttcgtgaacgtgaccaacgccagcagcctgatcggcagcgagtgggagctggagatcgtggtggaggaccagggcagcccccccctgcagaccagagccctgctgagagtgatgttcgtgaccagcgtggaccacctgagagacagcgccagaaagcccggcgccctgagcatgagcatgctgaccgtgatctgcctggccgtgctgctgggcatcttcggcctgatcctggccctgttcatgagcatctgcagaaccgagaagaaggacaacagagcctacaactgcagagaggccgagagcacctacagacagcagcccaagagaccccagaagcacatccagaaggccgacatccacctggtgcccgtgctgagaggccaggccggcgagccctgcgaggtgggccagagccacaaggacgtggacaaggaggccatgatggaggccggctgggacccctgcctgcaggcccccttccacctgacccccaccctgtacagaaccctgagaaaccagggcaaccagggcgcccccgccgagagcagagaggtgctgcaggacaccgtgaacctgctgttcaaccaccccagacagagaaacgccagcagagagaacctgaacctgcccgagccccagcccgccaccggccagcccagaagcagacccctgaaggtggccggcagccccaccggcagactggccggcgaccagggcagcgaggaggccccccagagaccccccgccagcagcgccaccctgagaagacagagacacctgaacggcaaggtgagccccgagaaggagagcggccccagacagatcctgagaagcctggtgagactgagcgtggccgccttcgccgagagaaaccccgtggaggagctgaccgtggacagcccccccgtgcagcagatcagccagctgctgagcctgctgcaccagggccagttccagcccaagcccaaccacagaggcaacaagtacctggccaagcccggcggcagcagaagcgccatccccgacaccgacggccccagcgccagagccggcggccagaccgaccccgagcaggaggagggccccctggaccccgaggaggacctgagcgtgaagcagctgctggaggaggagctgagcagcctgctggaccccagcaccggcctggccctggacagactgagcgcccccgaccccgcctggatggccagactgagcctgcccctgaccaccaactacagagacaacgtgatcagccccgacgccgccgccaccgaggagcccagaaccttccagaccttcggcaaggccgaggcccccgagctgagccccaccggcaccagactggccagcaccttcgtgagcgagatgagcagcctgctggagatgctgctggagcagagaagcagcatgcccgtggaggccgccagcgaggccctgagaagactgagcgtgtgcggcagaaccctgagcctggacctggccaccagcgccgccagcggcatgaaggtgcagggcgaccccggcggcaagaccggcaccgagggcaagagcagaggcagcagcagcagcagcagatgcctgtag

SEQ ID NO: 91716 - DNA, 3999 bp, Artificial Sequence
  Description of Artificial Sequence: Synthetic coding sequence
atgagcgacatggactaccccctgcagggccccggcctgctgagcgtgcccaacctgcccgagatcagcagcatcagaagagtgcccctgccccccgagctggtggagcagttcggccacatgcagtgcaactgcatgatgggcgtgttcccccccatcagcagagcctggctgaccatcgacagcgacatcttcatgtggaactacgaggacggcggcgacctggcctacttcgacggcctgagcgagaccatcctggccgtgggcctggtgaagcccaaggccggcatcttccagccccacgtgagacacctgctggtgctggccacccccgtggacatcgtgatcctgggcctgagctacgccaacctgcagaccggcagcggcgtgctgaacgacagcctgagcggcggcatgcagctgctgcccgaccccctgtacagcctgcccaccgacaacacctacctgctgaccatcaccagcaccgacaacggcagaatcttcctggccggcaaggacggctgcctgtacgaggtggcctaccaggccgaggccggctggttcagccagagatgcagaaagatcaaccacagcaagagcagcctgagcttcctggtgcccagcctgctgcagttcaccttcagcgaggacgaccccatcctgcagatcgccatcgacaacagcagaaacatcctgtacaccagaagcgagaagggcgtgatccaggtgtacgacctgggccaggacggccagggcatgagcagagtggccagcgtgagccagaacgccatcgtgagcgccgccggcaacatcgccagaaccatcgacagaagcgtgttcaagcccatcgtgcagatcgccgtgatcgagaacagcgagagcctggactgccagctgctggccgtgacccacgccggcgtgagactgtacttcagcacctgccccttcagacagcccctggccagacccaacaccctgaccctggtgcacgtgagactgccccccggcttcagcgccagcagcaccgtggagaagcccagcaaggtgcacagagccctgtacagcaagggcatcctgctgatggccgccagcgagaacgaggacaacgacatcctgtggtgcgtgaaccacgacaccttccccttccagaagcccatgatggagacccagatgaccgccggcgtggacggccacagctgggccctgagcgccatcgacgagctgaaggtggacaagatcatcacccccctgaacaaggaccacatccccatcaccgacagccccgtggtggtgcagcagcacatgctgccccccaagaagttcgtgctgctgagcgcccagggcagcctgatgttccacaagctgagacccgtggaccagctgagacacctgctggtgagcaacgtgggcggcgacggcgaggagatcgagagattcttcaagctgcaccaggaggaccaggcctgcgccacctgcctgatcctggcctgcagcaccgccgcctgcgacagagaggtgagcgcctgggccaccagagccttcttcagatacggcggcgaggcccagatgagattccccaccaccctgcccccccccagcaacgtgggccccatcctgggcagccccgtgtacagcagcagccccgtgcccagcggcagcccctaccccaaccccagcttcctgggcacccccagccacggcatccagccccccgccatgagcacccccgtgtgcgccctgggcaaccccgccacccaggccaccaacatgagctgcgtgaccggccccgagatcgtgtacagcggcaagcacaacggcatctgcatctacttcagcagaatcatgggcaacatctgggacgccagcctggtggtggagagaatcttcaagagcggcaacagagagatcaccgccatcgagagcagcgtgccctgccagctgctggagagcgtgctgcaggagctgaagggcctgcaggagttcctggacagaaacagccagttcgccggcggccccctgggcaaccccaacaccaccgccaaggtgcagcagagactgatcggcttcatgagacccgagaacggcaacccccagcagatgcagcaggagctgcagagaaagttccacgaggcccagctgagcgagaagatcagcctgcaggccatccagcagctggtgagaaagagctaccaggccctggccctgtggaagctgctgtgcgagcaccagttcaccatcatcgtggccgagctgcagaaggagctgcaggagcagctgaagatcaccaccttcaaggacctggtgatcagagacaaggagctgaccggcgccctgatcgccagcctgatcaactgctacatcagagacaacgccgccgtggacggcatcagcctgcacctgcaggacatctgccccctgctgtacagcaccgacgacgccatctgcagcaaggccaacgagctgctgcagagaagcagacaggtgcagaacaagaccgagaaggagagaatgctgagagagagcctgaaggagtaccagaagatcagcaaccaggtggacctgagcaacgtgtgcgcccagtacagacaggtgagattctacgagggcgtggtggagctgagcctgaccgccgccgagaagaaggacccccagggcctgggcctgcacttctacaagcacggcgagcccgaggaggacatcgtgggcctgcaggccttccaggagagactgaacagctacaagtgcatcaccgacaccctgcaggagctggtgaaccagagcaaggccgccccccagagccccagcgtgcccaagaagcccggcccccccgtgctgagcagcgaccccaacatgctgagcaacgaggaggccggccaccacttcgagcagatgctgaagctgagccagagaagcaaggacgagctgttcagcatcgccctgtacaactggctgatccaggtggacctggccgacaagctgctgcaggtggccagccccttcctggagccccacctggtgagaatggccaaggtggaccagaacagagtgagatacatggacctgctgtggagatactacgagaagaacagaagcttcagcaacgccgccagagtgctgagcagactggccgacatgcacagcaccgagatcagcctgcagcagagactggagtacatcgccagagccatcctgagcgccaagagcagcaccgccatcagcagcatcgccgccgacggcgagttcctgcacgagctggaggagaagatggaggtggccagaatccagctgcagatccaggagaccctgcagagacagtacagccaccacagcagcgtgcaggacgccgtgagccagctggacagcgagctgatggacatcaccaagctgtacggcgagttcgccgaccccttcaagctggccgagtgcaagctggccatcatccactgcgccggctacagcgaccccatcctggtgcagaccctgtggcaggacatcatcgagaaggagctgagcgacagcgtgaccctgagcagcagcgacagaatgcacgccctgagcctgaagatcgtgctgctgggcaagatctacgccggcacccccagattcttccccctggacttcatcgtgcagttcctggagcagcaggtgtgcaccctgaactgggacgtgggcttcgtgatccagaccatgaacgagatcggcgtgcccctgcccagactgctggaggtgtacgaccagctgttcaagagcagagaccccttctggaacagaatgaagaagcccctgcacctgctggactgcatccacgtgctgctgatcagatacgtggagaaccccagccaggtgctgaactgcgagagaagaagattcaccaacctgtgcctggacgccgtgtgcggctacctggtggagctgcagagcatgagcagcagcgtggccgtgcaggccatcaccggcaacttcaagagcctgcaggccaagctggagagactgcactag

SEQ ID NO: 91717 - DNA, 4062 bp, Artificial Sequence
  Description of Artificial Sequence: Synthetic coding sequence
atgtaccccgacctgagcgagctgctgatggtgagcgcccccaacaaccccaccgtgagcggcatgagcgacatggactaccccctgcagggccccggcctgctgagcgtgcccaacctgcccgagatcagcagcatcagaagagtgcccctgccccccgagctggtggagcagttcggccacatgcagtgcaactgcatgatgggcgtgttcccccccatcagcagagcctggctgaccatcgacagcgacatcttcatgtggaactacgaggacggcggcgacctggcctacttcgacggcctgagcgagaccatcctggccgtgggcctggtgaagcccaaggccggcatcttccagccccacgtgagacacctgctggtgctggccacccccgtggacatcgtgatcctgggcctgagctacgccaacctgcagaccggcagcggcgtgctgaacgacagcctgagcggcggcatgcagctgctgcccgaccccctgtacagcctgcccaccgacaacacctacctgctgaccatcaccagcaccgacaacggcagaatcttcctggccggcaaggacggctgcctgtacgaggtggcctaccaggccgaggccggctggttcagccagagatgcagaaagatcaaccacagcaagagcagcctgagcttcctggtgcccagcctgctgcagttcaccttcagcgaggacgaccccatcctgcagatcgccatcgacaacagcagaaacatcctgtacaccagaagcgagaagggcgtgatccaggtgtacgacctgggccaggacggccagggcatgagcagagtggccagcgtgagccagaacgccatcgtgagcgccgccggcaacatcgccagaaccatcgacagaagcgtgttcaagcccatcgtgcagatcgccgtgatcgagaacagcgagagcctggactgccagctgctggccgtgacccacgccggcgtgagactgtacttcagcacctgccccttcagacagcccctggccagacccaacaccctgaccctggtgcacgtgagactgccccccggcttcagcgccagcagcaccgtggagaagcccagcaaggtgcacagagccctgtacagcaagggcatcctgctgatggccgccagcgagaacgaggacaacgacatcctgtggtgcgtgaaccacgacaccttccccttccagaagcccatgatggagacccagatgaccgccggcgtggacggccacagctgggccctgagcgccatcgacgagctgaaggtggacaagatcatcacccccctgaacaaggaccacatccccatcaccgacagccccgtggtggtgcagcagcacatgctgccccccaagaagttcgtgctgctgagcgcccagggcagcctgatgttccacaagctgagacccgtggaccagctgagacacctgctggtgagcaacgtgggcggcgacggcgaggagatcgagagattcttcaagctgcaccaggaggaccaggcctgcgccacctgcctgatcctggcctgcagcaccgccgcctgcgacagagaggtgagcgcctgggccaccagagccttcttcagatacggcggcgaggcccagatgagattccccaccaccctgcccccccccagcaacgtgggccccatcctgggcagccccgtgtacagcagcagccccgtgcccagcggcagcccctaccccaaccccagcttcctgggcacccccagccacggcatccagccccccgccatgagcacccccgtgtgcgccctgggcaaccccgccacccaggccaccaacatgagctgcgtgaccggccccgagatcgtgtacagcggcaagcacaacggcatctgcatctacttcagcagaatcatgggcaacatctgggacgccagcctggtggtggagagaatcttcaagagcggcaacagagagatcaccgccatcgagagcagcgtgccctgccagctgctggagagcgtgctgcaggagctgaagggcctgcaggagttcctggacagaaacagccagttcgccggcggccccctgggcaaccccaacaccaccgccaaggtgcagcagagactgatcggcttcatgagacccgagaacggcaacccccagcagatgcagcaggagctgcagagaaagttccacgaggcccagctgagcgagaagatcagcctgcaggccatccagcagctggtgagaaagagctaccaggccctggccctgtggaagctgctgtgcgagcaccagttcaccatcatcgtggccgagctgcagaaggagctgcaggagcagctgaagatcaccaccttcaaggacctggtgatcagagacaaggagctgaccggcgccctgatcgccagcctgatcaactgctacatcagagacaacgccgccgtggacggcatcagcctgcacctgcaggacatctgccccctgctgtacagcaccgacgacgccatctgcagcaaggccaacgagctgctgcagagaagcagacaggtgcagaacaagaccgagaaggagagaatgctgagagagagcctgaaggagtaccagaagatcagcaaccaggtggacctgagcaacgtgtgcgcccagtacagacaggtgagattctacgagggcgtggtggagctgagcctgaccgccgccgagaagaaggacccccagggcctgggcctgcacttctacaagcacggcgagcccgaggaggacatcgtgggcctgcaggccttccaggagagactgaacagctacaagtgcatcaccgacaccctgcaggagctggtgaaccagagcaaggccgccccccagagccccagcgtgcccaagaagcccggcccccccgtgctgagcagcgaccccaacatgctgagcaacgaggaggccggccaccacttcgagcagatgctgaagctgagccagagaagcaaggacgagctgttcagcatcgccctgtacaactggctgatccaggtggacctggccgacaagctgctgcaggtggccagccccttcctggagccccacctggtgagaatggccaaggtggaccagaacagagtgagatacatggacctgctgtggagatactacgagaagaacagaagcttcagcaacgccgccagagtgctgagcagactggccgacatgcacagcaccgagatcagcctgcagcagagactggagtacatcgccagagccatcctgagcgccaagagcagcaccgccatcagcagcatcgccgccgacggcgagttcctgcacgagctggaggagaagatggaggtggccagaatccagctgcagatccaggagaccctgcagagacagtacagccaccacagcagcgtgcaggacgccgtgagccagctggacagcgagctgatggacatcaccaagctgtacggcgagttcgccgaccccttcaagctggccgagtgcaagctggccatcatccactgcgccggctacagcgaccccatcctggtgcagaccctgtggcaggacatcatcgagaaggagctgagcgacagcgtgaccctgagcagcagcgacagaatgcacgccctgagcctgaagatcgtgctgctgggcaagatctacgccggcacccccagattcttccccctggacttcatcgtgcagttcctggagcagcaggtgtgcaccctgaactgggacgtgggcttcgtgatccagaccatgaacgagatcggcgtgcccctgcccagactgctggaggtgtacgaccagctgttcaagagcagagaccccttctggaacagaatgaagaagcccctgcacctgctggactgcatccacgtgctgctgatcagatacgtggagaaccccagccaggtgctgaactgcgagagaagaagattcaccaacctgtgcctggacgccgtgtgcggctacctggtggagctgcagagcatgagcagcagcgtggccgtgcaggccatcaccggcaacttcaagagcctgcaggccaagctggagagactgcactag

SEQ ID NO: 91718 - DNA, 3984 bp, Artificial Sequence
  Description of Artificial Sequence: Synthetic coding sequence
atgcccagcagcctgctgggcgccgccatgcccgccagcaccagcgccgccgccctgcaggaggccctggagaacgccggcagactgatcgacagacagctgcaggaggacagaatgtaccccgacctgagcgagctgctgatggtgagcgcccccaacaaccccaccgtgagcggcatgagcgacatggactaccccctgcagggccccggcctgctgagcgtgcccaacctgcccgagatcagcagcatcagaagagtgcccctgccccccgagctggtggagcagttcggccacatgcagtgcaactgcatgatgggcgtgttcccccccatcagcagagcctggctgaccatcgacagcgacatcttcatgtggaactacgaggacggcggcgacctggcctacttcgacggcctgagcgagaccatcctggccgtgggcctggtgaagcccaaggccggcatcttccagccccacgtgagacacctgctggtgctggccacccccgtggacatcgtgatcctgggcctgagctacgccaacctgcagaccggcagcggcgtgctgaacgacagcctgagcggcggcatgcagctgctgcccgaccccctgtacagcctgcccaccgacaacacctacctgctgaccatcaccagcaccgacaacggcagaatcttcctggccggcaaggacggctgcctgtacgaggtggcctaccaggccgaggccggctggttcagccagagatgcagaaagatcaaccacagcaagagcagcctgagcttcctggtgcccagcctgctgcagttcaccttcagcgaggacgaccccatcctgcagatcgccatcgacaacagcagaaacatcctgtacaccagaagcgagaagggcgtgatccaggtgtacgacctgggccaggacggccagggcatgagcagagtggccagcgtgagccagaacgccatcgtgagcgccgccggcaacatcgccagaaccatcgacagaagcgtgttcaagcccatcgtgcagatcgccgtgatcgagaacagcgagagcctggactgccagctgctggccgtgacccacgccggcgtgagactgtacttcagcacctgccccttcagacagcccctggccagacccaacaccctgaccctggtgcacgtgagactgccccccggcttcagcgccagcagcaccgtggagaagcccagcaaggtgcacagagccctgtacagcaagggcatcctgctgatggccgccagcgagaacgaggacaacgacatcctgtggtgcgtgaaccacgacaccttccccttccagaagcccatgatggagacccagatgaccgccggcgtggacggccacagctgggccctgagcgccatcgacgagctgaaggtggacaagatcatcacccccctgaacaaggaccacatccccatcaccgacagccccgtggtggtgcagcagcacatgctgccccccaagaagttcgtgctgctgagcgcccagggcagcctgatgttccacaagctgagacccgtggaccagctgagacacctgctggtgagcaacgtgggcggcgacggcgaggagatcgagagattcttcaagctgcaccaggaggaccaggcctgcgccacctgcctgatcctggcctgcagcaccgccgcctgcgacagagaggtgagcgcctgggccaccagagccttcttcagatacggcggcgaggcccagatgagattccccaccaccctgcccccccccagcaacgtgggccccatcctgggcagccccgtgtacagcagcagccccgtgcccagcggcagcccctaccccaaccccagcttcctgggcacccccagccacggcatccagccccccgccatgagcacccccgtgtgcgccctgggcaaccccgccacccaggccaccaacatgagctgcgtgaccggccccgagatcgtgtacagcggcaagcacaacggcatctgcatctacttcagcagaatcatgggcaacatctgggacgccagcctggtggtggagagaatcttcaagagcggcaacagagagatcaccgccatcgagagcagcgtgccctgccagctgctggagagcgtgctgcaggagctgaagggcctgcaggagttcctggacagaaacagccagttcgccggcggccccctgggcaaccccaacaccaccgccaaggtgcagcagagactgatcggcttcatgagacccgagaacggcaacccccagcagatgcagcaggagctgcagagaaagttccacgaggcccagctgagcgagaagatcagcctgcaggccatccagcagctggtgagaaagagctaccaggccctggccctgtggaagctgctgtgcgagcaccagttcaccatcatcgtggccgagctgcagaaggccaacgagctgctgcagagaagcagacaggtgcagaacaagaccgagaaggagagaatgctgagagagagcctgaaggagtaccagaagatcagcaaccaggtggacctgagcaacgtgtgcgcccagtacagacaggtgagattctacgagggcgtggtggagctgagcctgaccgccgccgagaagaaggacccccagggcctgggcctgcacttctacaagcacggcgagcccgaggaggacatcgtgggcctgcaggccttccaggagagactgaacagctacaagtgcatcaccgacaccctgcaggagctggtgaaccagagcaaggccgccccccagagccccagcgtgcccaagaagcccggcccccccgtgctgagcagcgaccccaacatgctgagcaacgaggaggccggccaccacttcgagcagatgctgaagctgagccagagaagcaaggacgagctgttcagcatcgccctgtacaactggctgatccaggtggacctggccgacaagctgctgcaggtggccagccccttcctggagccccacctggtgagaatggccaaggtggaccagaacagagtgagatacatggacctgctgtggagatactacgagaagaacagaagcttcagcaacgccgccagagtgctgagcagactggccgacatgcacagcaccgagatcagcctgcagcagagactggagtacatcgccagagccatcctgagcgccaagagcagcaccgccatcagcagcatcgccgccgacggcgagttcctgcacgagctggaggagaagatggaggtggccagaatccagctgcagatccaggagaccctgcagagacagtacagccaccacagcagcgtgcaggacgccgtgagccagctggacagcgagctgatggacatcaccaagctgtacggcgagttcgccgaccccttcaagctggccgagtgcaagctggccatcatccactgcgccggctacagcgaccccatcctggtgcagaccctgtggcaggacatcatcgagaaggagctgagcgacagcgtgaccctgagcagcagcgacagaatgcacgccctgagcctgaagatcgtgctgctgggcaagatctacgccggcacccccagattcttccccctggacttcatcgtgcagttcctggagcagcaggtgtgcaccctgaactgggacgtgggcttcgtgatccagaccatgaacgagatcggcgtgcccctgcccagactgctggaggtgtacgaccagctgttcaagagcagagaccccttctggaacagaatgaagaagcccctgcacctgctggactgcatccacgtgctgctgatcagatacgtggagaaccccagccaggtgctgaactgcgagagaagaagattcaccaacctgtgcctggacgccgtgtgcggctacctggtggagctgcagagcatgagcagcagcgtggccgtgcaggccatcaccggcaacttcaagagcctgcaggccaagctggagagactgcactag

SEQ ID NO: 91719 - DNA, 4311 bp, Artificial Sequence
  Description of Artificial Sequence: Synthetic coding sequence
atgctgcacctgagcgccgccccccccgcccccccccccgaggtgaccgccaccgccagaccctgcctgtgcagcgtgggcagaagaggcgacggcggcaagatggccgccgccggcgccctggagagaagcttcgtggagctgagcggcgccgagagagagagacccagacacttcagagagttcaccgtgtgcagcatcggcaccgccaacgccgtggccggcgccgtgaagtacagcgagagcgccggcggcttctactacgtggagagcggcaagctgttcagcgtgaccagaaacagattcatccactggaagaccagcggcgacaccctggagctgatggaggagagcctggacatcaacctgctgaacaacgccatcagactgaagttccagaactgcagcgtgctgcccggcggcgtgtacgtgagcgagacccagaacagagtgatcatcctgatgctgaccaaccagaccgtgcacagactgctgctgccccaccccagcagaatgtacagaagcgagctggtggtggacagccagatgcagagcatcttcaccgacatcggcaaggtggacttcaccgacccctgcaactaccagctgatccccgccgtgcccggcatcagccccaacagcaccgccagcaccgcctggctgagcagcgacggcgaggccctgttcgccctgccctgcgccagcggcggcatcttcgtgctgaagctgcccccctacgacatccccggcatggtgagcgtggtggagctgaagcagagcagcgtgatgcagagactgctgaccggctggatgcccaccgccatcagaggcgaccagagccccagcgacagacccctgagcctggccgtgcactgcgtggagcacgacgccttcatcttcgccctgtgccaggaccacaagctgagaatgtggagctacaaggagcagatgtgcctgatggtggccgacatgctggagtacgtgcccgtgaagaaggacctgagactgaccgccggcaccggccacaagctgagactggcctacagccccaccatgggcctgtacctgggcatctacatgcacgcccccaagagaggccagttctgcatcttccagctggtgagcaccgagagcaacagatacagcctggaccacatcagcagcctgttcaccagccaggagaccctgatcgacttcgccctgaccagcaccgacatctgggccctgtggcacgacgccgagaaccagaccgtggtgaagtacatcaacttcgagcacaacgtggccggccagtggaaccccgtgttcatgcagcccctgcccgaggaggagatcgtgatcagagacgaccaggaccccagagagatgtacctgcagagcctgttcacccccggccagttcaccaacgaggccctgtgcaaggccctgcagatcttctgcagaggcaccgagagaaacctggacctgagctggagcgagctgaagaaggaggtgaccctggccgtggagaacgagctgcagggcagcgtgaccgagtacgagttcagccaggaggagttcagaaacctgcagcaggagttctggtgcaagttctacgcctgctgcctgcagtaccaggaggccctgagccaccccctggccctgcacctgaacccccacaccaacatggtgtgcctgctgaagaagggctacctgagcttcctgatccccagcagcctggtggaccacctgtacctgctgccctacgagaacctgctgaccgaggacgagaccaccatcagcgacgacgtggacatcgccagagacgtgatctgcctgatcaagtgcctgagactgatcgaggagagcgtgaccgtggacatgagcgtgatcatggagatgagctgctacaacctgcagagccccgagaaggccgccgagcagatcctggaggacatgatcaccatcgacgtggagaacgtgatggaggacatctgcagcaagctgcaggagatcagaaaccccatccacgccatcggcctgctgatcagagagatggactacgagaccgaggtggagatggagaagggcttcaaccccgcccagcccctgaacatcagaatgaacctgacccagctgtacggcagcaacaccgccggctacatcgtgtgcagaggcgtgcacaagatcgccagcaccagattcctgatctgcagagacctgctgatcctgcagcagctgctgatgagactgggcgacgccgtgatctggggcaccggccagctgttccaggcccagcaggacctgctgcacagaaccgcccccctgctgctgagctactacctgatcaagtggggcagcgagtgcctggccaccgacgtgcccctggacaccctggagagcaacctgcagcacctgagcgtgctggagctgaccgacagcggcgccctgatggccaacagattcgtgagcagcccccagaccatcgtggagctgttcttccaggaggtggccagaaagcacatcatcagccacctgttcagccagcccaaggcccccctgagccagaccggcctgaactggcccgagatgatcaccgccatcaccagctacctgctgcagctgctgtggcccagcaaccccggctgcctgttcctggagtgcctgatgggcaactgccagtacgtgcagctgcaggactacatccagctgctgcacccctggtgccaggtgaacgtgggcagctgcagattcatgctgggcagatgctacctggtgaccggcgagggccagaaggccctggagtgcttctgccaggccgccagcgaggtgggcaaggaggagttcctggacagactgatcagaagcgaggacggcgagatcgtgagcacccccagactgcagtactacgacaaggtgctgagactgctggacgtgatcggcctgcccgagctggtgatccagctggccaccagcgccatcaccgaggccggcgacgactggaagagccaggccaccctgagaacctgcatcttcaagcaccacctggacctgggccacaacagccaggcctacgaggccctgacccagatccccgacagcagcagacagctggactgcctgagacagctggtggtggtgctgtgcgagagaagccagctgcaggacctggtggagttcccctacgtgaacctgcacaacgaggtggtgggcatcatcgagagcagagccagagccgtggacctgatgacccacaactactacgagctgctgtacgccttccacatctacagacacaactacagaaaggccggcaccgtgatgttcgagtacggcatgagactgggcagagaggtgagaaccctgagaggcctggagaagcagggcaactgctacctggccgccctgaactgcctgagactgatcagacccgagtacgcctggatcgtgcagcccgtgagcggcgccgtgtacgacagacccggcgccagccccaagagaaaccacgacggcgagtgcaccgccgcccccaccaacagacagatcgagatcctggagctggaggacctggagaaggagtgcagcctggccagaatcagactgaccctggcccagcacgaccccagcgccgtggccgtggccggcagcagcagcgccgaggagatggtgaccctgctggtgcaggccggcctgttcgacaccgccatcagcctgtgccagaccttcaagctgcccctgacccccgtgttcgagggcctggccttcaagtgcatcaagctgcagttcggcggcgaggccgcccaggccgaggcctgggcctggctggccgccaaccagctgagcagcgtgatcaccaccaaggagagcagcgccaccgacgaggcctggagactgctgagcacctacctggagagatacaaggtgcagaacaacctgtaccaccactgcgtgatcaacaagctgctgagccacggcgtgcccctgcccaactggctgatcaacagctacaagaaggtggacgccgccgagctgctgagactgtacctgaactacgacctgctggaggaggccgtggacctggtgagcgagtacgtggacgccgtgctgggcaagggccaccagtacttcggcatcgagttccccctgagcgccaccgcccccatggtgtggctgccctacagcagcatcgaccagctgctgcaggccctgggcgagaacagcgccaacagccacaacatcgccctgagccagaagatcctggacaagctggaggactaccagcagaaggtggacaaggccaccagagacctgctgtacagaagaaccctgtag

SEQ ID NO: 91720 - DNA, 1452 bp, Artificial Sequence
  Description of Artificial Sequence: Synthetic coding sequence
atggtgagcgtggtggagctgaagcagagcagcgtgatgcagagactgctgaccggctggatgcccaccgccatcagaggcgaccagagccccagcgacagacccctgagcctggccgtgcactgcgtggagcacgacgccttcatcttcgccctgtgccaggaccacaagctgagaatgtggagctacaaggagcagatgtgcctgatggtggccgacatgctggagtacgtgcccgtgaagaaggacctgagactgaccgccggcaccggccacaagctgagactggcctacagccccaccatgggcctgtacctgggcatctacatgcacgcccccaagagaggccagagaagaggcttcgccatgctgcccggcctgaagctgctgagcagcagcagcccccccaccagcgccagccagtgcgccggcatcaccagcgtgaaccacagcacccagcccgagttcttcttctgcatcttccagctggtgagcaccgagagcaacagatacagcctggaccacatcagcagcctgttcaccagccaggagaccctgatcgacttcgccctgaccagcaccgacatctgggccctgtggcacgacgccgagaaccagaccgtggtgaagtacatcaacttcgagcacaacgtggccggccagtggaaccccgtgttcatgcagcccctgcccgaggaggagatcgtgatcagagacgaccaggaccccagagagatgtacctgcagagcctgttcacccccggccagttcaccaacgaggccctgtgcaaggccctgcagatcttctgcagaggcaccgagagaaacctggacctgagctggagcgagctgaagaaggaggtgaccctggccgtggagaacgagctgcagggcagcgtgaccgagtacgagttcagccaggaggagttcagaaacctgcagcaggagttctggtgcaagttctacgcctgctgcctgcagtaccaggaggccctgagccaccccctggccctgcacctgaacccccacaccaacatggtgtgcctgctgaagaagggctacctgagcttcctgatccccagcagcctggtggaccacctgtacctgctgccctacgagaacctgctgaccgaggacgagaccaccatcagcgacgacgtggacatcgccagagacgtgatctgcctgatcaagtgcctgagactgatcgaggagagcgtgaccgtggacatgagcgtgatcatggagatgagctgctacaacctgcagagccccgagaaggccgccgagcagatcctggaggacatgatcaccatcgacgtggagaacgtgatggaggacatctgcagcaagctgcaggagatcagaaaccccatccacgccatcggcctgctgatcagagagatggactacgagaccgaggtggagatggagaagggcttcaacccctag

SEQ ID NO: 91721 - DNA, 675 bp, Artificial Sequence
  Description of Artificial Sequence: Synthetic coding sequence
atgctgcacctgagcgccgccccccccgcccccccccccgaggtgaccgccaccgccagaccctgcctgtgcagcgtgggcagaagaggcgacggcggcaagatggccgccgccggcgccctggagagaagcttcgtggagctgagcggcgccgagagagagagacccagacacttcagagagttcaccgtgtgcagcatcggcaccgccaacgccgtggccggcgccgtgaagtacagcgagagcgccggcggcttctactacgtggagagcggcaagctgttcagcgtgaccagaaacagattcatccactggaagaccagcggcgacaccctggagctgatggaggagagcctggacatcaacctgctgaacaacgccatcagactgaagttccagaactgcagcgtgctgcccggcggcgtgtacgtgagcgagacccagaacagagtgatcatcctgatgctgaccaaccagaccgtgcacagactgctgctgccccaccccagcagaatgtacagaagcgtgagctggctgagcgccatcagcttcatcagccagatcaccctgggcgtgaccaacgtggtgctggagagatgcctgctggagctgaaggagatctggatcctggtgatcccccaccaggcctacttcgacagctacagactgaagtag

SEQ ID NO: 91722 - DNA, 6039 bp, Artificial Sequence
  Description of Artificial Sequence: Synthetic coding sequence
atggccacccccctggccgtgaacagcgccgccagcctgtggggcccctacaaggacatctggcacaaggtgggcaacgccctgtggagaagacagcccgaggccgtgcacctgctggacaagatcctgaagaagcacaagcccgacttcatcagcctgttcaagaacccccccaagaacgtgcagcagcacgagaaggtgcagaaggccagcaccgagggcgtggccatccagggccagcagggcaccagactgctgcccgagcagctgatcaaggaggccttcatcctgagcgacctgttcgacatcggcgagctggccgccgtggagctgctgctggccggcgagcaccagcagccccacttccccggcctgaccagaggcctggtggccgtgctgctgtactgggacggcaagagatgcatcgccaacagcctgaaggccctgatccagagcagaagaggcaagacctggaccctggagctgagccccgagctggccagcatgaccaccagattcaccgacgagctgatggagcagggcctgacctacaaggtgctgaccctggtgagccagatcgacgtgaacaacgagttcgagaagctgcagagagagagaggcctgggcagcgagaagcacagaaaggaggtgagcgacctgatcaaggagtgcagacagagcctggccgagagcctgttcgcctgggcctgccagagccccctgggcaaggaggacaccctgctgctgatcggccacctggagagagtgaccgtggaggccaacggcagcctggacgccgtgaacctggccctgctgatggccctgctgtactgcttcgacatcagcttcatcgagcagagcaccgaggagagagacgacatgatccaccagctgcccctgctgaccgagaagcagtacatcgccaccatccacagcagactgcaggacagccagctgtggaagctgcccggcctgcaggccaccgtgagactggcctgggccctggccctgagaggcatcagccagctgcccgacgtgaccgccctggccgagttcaccgaggccgacgaggccatggccgagctggccatcgccgacaacgtgttcctgttcctgatggagagcgtggtggtgagcgagtacttctaccaggaggagttctacatcagaagagtgcacaacctgatcaccgacttcctggccctgatgcccatgaaggtgaagcagctgagaaacagagccgacgaggacgccagaatgatccacatgagcatgcagatgggcaacgagccccccatcagcctgagaagagacctggagcacctgatgctgctgatcggcgagctgtacaagaagaaccccttccacctggagctggccctggagtactggtgccccaccgagcccctgcagacccccaccatcatgggcagctacctgggcgtggcccaccagagacccccccagagacaggtggtgctgagcaagttcgtgagacagatgggcgacctgctgccccccaccatctacatcccctacctgaagatgctgcagggcctggccaacggcccccagtgcgcccactactgcttcagcctgctgaaggtgaacggcagcagccacgtggagaacatccagggcgccggcggcagccccgtgagctgggagcacttcttccacagcctgatgctgtaccacgagcacctgagaaaggacctgcccagcgccgacagcgtgcagtacagacacctgcccagcagaggcatcacccagaaggagcaggacggcctgatcgccttcctgcagctgaccagcaccatcatcacctggagcgagaacgccagactggccctgtgcgagcacccccagtggacccccgtggtggtgatcctgggcctgctgcagtgcagcatcccccccgtgctgaaggccgagctgctgaagaccctggccgccttcggcaagagccccgagatcgccgccagcctgtggcagagcctggagtacacccagatcctgcagaccgtgagaatccccagccagagacaggccatcggcatcgaggtggagctgaacgagatcgagagcagatgcgaggagtaccccctgaccagagccttctgccagctgatcagcaccctggtggagagcagcttccccagcaacctgggcgccggcctgagaccccccggcttcgacccctacctgcagttcctgagagacagcgtgttcctgagattcagaaccagagcctacagaagagccgccgagaagtgggaggtggccgaggtggtgctggaggtgttctacaagctgctgagagactacgagccccagctggaggacttcgtggaccagttcgtggagctgcagggcgaggagatcatcgcctacaagccccccggcttcagcctgatgtaccacctgctgaacgagagccccatgctggagctggccctgagcctgctggaggagggcgtgaagcagctggacacctacgcccccttccccggcaagaagcacctggagaaggccgtgcagcactgcctggccctgctgaacctgaccctgcagaaggagaacctgttcatggacctgctgagagagagccagctggccctgatcgtgtgccccctggagcagctgctgcagggcatcaaccccagaaccaagaaggccgacaacgtggtgaacatcgccagatacctgtaccacggcaacaccaaccccgagctggccttcgagagcgccaagatcctgtgctgcatcagctgcaacagcaacatccagatcaagctggtgggcgacttcacccacgaccagagcatcagccagaagctgatggccggcttcgtggagtgcctggactgcgaggacgccgaggagttcgtgagactggaggagggcagcgagctggagaagaagctggtggccatcagacacgagaccagaatccacatcctgaacctgctgatcaccagcctggagtgcaacccccccaacctggccctgtacctgctgggcttcgagctgaagaagcccgtgagcaccaccaacctgcaggaccccggcgtgctgggctgccccagaacctgcctgcacgccatcctgaacatcctggagaagggcaccgagggcagaaccggccccgtggccgtgagagagagcccccagctggccgagctgtgctaccaggtgatctaccagctgtgcgcctgcagcgacaccagcggccccaccatgagatacctgagaaccagccaggacttcctgttcagccagctgcagtacctgcccttcagcaacaaggagtacgagatcagcatgctgaaccagatgagctggctgatgaagaccgccagcatcgagctgagagtgaccagcctgaacagacagagaagccacacccagagactgctgcacctgctgctggacgacatgcccgtgaagccctacagcgacggcgagggcggcatcgaggacgagaacagaagcgtgagcggcttcctgcacttcgacaccgccaccaaggtgagaagaaagatcctgaacatcctggacagcatcgacttcagccaggagatccccgagcccctgcagctggacttcttcgacagagcccagatcgagcaggtgatcgccaactgcgagcacaagaacctgagaggccagaccgtgtgcaacgtgaagctgctgcacagagtgctggtggccgaggtgaacgccctgcagggcatggccgccatcggccagagacccctgctgatggaggagatcagcaccgtgctgcagtacgtggtgggcagaaacaagctgctgcagtgcctgcacgccaagagacacgccctggagagctggagacagctggtggagatcatcctgaccgcctgcccccaggacctgatccaggccgaggacagacagctgatcatcagagacatcctgcaggacgtgcacgacaagatcctggacgacgaggccgcccaggagctgatgcccgtggtggccggcgccgtgttcaccctgaccgcccacctgagccaggccgtgctgaccgagcagaaggagaccagcgtgctgggccccgccgaggcccactacgccttcatgctggacagctgcttcaccagccccccccccgaggagaaccccctggtgggcttcgccagcatcggcgacagcagcctgtacatcatcctgaagaagctgctggacttcatcctgaagaccggcggcggcttccagagagtgagaacccacctgtacggcagcctgctgtactacctgcagatcgcccagagacccgacgagcccgacaccctggaggccgccaagaagaccatgtgggagagactgaccgcccccgaggacgtgttcagcaagctgcagagagagaacatcgccatcatcgagagctacggcgccgccctgatggaggtggtgtgcagagacgcctgcgacggccacgagatcggcagaatgctggccctggccctgctggacagaatcgtgagcgtggacaagcagcagcagtggctgctgtacctgagcaacagcggctacctgaaggtgctggtggacagcctggtggaggacgacagaaccctgcagagcctgctgaccccccagccccccctgctgaaggccctgtacacctacgagagcaagatggccttcctgaccagagtggccaagatccagcagggcgccctggagctgctgagaagcggcgtgatcgtgagactggcccagtgccaggtgtacgacatgagacccgagaccgacccccagagcatgttcggcatgagagacccccccatgttcatccccacccccgtggacagatacagacagatcctgctgcccgccctgcagctgtgccaggtgatcctgaccagcagcatggcccagcacctgcaggccgccggccaggtgctgcagttcctgatcagccacagcgacaccatccaggccatcctgagatgccaggacgtgagcgccggcagcctgcaggagctggccctgctgaccggcatcatcagcaaggccgccctgcccggcatcctgagcgagctggacgtggacgtgaacgagggcagcctgatggagctgcagggccacatcggcagattccagagacagtgcctgggcctgctgagcagattcggcggcagcgacagactgagacagttcaagttccaggacgacaacgtggagggcgacaaggtgagcaagaaggacgagatcgagctggccatgcagcagatctgcgccaacgtgatggagtactgccagagcctgatgctgcagagcagccccaccttccagcacgccgtgtgcctgttcacccccagcctgagcgagaccgtgaacagagacggccccagacaggacacccaggcccccgtggtgccctactggagactgcccggcctgggcatcatcatctacctgctgaagcagagcgccaacgacttcttcagctactacgacagccacagacagagcgtgagcaagctgcagaacgtggagcagctgccccccgacgagatcaaggagctgtgccagagcgtgatgcccgccggcgtggacaagatcagcaccgcccagaagtacgtgctggccagaagaagactggtgaaggtgatcaacaacagagccaagctgctgagcctgtgcagcttcatcatcgagacctgcctgttcatcctgtggagacacctggagtactacctgctgcactgcatgcccaccgacagccaggacagcctgttcgccagcagaaccctgttcaagagcagaagactgcaggacagcttcgccagcgagaccaacctggacttcagaagcggcctggccatcgtgagccagcacgacctggaccagctgcaggccgacgccatcaacgccttcggcgagagcctgcagaagaagctgctggacatcgagggcctgtacagcaaggtgagaagcagatacagcttcatccaggccctggtgagaagaatcagaggcctgctgagaatcagcagaaactag

SEQ ID NO: 91723 - DNA, 750 bp, Artificial Sequence
  Description of Artificial Sequence: Synthetic coding sequence
atgagcctgagaaactacagcgagagagaggtgagcgacctgatcaaggagtgcagacagagcctggccgagagcctgttcgcctgggcctgccagagccccctgggcaaggaggacaccctgctgctgatcggccacctggagagagtgaccgtggaggccaacggcagcctggacgccgtgaacctggccctgctgatggccctgctgtactgcttcgacatcagcttcatcgagcagagcaccgaggagagagacgacatgatccaccagctgcccctgctgaccgagaagcagtacatcgccaccatccacagcagactgcaggacagccagctgtggaagctgcccggcctgcaggccaccgtgagactggcctgggccctggccctgagaggcatcagccagctgcccgacgtgaccgccctggccgagttcaccgaggccgacgaggccatggccgagctggccatcgccgacaacgtgttcctgttcctgatggagagcgtggtggtgagcgagtacttctaccaggaggagttctacatcagaagagtgcacaacctgatcaccgacttcctggccctgatgcccatgaaggtgaagcagctgagaaacagagccgacgaggacgccagaatgatccacatgagcatgcagatgggcaacgagccccccatcagcctgagaagagacctggagcacctgatgctgctggtgagcaagctgctggtgctgagactgaactag

SEQ ID NO: 91724 - DNA, 5664 bp, Artificial Sequence
  Description of Artificial Sequence: Synthetic coding sequence
atggccgccagaggcagaggcctgctgctgctgaccctgagcgtgctgctggccgccggccccagcgccgccgccgccaagctgaacatccccaaggtgctgctgcccttcaccagagccaccagagtgaacttcaccctggaggccagcgagggctgctacagatggctgagcaccagacccgaggtggccagcatcgagcccctgggcctggacgagcagcagtgcagccagaaggccgtggtgcaggccagactgacccagcccgccagactgaccagcatcatcttcgccgaggacatcaccaccggccaggtgctgagatgcgacgccatcgtggacctgatccacgacatccagatcgtgagcaccaccagagagctgtacctggaggacagccccctggagctgaagatccaggccctggacagcgagggcaacaccttcagcaccctggccggcctggtgttcgagtggaccatcgtgaaggacagcgaggccgacagattcagcgacagccacaacgccctgagaatcctgaccttcctggagagcacctacatcccccccagctacatcagcgagatggagaaggccgccaagcagggcgacaccatcctggtgagcggcatgaagaccggcagcagcaagctgaaggccagaatccaggaggccgtgtacaagaacgtgagacccgccgaggtgagactgctgatcctggagaacatcctgctgaaccccgcctacgacgtgtacctgatggtgggcaccagcatccactacaaggtgcagaagatcagacagggcaagatcaccgagctgagcatgcccagcgaccagtacgagctgcagctgcagaacagcatccccggccccgagggcgaccccgccagacccgtggccgtgctggcccaggacaccagcatggtgaccgccctgcagctgggccagagcagcctggtgctgggccacagaagcatcagaatgcagggcgccagcagactgcccaacagcaccatctacgtggtggagcccggctacctgggcttcaccgtgcaccccggcgacagatgggtgctggagaccggcagactgtacgagatcaccatcgaggtgttcgacaagttcagcaacaaggtgtacgtgagcgacaacatcagaatcgagaccgtgctgcccgccgagttcttcgaggtgctgagcagcagccagaacggcagctaccacagaatcagagccctgaagagaggccagaccgccatcgacgccgccctgaccagcgtggtggaccaggacggcggcgtgcacatcctgcaggtgcccgtgtggaaccagcaggaggtggagatccacatccccatcaccctgtaccccagcatcctgaccttcccctggcagcccaagaccggcgcctaccagtacaccatcagagcccacggcggcagcggcaacttcagctggagcagcagcagccacctggtggccaccgtgaccgtgaagggcgtgatgaccaccggcagcgacatcggcttcagcgtgatccaggcccacgacgtgcagaaccccctgcacttcggcgagatgaaggtgtacgtgatcgagccccacagcatggagttcgccccctgccaggtggaggccagagtgggccaggccctggagctgcccctgagaatcagcggcctgatgcccggcggcgccagcgaggtggtgaccctgagcgactgcagccacttcgacctggccgtggaggtggagaaccagggcgtgttccagcccctgcccggcagactgccccccggcagcgagcactgcagcggcatcagagtgaaggccgaggcccagggcagcaccaccctgctggtgagctacagacacggccacgtgcacctgagcgccaagatcaccatcgccgcctacctgcccctgaaggccgtggaccccagcagcgtggccctggtgaccctgggcagcagcaaggagatgctgttcgagggcggccccagaccctggatcctggagcccagcaagttcttccagaacgtgaccgccgaggacaccgacagcatcggcctggccctgttcgccccccacagcagcagaaactaccagcagcactggatcctggtgacctgccaggccctgggcgagcaggtgatcgccctgagcgtgggcaacaagcccagcctgaccaaccccttccccgccgtggagcccgccgtggtgaagttcgtgtgcgccccccccagcagactgaccctggcccccgtgtacaccagcccccagctggacatgagctgccccctgctgcagcagaacaagcaggtggtgcccgtgagcagccacagaaaccccagactggacctggccgcctacgaccaggagggcagaagattcgacaacttcagcagcctgagcatccagtgggagagcaccagacccgtgctggccagcatcgagcccgagctgcccatgcagctggtgagccaggacgacgagagcggccagaagaagctgcacggcctgcaggccatcctggtgcacgaggccagcggcaccaccgccatcaccgccaccgccaccggctaccaggagagccacctgagcagcgccagaaccaagcagccccacgaccccctggtgcccctgagcgccagcatcgagctgatcctggtggaggacgtgagagtgagccccgaggaggtgaccatctacaaccaccccggcatccaggccgagctgagaatcagagagggcagcggctacttcttcctgaacaccagcaccgccgacgtggtgaaggtggcctaccaggaggccagaggcgtggccatggtgcaccccctgctgcccggcagcagcaccatcatgatccacgacctgtgcctggtgttccccgcccccgccaaggccgtggtgtacgtgagcgacatccaggagctgtacatcagagtggtggacaaggtggagatcggcaagaccgtgaaggcctacgtgagagtgctggacctgcacaagaagcccttcctggccaagtacttccccttcatggacctgaagctgagagccgccagccccatcatcaccctggtggccctggacgaggccctggacaactacaccatcaccttcctgatcagaggcgtggccatcggccagaccagcctgaccgccagcgtgaccaacaaggccggccagagaatcaacagcgccccccagcagatcgaggtgttcccccccttcagactgatgcccagaaaggtgaccctgctgatcggcgccaccatgcaggtgaccagcgagggcggcccccagccccagagcaacatcctgttcagcatcagcaacgagagcgtggccctggtgagcgccgccggcctggtgcagggcctggccatcggcaacggcaccgtgagcggcctggtgcaggccgtggacgccgagaccggcaaggtggtgatcatcagccaggacctggtgcaggtggaggtgctgctgctgagagccgtgagaatcagagcccccatcatgagaatgagaaccggcacccagatgcccatctacgtgaccggcatcaccaaccaccagaaccccttcagcttcggcaacgccgtgcccggcctgaccttccactggagcgtgaccaagagagacgtgctggacctgagaggcagacaccacgaggccagcatcagactgcccagccagtacaacttcgccatgaacgtgctgggcagagtgaagggcagaaccggcctgagagtggtggtgaaggccgtggaccccaccagcggccagctgtacggcctggccagagagctgagcgacgagatccaggtgcaggtgttcgagaagctgcagctgctgaaccccgagatcgaggccgagcagatcctgatgagccccaacagctacatcaagctgcagaccaacagagacggcgccgccagcctgagctacagagtgctggacggccccgagaaggtgcccgtggtgcacgtggacgagaagggcttcctggccagcggcagcatgatcggcaccagcaccatcgaggtgatcgcccaggagcccttcggcgccaaccagaccatcatcgtggccgtgaaggtgagccccgtgagctacctgagagtgagcatgagccccgtgctgcacacccagaacaaggaggccctggtggccgtgcccctgggcatgaccgtgaccttcaccgtgcacttccacgacaacagcggcgacgtgttccacgcccacagcagcgtgctgaacttcgccaccaacagagacgacttcgtgcagatcggcaagggccccaccaacaacacctgcgtggtgagaaccgtgagcgtgggcctgaccctgctgagagtgtgggacgccgagcaccccggcctgagcgacttcatgcccctgcccgtgctgcaggccatcagccccgagctgagcggcgccatggtggtgggcgacgtgctgtgcctggccaccgtgctgaccagcctggagggcctgagcggcacctggagcagcagcgccaacagcatcctgcacatcgaccccaagaccggcgtggccgtggccagagccgtgggcagcgtgaccgtgtactacgaggtggccggccacctgagaacctacaaggaggtggtggtgagcgtgccccagagaatcatggccagacacctgcaccccatccagaccagcttccaggaggccaccgccagcaaggtgatcgtggccgtgggcgacagaagcagcaacctgagaggcgagtgcacccccacccagagagaggtgatccaggccctgcaccccgagaccctgatcagctgccagagccagttcaagcccgccgtgttcgacttccccagccaggacgtgttcaccgtggagccccagttcgacaccgccctgggccagtacttctgcagcatcaccatgcacagactgaccgacaagcagagaaagcacctgagcatgaagaagaccgccctggtggtgagcgccagcctgagcagcagccacttcagcaccgagcaggtgggcgccgaggtgcccttcagccccggcctgttcgccgaccaggccgagatcctgctgagcaaccactacaccagcagcgagatcagagtgttcggcgcccccgaggtgctggagaacctggaggtgaagagcggcagccccgccgtgctggccttcgccaaggagaagagcttcggctggcccagcttcatcacctacaccgtgggcgtgctggaccccgccgccggcagccagggccccctgagcaccaccctgaccttcagcagccccgtgaccaaccaggccatcgccatccccgtgaccgtggccttcgtggtggacagaagaggccccggcccctacggcgccagcctgttccagcacttcctggacagctaccaggtgatgttcttcaccctgttcgccctgctggccggcaccgccgtgatgatcatcgcctaccacaccgtgtgcacccccagagacctggccgtgcccgccgccctgacccccagagccagccccggccacagcccccactacttcgccgccagcagccccaccagccccaacgccctgccccccgccagaaaggccagcccccccagcggcctgtggagccccgcctacgccagccactag

SEQ ID NO: 91725 - DNA, 6273 bp, Artificial Sequence
  Description of Artificial Sequence: Synthetic coding sequence
atgggcgacgagatggacgccatgatccccgagagagagatgaaggacttccagttcagagccctgaagaaggtgagaatcttcgacagccccgaggagctgcccaaggagagaagcagcctgctggccgtgagcaacaagtacggcctggtgttcgccggcggcgccagcggcctgcagatcttccccaccaagaacctgctgatccagaacaagcccggcgacgaccccaacaagatcgtggacaaggtgcagggcctgctggtgcccatgaagttccccatccaccacctggccctgagctgcgacaacctgaccctgagcgcctgcatgatgagcagcgagtacggcagcatcatcgccttcttcgacgtgagaaccttcagcaacgaggccaagcagcagaagagacccttcgcctaccacaagctgctgaaggacgccggcggcatggtgatcgacatgaagtggaaccccaccgtgcccagcatggtggccgtgtgcctggccgacggcagcatcgccgtgctgcaggtgaccgagaccgtgaaggtgtgcgccaccctgcccagcaccgtggccgtgaccagcgtgtgctggagccccaagggcaagcagctggccgtgggcaagcagaacggcaccgtggtgcagtacctgcccaccctgcaggagaagaaggtgatcccctgcccccccttctacgagagcgaccaccccgtgagagtgctggacgtgctgtggatcggcacctacgtgttcgccatcgtgtacgccgccgccgacggcaccctggagaccagccccgacgtggtgatggccctgctgcccaagaaggaggagaagcaccccgagatcttcgtgaacttcatggagccctgctacggcagctgcaccgagagacagcaccactactacctgagctacatcgaggagtgggacctggtgctggccgccagcgccgccagcaccgaggtgagcatcctggccagacagagcgaccagatcaactgggagagctggctgctggaggacagcagcagagccgagctgcccgtgaccgacaagagcgacgacagcctgcccatgggcgtggtggtggactacaccaaccaggtggagatcaccatcagcgacgagaagaccctgccccccgcccccgtgctgatgctgctgagcaccgacggcgtgctgtgccccttctacatgatcaaccagaaccccggcgtgaagagcctgatcaagacccccgagagactgagcctggagggcgagagacagcccaagagccccggcagcacccccaccacccccaccagcagccaggccccccagaagctggacgccagcgccgccgccgcccccgccagcctgccccccagcagccccgccgcccccatcgccaccttcagcctgctgcccgccggcggcgcccccaccgtgttcagcttcggcagcagcagcctgaagagcagcgccaccgtgaccggcgagccccccagctacagcagcggcagcgacagcagcaaggccgcccccggccccggccccagcaccttcagcttcgtgccccccagcaaggccagcctggcccccacccccgccgccagccccgtggcccccagcgccgccagcttcagcttcggcagcagcggcttcaagcccaccctggagagcacccccgtgcccagcgtgagcgcccccaacatcgccatgaagcccagcttcccccccagcaccagcgccgtgaaggtgaacctgagcgagaagttcaccgccgccgccaccagcacccccgtgagcagcagccagagcgccccccccatgagccccttcagcagcgccagcaagcccgccgccagcggccccctgagccaccccacccccctgagcgccccccccagcagcgtgcccctgaagagcagcgtgctgcccagccccagcggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccatgggcagcagcgtgccctacagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91726 - DNA, 6243 bp, Artificial Sequence
  Description of Artificial Sequence: Synthetic coding sequence
atgggcgacgagatggacgccatgatccccgagagagagatgaaggacttccagttcagagccctgaagaaggtgagaatcttcgacagccccgaggagctgcccaaggagagaagcagcctgctggccgtgagcaacaagtacggcctggtgttcgccggcggcgccagcggcctgcagatcttccccaccaagaacctgctgatccagaacaagcccggcgacgaccccaacaagatcgtggacaaggtgcagggcctgctggtgcccatgaagttccccatccaccacctggccctgagctgcgacaacctgaccctgagcgcctgcatgatgagcagcgagtacggcagcatcatcgccttcttcgacgtgagaaccttcagcaacgaggccaagcagcagaagagacccttcgcctaccacaagctgctgaaggacgccggcggcatggtgatcgacatgaagtggaaccccaccgtgcccagcatggtggccgtgtgcctggccgacggcagcatcgccgtgctgcaggtgaccgagaccgtgaaggtgtgcgccaccctgcccagcaccgtggccgtgaccagcgtgtgctggagccccaagggcaagcagctggccgtgggcaagcagaacggcaccgtggtgcagtacctgcccaccctgcaggagaagaaggtgatcccctgcccccccttctacgagagcgaccaccccgtgagagtgctggacgtgctgtggatcggcacctacgtgttcgccatcgtgtacgccgccgccgacggcaccctggagaccagccccgacgtggtgatggccctgctgcccaagaaggaggagaagcaccccgagatcttcgtgaacttcatggagccctgctacggcagctgcaccgagagacagcaccactactacctgagctacatcgaggagtgggacctggtgctggccgccagcgccgccagcaccgaggtgagcatcctggccagacagagcgaccagatcaactgggagagctggctgctggaggacagcagcagagccgagctgcccgtgaccgacaagagcgacgacagcctgcccatgggcgtggtggtggactacaccaaccaggtggagatcaccatcagcgacgagaagaccctgccccccgcccccgtgctgatgctgctgagcaccgacggcgtgctgtgccccttctacatgatcaaccagaaccccggcgtgaagagcctgatcaagacccccgagagactgagcctggagggcgagagacagcccaagagccccggcagcacccccaccacccccaccagcagccaggccccccagaagctggacgccagcgccgccgccgcccccgccagcctgccccccagcagccccgccgcccccatcgccaccttcagcctgctgcccgccggcggcgcccccaccgtgttcagcttcggcagcagcagcctgaagagcagcgccaccgtgaccggcgagccccccagctacagcagcggcagcgacagcagcaaggccgcccccggccccggccccagcaccttcagcttcgtgccccccagcaaggccagcctggcccccacccccgccgccagccccgtggcccccagcgccgccagcttcagcttcggcagcagcggcttcaagcccaccctggagagcacccccgtgcccagcgtgagcgcccccaacatcgccatgaagcccagcttcccccccagcaccagcgccgtgaaggtgaacctgagcgagaacagcagccagagcgccccccccatgagccccttcagcagcgccagcaagcccgccgccagcggccccctgagccaccccacccccctgagcgccccccccagcagcgtgcccctgaagagcagcgtgctgcccagccccagcgccggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccatgggcagcagcgtgccctacagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91727 - DNA, 4560 bp, Artificial Sequence
  Description of Artificial Sequence: Synthetic coding sequence
atgaagcccagcttcccccccagcaccagcgccgtgaaggtgaacctgagcgagaagttcaccgccgccgccaccagcacccccgtgagcagcagccagagcgccccccccatgagccccttcagcagcgccagcaagcccgccgccagcggccccctgagccaccccacccccctgagcgccccccccagcagcgtgcccctgaagagcagcgtgctgcccagccccagcggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccatgggcagcagcgtgccctacagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91728 - DNA, 6276 bp, Artificial Sequence
  Description of Artificial Sequence: Synthetic coding sequence
atgggcgacgagatggacgccatgatccccgagagagagatgaaggacttccagttcagagccctgaagaaggtgagaatcttcgacagccccgaggagctgcccaaggagagaagcagcctgctggccgtgagcaacaagtacggcctggtgttcgccggcggcgccagcggcctgcagatcttccccaccaagaacctgctgatccagaacaagcccggcgacgaccccaacaagatcgtggacaaggtgcagggcctgctggtgcccatgaagttccccatccaccacctggccctgagctgcgacaacctgaccctgagcgcctgcatgatgagcagcgagtacggcagcatcatcgccttcttcgacgtgagaaccttcagcaacgaggccaagcagcagaagagacccttcgcctaccacaagctgctgaaggacgccggcggcatggtgatcgacatgaagtggaaccccaccgtgcccagcatggtggccgtgtgcctggccgacggcagcatcgccgtgctgcaggtgaccgagaccgtgaaggtgtgcgccaccctgcccagcaccgtggccgtgaccagcgtgtgctggagccccaagggcaagcagctggccgtgggcaagcagaacggcaccgtggtgcagtacctgcccaccctgcaggagaagaaggtgatcccctgcccccccttctacgagagcgaccaccccgtgagagtgctggacgtgctgtggatcggcacctacgtgttcgccatcgtgtacgccgccgccgacggcaccctggagaccagccccgacgtggtgatggccctgctgcccaagaaggaggagaagcaccccgagatcttcgtgaacttcatggagccctgctacggcagctgcaccgagagacagcaccactactacctgagctacatcgaggagtgggacctggtgctggccgccagcgccgccagcaccgaggtgagcatcctggccagacagagcgaccagatcaactgggagagctggctgctggaggacagcagcagagccgagctgcccgtgaccgacaagagcgacgacagcctgcccatgggcgtggtggtggactacaccaaccaggtggagatcaccatcagcgacgagaagaccctgccccccgcccccgtgctgatgctgctgagcaccgacggcgtgctgtgccccttctacatgatcaaccagaaccccggcgtgaagagcctgatcaagacccccgagagactgagcctggagggcgagagacagcccaagagccccggcagcacccccaccacccccaccagcagccaggccccccagaagctggacgccagcgccgccgccgcccccgccagcctgccccccagcagccccgccgcccccatcgccaccttcagcctgctgcccgccggcggcgcccccaccgtgttcagcttcggcagcagcagcctgaagagcagcgccaccgtgaccggcgagccccccagctacagcagcggcagcgacagcagcaaggccgcccccggccccggccccagcaccttcagcttcgtgccccccagcaaggccagcctggcccccacccccgccgccagccccgtggcccccagcgccgccagcttcagcttcggcagcagcggcttcaagcccaccctggagagcacccccgtgcccagcgtgagcgcccccaacatcgccatgaagcccagcttcccccccagcaccagcgccgtgaaggtgaacctgagcgagaagttcaccgccgccgccaccagcacccccgtgagcagcagccagagcgccccccccatgagccccttcagcagcgccagcaagcccgccgccagcggccccctgagccaccccacccccctgagcgccccccccagcagcgtgcccctgaagagcagcgtgctgcccagccccagcgccggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccatgggcagcagcgtgccctacagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91729 - DNA, 237 bp, Artificial Sequence
  Description of Artificial Sequence: Synthetic coding sequence
ggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91730 - DNA, 5055 bp, Artificial Sequence
  Description of Artificial Sequence: Synthetic coding sequence
ggcgccgagggcagaaagttcgccgtggagagacccggcttcagaggccagggcagaggcagacagagatggctgctgagacacaccacccccaccagcagccaggccccccagaagctggacgccagcgccgccgccgcccccgccagcctgccccccagcagccccgccgcccccatcgccaccttcagcctgctgcccgccggcggcgcccccaccgtgttcagcttcggcagcagcagcctgaagagcagcgccaccgtgaccggcgagccccccagctacagcagcggcagcgacagcagcaaggccgcccccggccccggccccagcaccttcagcttcgtgccccccagcaaggccagcctggcccccacccccgccgccagccccgtggcccccagcgccgccagcttcagcttcggcagcagcggcttcaagcccaccctggagagcacccccgtgcccagcgtgagcgcccccaacatcgccatgaagcccagcttcccccccagcaccagcgccgtgaaggtgaacctgagcgagaagttcaccgccgccgccaccagcacccccgtgagcagcagccagagcgccccccccatgagccccttcagcagcgccagcaagcccgccgccagcggccccctgagccaccccacccccctgagcgccccccccagcagcgtgcccctgaagagcagcgtgctgcccagccccagcgccggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccatgggcagcagcgtgccctacagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcttcggcagcagcagcaacaccaccagcttcggcaccctggccagccagaacgcccccaccttcggcagcctgagccagcagaccagcggcttcggcacccagagcagcggcttcagcggcttcggcagcggcaccggcggcttcagcttcggcagcaacaacagcagcgtgcagggcttcggcggctggagaagctag

SEQ ID NO: 91731 - DNA, 6282 bp, Artificial Sequence
  Description of Artificial Sequence: Synthetic coding sequence
atgggcgacgagatggacgccatgatccccgagagagagatgaaggacttccagttcagagccctgaagaaggtgagaatcttcgacagccccgaggagctgcccaaggagagaagcagcctgctggccgtgagcaacaagtacggcctggtgttcgccggcggcgccagcggcctgcagatcttccccaccaagaacctgctgatccagaacaagcccggcgacgaccccaacaagatcgtggacaaggtgcagggcctgctggtgcccatgaagttccccatccaccacctggccctgagctgcgacaacctgaccctgagcgcctgcatgatgagcagcgagtacggcagcatcatcgccttcttcgacgtgagaaccttcagcaacgaggccaagcagcagaagagacccttcgcctaccacaagctgctgaaggacgccggcggcatggtgatcgacatgaagtggaaccccaccgtgcccagcatggtggccgtgtgcctggccgacggcagcatcgccgtgctgcaggtgaccgagaccgtgaaggtgtgcgccaccctgcccagcaccgtggccgtgaccagcgtgtgctggagccccaagggcaagcagctggccgtgggcaagcagaacggcaccgtggtgcagtacctgcccaccctgcaggagaagaaggtgatcccctgcccccccttctacgagagcgaccaccccgtgagagtgctggacgtgctgtggatcggcacctacgtgttcgccatcgtgtacgccgccgccgacggcaccctggagaccagccccgacgtggtgatggccctgctgcccaagaaggaggagaagcaccccgagatcttcgtgaacttcatggagccctgctacggcagctgcaccgagagacagcaccactactacctgagctacatcgaggagtgggacctggtgctggccgccagcgccgccagcaccgaggtgagcatcctggccagacagagcgaccagatcaactgggagagctggctgctggaggacagcagcagagccgagctgcccgtgaccgacaagagcgacgacagcctgcccatgggcgtggtggtggactacaccaaccaggtggagatcaccatcagcgacgagaagaccctgccccccgcccccgtgctgatgctgctgagcaccgacggcgtgctgtgccccttctacatgatcaaccagaaccccggcgtgaagagcctgatcaagacccccgagagactgagcctggagggcgagagacagcccaagagccccggcagcacccccaccacccccaccagcagccaggccccccagaagctggacgccagcgccgccgccgcccccgccagcctgccccccagcagccccgccgcccccatcgccaccttcagcctgctgcccgccggcggcgcccccaccgtgttcagcttcggcagcagcagcctgaagagcagcgccaccgtgaccggcgagccccccagctacagcagcggcagcgacagcagcaaggccgcccccggccccggccccagcaccttcagcttcgtgccccccagcaaggccagcctggcccccacccccgccgccagccccgtggcccccagcgccgccagcttcagcttcggcagcagcggcttcaagcccaccctggagagcacccccgtgcccagcgtgagcgcccccaacatcgccatgaagcccagcttcccccccagcaccagcgccgtgaaggtgaacctgagcgagaacagcagccagagcgccccccccatgagccccttcagcagcgccagcaagcccgccgccagcggccccctgagccaccccacccccctgagcgccccccccagcagcgtgcccctgaagagcagcgtgctgcccagccccagcggcagaagcgcccagggcagcagcagccccgtgcccagcatggtgcagaagagccccagaatcaccccccccgccgccaagcccggcagcccccaggccaagagcctgcagcccgccgtggccgagaagcagggccaccagtggaaggacagcgaccccgtgatggccggcatcggcgaggagatcgcccacttccagaaggagctggaggagctgaaggccagaaccagcaaggcctgcttccaggtgggcaccagcgaggagatgaagatgctgagaaccgagagcgacgacctgcacaccttcctgctggagatcaaggagaccaccgagagcctgcacggcgacatcagcagcctgaagaccaccctgctggagggcttcgccggcgtggaggaggccagagagcagaacgagagaaacagagacagcggctacctgcacctgctgtacaagagacccctggaccccaagagcgaggcccagctgcaggagatcagaagactgcaccagtacgtgaagttcgccgtgcaggacgtgaacgacgtgctggacctggagtgggaccagcacctggagcagaagaagaagcagagacacctgctggtgcccgagagagagaccctgttcaacaccctggccaacaacagagagatcatcaaccagcagagaaagagactgaaccacctggtggacagcctgcagcagctgagactgtacaagcagaccagcctgtggagcctgagcagcgccgtgcccagccagagcagcatccacagcttcgacagcgacctggagagcctgtgcaacgccctgctgaagaccaccatcgagagccacaccaagagcctgcccaaggtgcccgccaagctgagccccatgaagcaggcccagctgagaaacttcctggccaagagaaagaccccccccgtgagaagcaccgcccccgccagcctgagcagaagcgccttcctgagccagagatactacgaggacctggacgaggtgagcagcaccagcagcgtgagccagagcctggagagcgaggacgccagaaccagctgcaaggacgacgaggccgtggtgcaggcccccagacacgcccccgtggtgagaacccccagcatccagcccagcctgctgccccacgccgcccccttcgccaagagccacctggtgcacggcagcagccccggcgtgatgggcaccagcgtggccaccagcgccagcaagatcatcccccagggcgccgacagcaccatgctggccaccaagaccgtgaagcacggcgcccccagccccagccaccccatcagcgccccccaggccgccgccgccgccgccctgagaagacagatggccagccaggcccccgccgtgaacaccctgaccgagagcaccctgaagaacgtgccccaggtggtgaacgtgcaggagctgaagaacaaccccgccacccccagcaccgccaagaccccccaccccgtgctgacccccgtggccgccaaccaggccaagcagggcagcctgatcaacagcctgaagcccagcggccccacccccgccagcggccagctgagcagcggcgacaaggccagcggcaccgccaagatcgagaccgccgtgaccagcacccccagcgccagcggccagttcagcaagcccttcagcttcagccccagcggcaccggcttcaacttcggcatcatcacccccacccccagcagcaacttcaccgccgcccagggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaaccagctgaccaacaacaccgccaccgcccccagcgccacccccgtgttcggccaggtggccgccagcaccgcccccagcctgttcggccagcagaccggcagcaccgccagcaccgccgccgccaccccccaggtgagcagcagcggcttcagcagccccgccttcggcaccaccgcccccggcgtgttcggccagaccaccttcggccaggccagcgtgttcggccagagcgccagcagcgccgccagcgtgttcagcttcagccagcccggcttcagcagcgtgcccgccttcggccagcccgccagcagcacccccaccagcaccagcggcagcgtgttcggcgccgccagcagcaccagcagcagcagcagcttcagcttcggccagagcagccccaacaccggcggcggcctgttcggccagagcaacgcccccgccttcggccagagccccggcttcggccagggcggcagcgtgttcggcggcaccagcgccgccaccaccaccgccgccaccagcggcttcagcttctgccaggccagcggcttcggcagcagcaacaccggcagcgtgttcggccaggccgccagcaccggcggcatcgtgttcggccagcagagcagcagcagcagcggcagcgtgttcggcagcggcaacaccggcagaggcggcggcttcttcagcggcctgggcggcaagcccagccaggacgccgccaacaagaaccccttcagcagcgccagcggcggcttcggcagcaccgccaccagcaacaccagcaacctgttcggcaacagcggcgccaagaccttcggcggcttcgccagcagcagcttcggcgagcagaagcccaccggcaccttcagcagcggcggcggcagcgtggccagccagggcttcggcttcagcagccccaacaagaccggcggcttcggcgccgcccccgtgttcggcagcccccccaccttcggcggcagccccggcttcggcggcgtgcccgccttcggcagcgcccccgccttcaccagccccctgggcagcaccggcggcaaggtgttcggcgagggcaccgccgccgccagcgccggcggcttcggcagcctggccatgagcctgagccccaccctgaagggcagactgctgctgatgagacccaaggccggcggcggcagagagcaggccgcccccggcagaaagagcaacgagagcagaagcctgggccacctgtgcatggagagagccctgaccagccccctgaaggtgtgggagcagcagcagcaccacatcctgagacacgccagagagagcgagtgcccccacttcagaatcaccgtgcccaccgacttctggttctgggaccccgagtag

SEQ ID NO: 91732 - DNA, 1308 bp, Artificial Sequence
  Description of Artificial Sequence: Synthetic coding sequence
atgaagagcagcctgctgctgagaggcgtgcacttctgcttccacctgcccggcgccacccccagcaccaaggagagcagccagcccgacgccttcagcagcggcggcggcagcaagcccagctacgaggccatccccgagagcagcccccccagcggcatcaccagcgccagcaacaccacccccggcgagcccgccgccagcagcagcagacccgtggcccccagcggcaccgccctgagcaccaccagcagcaagctggagaccccccccagcaagctgggcgagctgctgttccccagcagcctggccggcgagaccctgggcagcttcagcggcctgagagtgggccaggccgacgacagcaccaagcccaccaacaaggccagcagcaccagcctgaccagcacccagcccaccaagaccagcggcgtgcccagcggcttcaacttcaccgccccccccgtgctgggcaagcacaccgagccccccgtgaccagcagcgccaccaccaccagcgtggccccccccgccgccaccagcaccagcagcaccgccgtgttcggcagcctgcccgtgaccagcgccggcagcagcggcgtgatcagcttcggcggcaccagcctgagcgccggcaagaccagcttcagcttcggcagccagcagaccaacagcaccgtgccccccagcgcccccccccccaccaccgccgccacccccctgcccaccagcttccccaccctgagcttcggcagcctgctgagcagcgccaccacccccagcctgcccatgagcgccggcagaagcaccgaggaggccaccagcagcgccctgcccgagaagcccggcgacagcgaggtgagcgccagcgccgccagcctgctggaggagcagcagagcgcccagctgccccaggcccccccccagaccagcgacagcgtgaagaaggagcccgtgctggcccagcccgccgtgagcaacagcggcaccgccgccagcagcaccagcctggtggccctgagcgccgaggccacccccgccaccaccggcgtgcccgacgccagaaccgaggccgtgccccccgccagcagcttcagcgtgcccggccagaccgccgtgaccgccgccgccatcagcagcgccggccccgtggccgtggagaccagcagcacccccatcgccagcagcaccaccagcatcgtggcccccggccccagcgccgaggccgccgccttcggcaccgtgaccagcggcagcagcgtgttcgcccagccccccgccgccagcagcagcagcgccttcaactag

SEQ ID NO: 91733 - DNA, 981 bp, Artificial Sequence
  Description of Artificial Sequence: Synthetic coding sequence
atggccgccttcgccgtggagccccagggccccgccctgggcagcgagcccatgatgctgggcagccccaccagccccaagcccggcgtgaacgcccagttcctgcccggcttcctgatgggcgacctgcccgcccccgtgaccccccagcccagaagcatcagcggccccagcgtgggcgtgatggagatgagaagccccctgctggccggcggcagccccccccagcccgtggtgcccgcccacaaggacaagagcggcgccccccccgtgagaagcatctacgacgacatcagcagccccggcctgggcagcacccccctgaccagcagaagacagcccaacatcagcgtgatgcagagccccctggtgggcgtgaccagcacccccggcaccggccagagcatgttcagccccgccagcatcggccagcccagaaagaccaccctgagccccgcccagctggaccccttctacacccagggcgacagcctgaccagcgaggaccacctggacgacagctgggtgaccgtgttcggcttcccccaggccagcgccagctacatcctgctgcagttcgcccagtacggcaacatcctgaagcacgtgatgagcaacaccggcaactggatgcacatcagataccagagcaagctgcaggccagaaaggccctgagcaaggacggcagaatcttcggcgagagcatcatgatcggcgtgaagccctgcatcgacaagagcgtgatggagagcagcgacagatgcgccctgagcagccccagcctggccttcaccccccccatcaagaccctgggcacccccacccagcccggcagcacccccagaatcagcaccatgagacccctggccaccgcctacaaggccagcaccagcgactaccaggtgatcagcgacagacagacccccaagaaggacgagagcctggtgagcaaggccatggagtacatgttcggctggtag

SEQ ID NO: 91734 - DNA, 930 bp, Artificial Sequence
  Description of Artificial Sequence: Synthetic coding sequence
atgatgctgggcagccccaccagccccaagcccggcgtgaacgcccagttcctgcccggcttcctgatgggcgacctgcccgcccccgtgaccccccagcccagaagcatcagcggccccagcgtgggcgtgatggagatgagaagccccctgctggccggcggcagccccccccagcccgtggtgcccgcccacaaggacaagagcggcgccccccccgtgagaagcatctacgacgacatcagcagccccggcctgggcagcacccccctgaccagcagaagacagcccaacatcagcgtgatgcagagccccctggtgggcgtgaccagcacccccggcaccggccagagcatgttcagccccgccagcatcggccagcccagaaagaccaccctgagccccgcccagctggaccccttctacacccagggcgacagcctgaccagcgaggaccacctggacgacagctgggtgaccgtgttcggcttcccccaggccagcgccagctacatcctgctgcagttcgcccagtacggcaacatcctgaagcacgtgatgagcaacaccggcaactggatgcacatcagataccagagcaagctgcaggccagaaaggccctgagcaaggacggcagaatcttcggcgagagcatcatgatcggcgtgaagccctgcatcgacaagagcgtgatggagagcagcgacagatgcgccctgagcagccccagcctggccttcaccccccccatcaagaccctgggcacccccacccagcccggcagcacccccagaatcagcaccatgagacccctggccaccgcctacaaggccagcaccagcgactaccaggtgatcagcgacagacagacccccaagaaggacgagagcctggtgagcaaggccatggagtacatgttcggctggtag

SEQ ID NO: 91735 - DNA, 576 bp, Artificial Sequence
  Description of Artificial Sequence: Synthetic coding sequence
atgttcagccccgccagcatcggccagcccagaaagaccaccctgagccccgcccagctggaccccttctacacccagggcgacagcctgaccagcgaggaccacctggacgacagctgggtgaccgtgttcggcttcccccaggccagcgccagctacatcctgctgcagttcgcccagtacggcaacatcctgaagcacgtgatgagcaacaccggcaactggatgcacatcagataccagagcaagctgcaggccagaaaggccctgagcaaggacggcagaatcttcggcgagagcatcatgatcggcgtgaagccctgcatcgacaagagcgtgatggagagcagcgacagatgcgccctgagcagccccagcctggccttcaccccccccatcaagaccctgggcacccccacccagcccggcagcacccccagaatcagcaccatgagacccctggccaccgcctacaaggccagcaccagcgactaccaggtgatcagcgacagacagacccccaagaaggacgagagcctggtgagcaaggccatggagtacatgttcggctggtag

SEQ ID NO: 91736 - DNA, 981 bp, Artificial Sequence
  Description of Artificial Sequence: Synthetic coding sequence
atgaagcaggacgccagcagaaacgccgcctacaccgtggactgcgaggactacgtgcacgtggtggagttcaaccccttcgagaacggcgacagcggcaacctgatcgcctacggcggcaacaactacgtggtgatcggcacctgcaccttccaggaggaggaggccgacgtggagggcatccagtacaagaccctgagaaccttccaccacggcgtgagagtggacggcatcgcctggagccccgagaccagactggacagcctgccccccgtgatcaagttctgcaccagcgccgccgacatgaagatcagactgttcaccagcgacctgcaggacaagaacgagtacaaggtgctggagggccacaccgacttcatcaacggcctggtgttcgaccccaaggagggccaggagatcgccagcgtgagcgacgaccacacctgcagaatctggaacctggagggcgtgcagaccgcccacttcgtgctgcacagccccggcatgagcgtgtgctggcaccccgaggagaccttcaagctgatggtggccgagaagaacggcaccatcagattctacgacctgctggcccagcaggccatcctgagcctggagagcgagcaggtgcccctgatgagcgcccactggtgcctgaagaacaccttcaaggtgggcgccgtggccggcaacgactggctgatctgggacatcaccagaagcagctacccccagaacaagagacccgtgcacatggacagagcctgcctgttcagatggagcaccatcagcgagaacctgttcgccaccaccggctaccccggcaagatggccagccagttccagatccaccacctgggccacccccagcccatcctgatgggcagcgtggccgtgggcagcggcctgagctggcacagaaccctgcccctgtgcgtgatcggcggcgaccacaagctgctgttctgggtgaccgaggtgtag

SEQ ID NO: 91737 - DNA, 156 bp, Artificial Sequence
  Description of Artificial Sequence: Synthetic coding sequence
atgaagcaggacgccagcagaaacgccgcctacaccgtggactgcgaggactacgtgcacgtggtggagttcaaccccttcgagaacggcgacagcggcaacctgatcgcctacggcggcaacaactacgtggtgatcggcacctgcaccttctag

SEQ ID NO: 91738 - DNA, 981 bp, Artificial Sequence; identical to SEQ ID NO: 91736
  Description of Artificial Sequence: Synthetic coding sequence

SEQ ID NO: 91739 - DNA, 1143 bp, Artificial Sequence
  Description of Artificial Sequence: Synthetic coding sequence
atggaggagatctacgccaagttcgtgagccagaagatcagcaagaccagatggagacccctgccccccggcagcctgcagaccgccgagaccttcgccaccggcagctgggacaacgaggagaactacatcagcctgtggagcatcggcgacttcggcaacctggacagcgacggcggcttcgagggcgaccaccagctgctgtgcgacatcagacaccacggcgacgtgatggacctgcagttcttcgaccaggagagaatcgtggccgccagcagcaccggctgcgtgaccgtgttcctgcaccaccccaacaaccagaccctgagcgtgaaccagcagtggaccaccgcccactaccacaccggccccggcagccccagctacagcagcgccccctgcaccggcgtggtgtgcaacaaccccgagatcgtgaccgtgggcgaggacggcagaatcaacctgttcagagccgaccacaaggaggccgtgagaaccatcgacaacgccgacagcagcaccctgcacgccgtgaccttcctgagaacccccgagatcctgaccgtgaacagcatcggccagctgaagatctgggacttcagacagcagggcaacgagcccagccagatcctgagcctgaccggcgacagagtgcccctgcactgcgtggacagacaccccaaccagcagcacgtggtggccaccggcggccaggacggcatgctgagcatctgggacgtgagacagggcaccatgcccgtgagcctgctgaaggcccacgaggccgagatgtgggaggtgcacttccaccccagcaaccccgagcacctgttcacctgcagcgaggacggcagcctgtggcactgggacgccagcaccgacgtgcccgagaagagcagcctgttccaccagggcggcagaagcagcaccttcctgagccacagcatcagcaaccaggccaacgtgcaccagagcgtgatcagcagctggctgagcaccgaccccgccaaggacagaatcgagatcaccagcctgctgcccagcagaagcctgagcgtgaacaccctggacgtgctgggcccctgcctggtgtgcggcaccgacgccgaggccatctacgtgaccagacacctgttcagctag

SEQ ID NO: 91740 - DNA, 747 bp, Artificial Sequence
  Description of Artificial Sequence: Synthetic coding sequence
atgggcggccccctgagcctgggcaccgactgcgcccacaccggctacagaagagagctgaccctgtgcagccacagactgagacccaaggtgcccagcaaccagggcagcgccggcagaggcggcgccgagagaagagtgctgtgcctgctgttcgccgtgcccgccgccgccgccttcggcatggaggagatctacgccaagttcgtgagccagaagatcagcaagaccagatggagacccctgccccccggcagcctgcagaccgccgagaccttcgccaccggcagctgggacaacgaggagaactacatcagcctgtggagcatcggcgacttcggcaacctggacagcgacggcggcttcgagggcgaccaccagctgctgtgcgacatcagacaccacggcgacgtgatggacctgcagttcttcgaccaggagagaatcgtggccgccagcagcaccggctgcgtgaccgtgttcctgcaccaccccaacaaccagaccctgagcgtgaaccagcagtggaccaccgcccactaccacaccggccccggcagccccagctacagcagcgccccctgcaccggcgtggtgtgcaacaaccccgagatcgtgaccgtgggcgaggacggcagaatcaacctgttcagagccgaccacaaggaggccgtgagaaccatcggcctggtgaccgagtgccacagcaccgtgctgatcgacatccccaccaacagcatgctgtag

SEQ ID NO: 91741 - DNA, 1143 bp, Artificial Sequence; identical to SEQ ID NO: 91739
  Description of Artificial Sequence: Synthetic coding sequence

SEQ ID NO: 91742 - DNA, 1407 bp, Artificial Sequence
  Description of Artificial Sequence: Synthetic coding sequence
atggccaagagaaacgccgagaaggagctgaccgacagaaactgggaccaggaggacgaggccgaggaggtgggcaccttcagcatggccagcgaggaggtgctgaagaacagagccatcaagaaggccaagagaagaaacgtgggcttcgagagcgacaccggcggcgccttcaagggcttcaagggcctggtggtgcccagcggcggcggcagattcagcggcttcggcagcggcgccggcggcaagcccctggagggcctgagcaacggcaacaacatcaccagcgccccccccttcgccagcgccaaggccgccgccgaccccaaggtggccttcggcagcctggccgccaacggccccaccaccctggtggacaaggtgagcaaccccaagaccaacggcgacagccagcagcccagcagcagcggcctggccagcagcaaggcctgcgtgggcaacgcctaccacaagcagctggccgccctgaactgcagcgtgagagactggatcgtgaagcacgtgaacaccaaccccctgtgcgacctgacccccatcttcaaggactacgagaagtacctggccaacatcgagcagcagcacggcaacagcggcagaaacagcgagagcgagagcaacaaggtggccgccgagacccagagccccagcctgttcggcagcaccaagctgcagcaggagagcaccttcctgttccacggcaacaagaccgaggacacccccgacaagaagatggaggtggccagcgagaagaagaccgaccccagcagcctgggcgccaccagcgccagcttcaacttcggcaagaaggtggacagcagcgtgctgggcagcctgagcagcgtgcccctgaccggcttcagcttcagccccggcaacagcagcctgttcggcaaggacaccacccagagcaagcccgtgagcagccccttccccaccaagcccctggagggccaggccgagggcgacagcggcgagtgcaagggcggcgacgaggaggagaacgacgagccccccaaggtggtggtgaccgaggtgaaggaggaggacgccttctacagcaagaagtgcaagctgttctacaagaaggacaacgagttcaaggagaagggcatcggcaccctgcacctgaagcccaccgccaaccagaagacccagctgctggtgagagccgacaccaacctgggcaacatcctgctgaacgtgctgatcccccccaacatgccctgcaccagaaccggcaagaacaacgtgctgatcgtgtgcgtgcccaacccccccatcgacgagaagaacgccaccatgcccgtgaccatgctgatcagagtgaagaccagcgaggacgccgacgagctgcacaagatcctgctggagaagaaggacgcctag

SEQ ID NO: 91743 - DNA, 1323 bp, Artificial Sequence
  Description of Artificial Sequence: Synthetic coding sequence
atggccagcgaggaggtgctgaagaacagagccatcaagaaggccaagagaagaaacgtgggcttcgagagcgacaccggcggcgccttcaagggcttcaagggcctggtggtgcccagcggcggcggcagattcagcggcttcggcagcggcgccggcggcaagcccctggagggcctgagcaacggcaacaacatcaccagcgccccccccttcgccagcgccaaggccgccgccgaccccaaggtggccttcggcagcctggccgccaacggccccaccaccctggtggacaaggtgagcaaccccaagaccaacggcgacagccagcagcccagcagcagcggcctggccagcagcaaggcctgcgtgggcaacgcctaccacaagcagctggccgccctgaactgcagcgtgagagactggatcgtgaagcacgtgaacaccaaccccctgtgcgacctgacccccatcttcaaggactacgagaagtacctggccaacatcgagcagcagcacggcaacagcggcagaaacagcgagagcgagagcaacaaggtggccgccgagacccagagccccagcctgttcggcagcaccaagctgcagcaggagagcaccttcctgttccacggcaacaagaccgaggacacccccgacaagaagatggaggtggccagcgagaagaagaccgaccccagcagcctgggcgccaccagcgccagcttcaacttcggcaagaaggtggacagcagcgtgctgggcagcctgagcagcgtgcccctgaccggcttcagcttcagccccggcaacagcagcctgttcggcaaggacaccacccagagcaagcccgtgagcagccccttccccaccaagcccctggagggccaggccgagggcgacagcggcgagtgcaagggcggcgacgaggaggagaacgacgagccccccaaggtggtggtgaccgaggtgaaggaggaggacgccttctacagcaagaagtgcaagctgttctacaagaaggacaacgagttcaaggagaagggcatcggcaccctgcacctgaagcccaccgccaaccagaagacccagctgctggtgagagccgacaccaacctgggcaacatcctgctgaacgtgctgatcccccccaacatgccctgcaccagaaccggcaagaacaacgtgctgatcgtgtgcgtgcccaacccccccatcgacgagaagaacgccaccatgcccgtgaccatgctgatcagagtgaagaccagcgaggacgccgacgagctgcacaagatcctgctggagaagaaggacgcctag

SEQ ID NO: 91744 - DNA, 1323 bp, Artificial Sequence; identical to SEQ ID NO: 91743
  Description of Artificial Sequence: Synthetic coding sequence

SEQ ID NO: 91745 - DNA, 27 bp, Artificial Sequence
  Description of Artificial Sequence: Synthetic coding sequence
atggccagcgaggaggtgctgaagtag

SEQ ID NO: 91746 - DNA, 537 bp, Artificial Sequence
  Description of Artificial Sequence: Synthetic coding sequence
atggccaagagaaacgccgagaaggagctgaccgacagaaactgggaccaggaggacgaggccgaggaggtgggcaccttcagcatggccagcgaggaggtgctgaagaacagagccatcaagaaggccaagagaagaaacgtgggcttcgagagcgacaccggcggcgccttcaagggcttcaagggcctggtggtgcccagcggcggcggcagattcagcggcttcggcagcggcgccggcggcaagcccctggagggcctgagcaacggcaacaacatcaccagcgccccccccttcgccagcgccaaggccgccgccgaccccaaggtggccttcggcggcgacgaggaggagaacgacgagccccccaaggtggtggtgaccgaggtgaaggaggaggacgccttctacagcaagaagtgcaagctgttctacaagaaggacaacgagttcaaggagaagggcatcggcaccctgcacctgaagcccaccgccaaccagaagacccagctgctggtgagagccgacacctag

SEQ ID NO: 91747 - DNA, 138 bp, Artificial Sequence
  Description of Artificial Sequence: Synthetic coding sequence
atggccaagagaaacgccgagaaggagctgaccgacagaaactgggaccaggaggacgaggccgaggaggtgggcaccttcagcatggccagcgaggaggtgctgaagaacagagccatcaagaaggccaagagatag

SEQ ID NO: 91748 - DNA, 657 bp, Artificial Sequence
  Description of Artificial Sequence: Synthetic coding sequence
atggaggtggccagcgagaagaagaccgaccccagcagcctgggcgccaccagcgccagcttcaacttcggcaagaaggtggacagcagcgtgctgggcagcctgagcagcgtgcccctgaccggcttcagcttcagccccggcaacagcagcctgttcggcaaggacaccacccagagcaagcccgtgagcagccccttccccaccaagcccctggagggccaggccgagggcgacagcggcgagtgcaagggcggcgacgaggaggagaacgacgagccccccaaggtggtggtgaccgaggtgaaggaggaggacgccttctacagcaagaagtgcaagctgttctacaagaaggacaacgagttcaaggagaagggcatcggcaccctgcacctgaagcccaccgccaaccagaagacccagctgctggtgagagccgacaccaacctgggcaacatcctgctgaacgtgctgatcccccccaacatgccctgcaccagaaccggcaagaacaacgtgctgatcgtgtgcgtgcccaacccccccatcgacgagaagaacgccaccatgcccgtgaccatgctgatcagagtgaagaccagcgaggacgccgacgagctgcacaagatcctgctggagaagaaggacgcctag

SEQ ID NO: 91749 - DNA, 231 bp, Artificial Sequence
  Description of Artificial Sequence: Synthetic coding sequence
atggccaagagaaacgccgagaaggagctgaccgacagaaactgggaccaggaggacgaggccgaggaggtgggcaccttcagcatggccagcgaggaggtgctgaagaacagagccatcaagaaggccaagagaagaaacgtgggcttcgaggtgctgctgctgcagatggccctgcccccctggctgatcaagttccagatccccaagctgatgggcaccgtgagctag

SEQ ID NO: 91750 - DNA, 15 bp, Artificial Sequence
  Description of Artificial Sequence: Synthetic coding sequence
atggccaagagatag

SEQ ID NO: 91751 - DNA, 33 bp, Artificial Sequence
  Description of Artificial Sequence: Synthetic coding sequence
atggccaagagaaacgccgagaaggagctgtag

SEQ ID NO: 91752 - DNA, 1524 bp, Artificial Sequence
  Description of Artificial Sequence: Synthetic coding sequence
atggccttcaacttcggcgcccccagcggcaccagcggcaccgccgccgccaccgccgcccccgccggcggcttcggcggcttcggcaccaccagcaccaccgccggcagcgccttcagcttcagcgcccccaccaacaccggcaccaccggcctgttcggcggcacccagaacaagggcttcggcttcggcaccggcttcggcaccaccaccggcaccagcaccggcctgggcaccggcctgggcaccggcctgggcttcggcggcttcaacacccagcagcagcagcagaccaccctgggcggcctgttcagccagcccacccaggcccccacccagagcaaccagctgatcaacaccgccagcgccctgagcgcccccaccctgctgggcgacgagagagacgccatcctggccaagtggaaccagctgcaggccttctggggcaccggcaagggctacttcaacaacaacatcccccccgtggagttcacccaggagaaccccttctgcagattcaaggccgtgggctacagctgcatgcccagcaacaaggacgaggacggcctggtggtgctggtgttcaacaagaaggagaccgagatcagaagccagcagcagcagctggtggagagcctgcacaaggtgctgggcggcaaccagaccctgaccgtgaacgtggagggcaccaagaccctgcccgacgaccagaccgaggtggtgatctacgtggtggagagaagccccaacggcaccagcagaagagtgcccgccaccaccctgtacgcccacttcgagcaggccaacatcaagacccagctgcagcagctgggcgtgaccctgagcatgaccagaaccgagctgagccccgcccagatcaagcagctgctgcagaacccccccgccggcgtggaccccatcatctgggagcaggccaaggtggacaaccccgacagcgagaagctgatccccgtgcccatggtgggcttcaaggagctgctgagaagactgaaggtgcaggaccagatgaccaagcagcaccagaccagactggacatcatcagcgaggacatcagcgagctgcagaagaaccagaccaccagcgtggccaagatcgcccagtacaagagaaagctgatggacctgagccacagaaccctgcaggtgctgatcaagcaggagatccagagaaagagcggctacgccatccaggccgacgaggagcagctgagagtgcagctggacaccatccagggcgagctgaacgcccccacccagttcaagggcagactgaacgagctgatgagccagatcagaatgcagaaccacttcggcgccgtgagaagcgaggagagatactacatcgacgccgacctgctgagagagatcaagcagcacctgaagcagcagcaggagggcctgagccacctgatcagcatcatcaaggacgacctggaggacatcaagctggtggagcacggcctgaacgagaccatccacatcagaggcggcgtgttcagctag

SEQ ID NO: 91753 - DNA, 876 bp, Artificial Sequence
  Description of Artificial Sequence: Synthetic coding sequence
atgcccagcaacaaggacgaggacggcctggtggtgctggtgttcaacaagaaggagaccgagatcagaagccagcagcagcagctggtggagagcctgcacaaggtgctgggcggcaaccagaccctgaccgtgaacgtggagggcaccaagaccctgcccgacgaccagaccgaggtggtgatctacgtggtggagagaagccccaacggcaccagcagaagagtgcccgccaccaccctgtacgcccacttcgagcaggccaacatcaagacccagctgcagcagctgggcgtgaccctgagcatgaccagaaccgagctgagccccgcccagatcaagcagctgctgcagaacccccccgccggcgtggaccccatcatctgggagcaggccaaggtggacaaccccgacagcgagaagctgatccccgtgcccatggtgggcttcaaggagctgctgagaagactgaaggtgcaggaccagatgaccaagcagcaccagaccagactggacgtgctgatcaagcaggagatccagagaaagagcggctacgccatccaggccgacgaggagcagctgagagtgcagctggacaccatccagggcgagctgaacgcccccacccagttcaagggcagactgaacgagctgatgagccagatcagaatgcagaaccacttcggcgccgtgagaagcgaggagagatactacatcgacgccgacctgctgagagagatcaagcagcacctgaagcagcagcaggagggcctgagccacctgatcagcatcatcaaggacgacctggaggacatcaagctggtggagcacggcctgaacgagaccatccacatcagaggcggcgtgttcagctag

SEQ ID NO: 91754 - DNA, 984 bp, Artificial Sequence
  Description of Artificial Sequence: Synthetic coding sequence
atgcccagcaacaaggacgaggacggcctggtggtgctggtgttcaacaagaaggagaccgagatcagaagccagcagcagcagctggtggagagcctgcacaaggtgctgggcggcaaccagaccctgaccgtgaacgtggagggcaccaagaccctgcccgacgaccagaccgaggtggtgatctacgtggtggagagaagccccaacggcaccagcagaagagtgcccgccaccaccctgtacgcccacttcgagcaggccaacatcaagacccagctgcagcagctgggcgtgaccctgagcatgaccagaaccgagctgagccccgcccagatcaagcagctgctgcagaacccccccgccggcgtggaccccatcatctgggagcaggccaaggtggacaaccccgacagcgagaagctgatccccgtgcccatggtgggcttcaaggagctgctgagaagactgaaggtgcaggaccagatgaccaagcagcaccagaccagactggacatcatcagcgaggacatcagcgagctgcagaagaaccagaccaccagcgtggccaagatcgcccagtacaagagaaagctgatggacctgagccacagaaccctgcaggtgctgatcaagcaggagatccagagaaagagcggctacgccatccaggccgacgaggagcagctgagagtgcagctggacaccatccagggcgagctgaacgcccccacccagttcaagggcagactgaacgagctgatgagccagatcagaatgcagaaccacttcggcgccgtgagaagcgaggagagatactacatcgacgccgacctgctgagagagatcaagcagcacctgaagcagcagcaggagggcctgagccacctgatcagcatcatcaaggacgacctggaggacatcaagctggtggagcacggcctgaacgagaccatccacatcagaggcggcgtgttcagctag

SEQ ID NO: 91755 - DNA, 1380 bp, Artificial Sequence
  Description of Artificial Sequence: Synthetic coding sequence
atggccttcaacttcggcgcccccagcggcaccagcggcaccgccgccgccaccgccgcccccgccggcggcttcggcggcttcggcaccaccagcaccaccgccggcagcgccttcagcttcagcgcccccaccaacaccggcaccaccgccctgggcggcctgttcagccagcccacccaggcccccacccagagcaaccagctgatcaacaccgccagcgccctgagcgcccccaccctgctgggcgacgagagagacgccatcctggccaagtggaaccagctgcaggccttctggggcaccggcaagggctacttcaacaacaacatcccccccgtggagttcacccaggagaaccccttctgcagattcaaggccgtgggctacagctgcatgcccagcaacaaggacgaggacggcctggtggtgctggtgttcaacaagaaggagaccgagatcagaagccagcagcagcagctggtggagagcctgcacaaggtgctgggcggcaaccagaccctgaccgtgaacgtggagggcaccaagaccctgcccgacgaccagaccgaggtggtgatctacgtggtggagagaagccccaacggcaccagcagaagagtgcccgccaccaccctgtacgcccacttcgagcaggccaacatcaagacccagctgcagcagctgggcgtgaccctgagcatgaccagaaccgagctgagccccgcccagatcaagcagctgctgcagaacccccccgccggcgtggaccccatcatctgggagcaggccaaggtggacaaccccgacagcgagaagctgatccccgtgcccatggtgggcttcaaggagctgctgagaagactgaaggtgcaggaccagatgaccaagcagcaccagaccagactggacatcatcagcgaggacatcagcgagctgcagaagaaccagaccaccagcgtggccaagatcgcccagtacaagagaaagctgatggacctgagccacagaaccctgcaggtgctgatcaagcaggagatccagagaaagagcggctacgccatccaggccgacgaggagcagctgagagtgcagctggacaccatccagggcgagctgaacgcccccacccagttcaagggcagactgaacgagctgatgagccagatcagaatgcagaaccacttcggcgccgtgagaagcgaggagagatactacatcgacgccgacctgctgagagagatcaagcagcacctgaagcagcagcaggagggcctgagccacctgatcagcatcatcaaggacgacctggaggacatcaagctggtggagcacggcctgaacgagaccatccacatcagaggcggcgtgttcagctag

SEQ ID NO: 91756 - DNA, 582 bp, Artificial Sequence
  Description of Artificial Sequence: Synthetic coding sequence
atgagcggcttcaacttcggcggcaccggcgcccccaccggcggcttcaccttcggcaccgccaagaccgccaccaccacccccgccaccggcttcagcttcagcaccagcggcaccggcggcttcaacttcggcgcccccttccagcccgccaccagcacccccagcaccggcctgttcagcctggccacccagacccccgccacccagaccaccggcttcaccttcggcaccgccaccctggccagcggcggcaccggcttcagcctgggcatcggcgccagcaagctgaacctgagcaacaccgccgccacccccgccatggccaaccccagcggcttcggcctgggcagcagcaacctgaccaacgccatcagcagcaccgtgaccagcagccagggcaccgcccccaccggcttcgtgttcggccccagcaccaccagcgtggcccccgccaccaccagcggcggcttcagcttcaccggcggcagcaccgcccagcccagcggcttcaacatcggcagcgccggcaacagcgcccagcccaccgcccccgccaccctgcccttcacccccgcctag

SEQ ID NO: 91757 - DNA, 1569 bp, Artificial Sequence
  Description of Artificial Sequence: Synthetic coding sequence
atgagcggcttcaacttcggcggcaccggcgcccccaccggcggcttcaccttcggcaccgccaagaccgccaccaccacccccgccaccggcttcagcttcagcaccagcggcaccggcggcttcaacttcggcgcccccttccagcccgccaccagcacccccagcaccggcctgttcagcctggccacccagacccccgccacccagaccaccggcttcaccttcggcaccgccaccctggccagcggcggcaccggcttcagcctgggcatcggcgccagcaagctgaacctgagcaacaccgccgccacccccgccatggccaaccccagcggcttcggcctgggcagcagcaacctgaccaacgccatcagcagcaccgtgaccagcagccagggcaccgcccccaccggcttcgtgttcggccccagcaccaccagcgtggcccccgccaccaccagcggcggcttcagcttcaccggcggcagcaccgcccagcccagcggcttcaacatcggcagcgccggcaacagcgcccagcccaccgcccccgccaccctgcccttcacccccgccacccccgccgccaccaccgccggcgccacccagcccgccgcccccacccccaccgccaccatcaccagcaccggccccagcctgttcgccagcatcgccaccgcccccaccagcagcgccaccaccggcctgagcctgtgcacccccgtgaccaccgccggcgcccccaccgccggcacccagggcttcagcctgaaggcccccggcgccgccagcggcaccagcaccaccaccagcaccgccgccaccgccaccgccaccaccaccagcagcagcagcaccaccggcttcgccctgaacctgaagcccctggcccccgccggcatccccagcaacaccgccgccgccgtgaccgccccccccggccccggcgccgccgccggcgccgccgccagcagcgccatgacctacgcccagctggagagcctgatcaacaagtggagcctggagctggaggaccaggagagacacttcctgcagcaggccacccaggtgaacgcctgggacagaaccctgatcgagaacggcgagaagatcaccagcctgcacagagaggtggagaaggtgaagctggaccagaagagactggaccaggagctggacttcatcctgagccagcagaaggagctggaggacctgctgagccccctggaggagctggtgaaggagcagagcggcaccatctacctgcagcacgccgacgaggagagagagaagacctacaagctggccgagaacatcgacgcccagctgaagagaatggcccaggacctgaaggacatcatcgagcacctgaacaccagcggcgcccccgccgacaccagcgaccccctgcagcagatctgcaagatcctgaacgcccacatggacagcctgcagtggatcgaccagaacagcgccctgctgcagagaaaggtggaggaggtgaccaaggtgtgcgagggcagaagaaaggagcaggagagaagcttcagaatcaccttcgactag

SEQ ID NO: 91758 - DNA, 1569 bp, Artificial Sequence; identical to SEQ ID NO: 91757
  Description of Artificial Sequence: Synthetic coding sequence

SEQ ID NO: 91759 - DNA, 1569 bp, Artificial Sequence; identical to SEQ ID NO: 91757
  Description of Artificial Sequence: Synthetic coding sequence

SEQ ID NO: 91760 - DNA, 1971 bp, Artificial Sequence
  Description of Artificial Sequence: Synthetic coding sequence
atggaggagctggacggcgagcccaccgtgaccctgatccccggcgtgaacagcaagaagaaccagatgtacttcgactggggccccggcgagatgctggtgtgcgagaccagcttcaacaagaaggagaagagcgagatggtgcccagctgccccttcatctacatcatcagaaaggacgtggacgtgtacagccagatcctgagaaagctgttcaacgagagccacggcatcttcctgggcctgcagagaatcgacgaggagctgaccggcaagagcagaaagagccagctggtgagagtgagcaagaactacagaagcgtgatcagagcctgcatggaggagatgcaccaggtggccatcgccgccaaggaccccgccaacggcagacagttcagcagccaggtgagcatcctgagcgccatggagctgatctggaacctgtgcgagatcctgttcatcgaggtggcccccgccggccccctgctgctgcacctgctggactgggtgagactgcacgtgtgcgaggtggacagcctgagcgccgacgtgctgggcagcgagaaccccagcaagcacgacagcttctggaacctggtgaccatcctggtgctgcagggcagactggacgaggccagacagatgctgagcaaggaggccgacgccagccccgccagcgccggcatctgcagaatcatgggcgacctgatgagaaccatgcccatcctgagccccggcaacacccagaccctgaccgagctggagctgaagtggcagcactggcacgaggagtgcgagagatacctgcaggacagcaccttcgccaccagcccccacctggagagcctgctgaagatcatgctgggcgacgaggccgccctgctggagcagaaggagctgctgagcaactggtaccacttcctggtgaccagactgctgtacagcaaccccaccgtgaagcccatcgacctgcactactacgcccagagcagcctggacctgttcctgggcggcgagagcagccccgagcccctggacaacatcctgctggccgccttcgagttcgacatccaccaggtgatcaaggagtgcagcatcgccctgagcaactggtggttcgtggcccacctgaccgacctgctggaccactgcaagctgctgcagagccacaacctgtacttcggcagcaacatgagagagttcctgctgctggagtacgccagcggcctgttcgcccaccccagcctgtggcagctgggcgtggactacttcgactactgccccgagctgggcagagtgagcctggagctgcacatcgagagaatccccctgaacaccgagcagaaggccctgaaggtgctgagaatctgcgagcagagacagatgaccgagcaggtgagaagcatctgcaagatcctggccatgaaggccgtgagaaacaacagactgggcagcgccctgagctggagcatcagagccaaggacgccgccttcgccaccctggtgagcgacagattcctgagagactactgcgagagaggctgcttcagcgacctggacctgatcgacaacctgggccccgccatgatgctgagcgacagactgaccttcctgggcaagtacagagagttccacagaatgtacggcgagaagagattcgccgacgccgccagcctgctgctgagcctgatgaccagcagaatcgcccccagaagcttctggatgaccctgctgaccgacgccctgcccctgctggagcagaagcaggtgatcttcagcgccgagcagacctacgagctgatgagatgcctggaggacctgaccagcagaagacccgtgcacggcgagagcgacaccgagcagctgcaggacgacgacatcgagaccaccaaggtggagatgctgagactgagcctggccagaaacctggccagagccatcatcagagagggcagcctggagggcagctag

SEQ ID NO: 91761 - DNA, 1389 bp, Artificial Sequence
  Description of Artificial Sequence: Synthetic coding sequence
atggccgccagcagcgccgccagaagccccttctgccagcagtggagcagcagcggcacctgcgtgagattcttcctgctgaagtggccccaggtgaccatcctggtgctgcagggcagactggacgaggccagacagatgctgagcaaggaggccgacgccagccccgccagcgccggcatctgcagaatcatgggcgacctgatgagaaccatgcccatcctgagccccggcaacacccagaccctgaccgagctggagctgaagtggcagcactggcacgaggagtgcgagagatacctgcaggacagcaccttcgccaccagcccccacctggagagcctgctgaagatcatgctgggcgacgaggccgccctgctggagcagaaggagctgctgagcaactggtaccacttcctggtgaccagactgctgtacagcaaccccaccgtgaagcccatcgacctgcactactacgcccagagcagcctggacctgttcctgggcggcgagagcagccccgagcccctggacaacatcctgctggccgccttcgagttcgacatccaccaggtgatcaaggagtgcagcatcgccctgagcaactggtggttcgtggcccacctgaccgacctgctggaccactgcaagctgctgcagagccacaacctgtacttcggcagcaacatgagagagttcctgctgctggagtacgccagcggcctgttcgcccaccccagcctgtggcagctgggcgtggactacttcgactactgccccgagctgggcagagtgagcctggagctgcacatcgagagaatccccctgaacaccgagcagaaggccctgaaggtgctgagaatctgcgagcagagacagatgaccgagcaggtgagaagcatctgcaagatcctggccatgaaggccgtgagaaacaacagactgggcagcgccctgagctggagcatcagagccaaggacgccgccttcgccaccctggtgagcgacagattcctgagagactactgcgagagaggctgcttcagcgacctggacctgatcgacaacctgggccccgccatgatgctgagcgacagactgaccttcctgggcaagtacagagagttccacagaatgtacggcgagaagagattcgccgacgccgccagcctgctgctgagcctgatgaccagcagaatcgcccccagaagcttctggatgaccctgctgaccgacgccctgcccctgctggagcagaagcaggtgaaggtggccgccgccgtggtgttcttcgcctgccagagcctgctggagctgagctgcatcgccgtggccgacgtgagagtgagcagcttcgtggtgctgcccgtgagagtgtacagcccctag

SEQ ID NO: 91762 - DNA, 975 bp, Artificial Sequence
  Description of Artificial Sequence: Synthetic coding sequence
atggtgcccagctgccccttcatctacatcatcagaaaggacgtggacgtgtacagccagatcctgagaaagctgttcaacgagagccacggcatcttcctgggcctgcagagaatcgacgaggagctgaccggcaagagcagaaagagccagctggtgagagtgagcaagaactacagaagcgtgatcagagcctgcatggaggagatgcaccaggtggccatcgccgccaaggaccccgccaacggcagacagttcagcagccaggtgagcatcctgagcgccatggagctgatctggaacctgtgcgagatcctgttcatcgaggtggcccccgccggccccctgctgctgcacctgctggactgggtgagactgcacgtgtgcgaggtggacagcctgagcgccgacgtgctgggcagcgagaaccccagcaagcacgacagcttctggaacctggtgaccatcctggtgctgcagggcagactggacgaggccagacagatgctgagcaaggaggccgacgccagccccgccagcgccggcatctgcagaatcatgggcgacctgatgagaaccatgcccatcctgagccccggcaacacccagaccctgaccgagctggagctgaagtggcagcactggcacgaggagtgcgagagatacctgcaggacagcaccttcgccaccagcccccacctggagagcctgctgaagatcatgctgggcgacgaggccgccctgctggagcagaaggagctgctgagcaactggtaccacttcctggtgaccagactgctgtacagcaaccccaccgtgaagcccatcgacctgcactactacgcccagagcagcctggacctgttcctgggcggcgagagcagccccgagcccctggacaacatcctgctggccgccttcgagttcgacatccaccaggtgatcaaggagtgcagagacgtgcacctgaagtag

SEQ ID NO: 91763 - DNA, 780 bp, Artificial Sequence
  Description of Artificial Sequence: Synthetic coding sequence
atgagagagttcctgctgctggagtacgccagcggcctgttcgcccaccccagcctgtggcagctgggcgtggactacttcgactactgccccgagctgggcagagtgagcctggagctgcacatcgagagaatccccctgaacaccgagcagaaggccctgaaggtgctgagaatctgcgagcagagacagatgaccgagcaggtgagaagcatctgcaagatcctggccatgaaggccgtgagaaacaacagactgggcagcgccctgagctggagcatcagagccaaggacgccgccttcgccaccctggtgagcgacagattcctgagagactactgcgagagaggctgcttcagcgacctggacctgatcgacaacctgggccccgccatgatgctgagcgacagactgaccttcctgggcaagtacagagagttccacagaatgtacggcgagaagagattcgccgacgccgccagcctgctgctgagcctgatgaccagcagaatcgcccccagaagcttctggatgaccctgctgaccgacgccctgcccctgctggagcagaagcaggtgatcttcagcgccgagcagacctacgagctgatgagatgcctggaggacctgaccagcagaagacccgtgcacggcgagagcgacaccgagcagctgcaggacgacgacatcgagaccaccaaggtggagatgctgagactgagcctggccagaaacctggccagagccatcatcagagagggcagcctggagggcagctag

SEQ ID NO: 91764 - DNA, 1833 bp, Artificial Sequence
  Description of Artificial Sequence: Synthetic coding sequence
atggtgcccagctgccccttcatctacatcatcagaaaggacgtggacgtgtacagccagatcctgagaaagctgttcaacgagagccacggcatcttcctgggcctgcagagaatcgacgaggagctgaccggcaagagcagaaagagccagctggtgagagtgagcaagaactacagaagcgtgatcagagcctgcatggaggagatgcaccaggtggccatcgccgccaaggaccccgccaacggcagacagttcagcagccaggtgagcatcctgagcgccatggagctgatctggaacctgtgcgagatcctgttcatcgaggtggcccccgccggccccctgctgctgcacctgctggactgggtgagactgcacgtgtgcgaggtggacagcctgagcgccgacgtgctgggcagcgagaaccccagcaagcacgacagcttctggaacctggtgaccatcctggtgctgcagggcagactggacgaggccagacagatgctgagcaaggaggccgacgccagccccgccagcgccggcatctgcagaatcatgggcgacctgatgagaaccatgcccatcctgagccccggcaacacccagaccctgaccgagctggagctgaagtggcagcactggcacgaggagtgcgagagatacctgcaggacagcaccttcgccaccagcccccacctggagagcctgctgaagatcatgctgggcgacgaggccgccctgctggagcagaaggagctgctgagcaactggtaccacttcctggtgaccagactgctgtacagcaaccccaccgtgaagcccatcgacctgcactactacgcccagagcagcctggacctgttcctgggcggcgagagcagccccgagcccctggacaacatcctgctggccgccttcgagttcgacatccaccaggtgatcaaggagtgcagcatcgccctgagcaactggtggttcgtggcccacctgaccgacctgctggaccactgcaagctgctgcagagccacaacctgtacttcggcagcaacatgagagagttcctgctgctggagtacgccagcggcctgttcgcccaccccagcctgtggcagctgggcgtggactacttcgactactgccccgagctgggcagagtgagcctggagctgcacatcgagagaatccccctgaacaccgagcagaaggccctgaaggtgctgagaatctgcgagcagagacagatgaccgagcaggtgagaagcatctgcaagatcctggccatgaaggccgtgagaaacaacagactgggcagcgccctgagctggagcatcagagccaaggacgccgccttcgccaccctggtgagcgacagattcctgagagactactgcgagagaggctgcttcagcgacctggacctgatcgacaacctgggccccgccatgatgctgagcgacagactgaccttcctgggcaagtacagagagttccacagaatgtacggcgagaagagattcgccgacgccgccagcctgctgctgagcctgatgaccagcagaatcgcccccagaagcttctggatgaccctgctgaccgacgccctgcccctgctggagcagaagcaggtgatcttcagcgccgagcagacctacgagctgatgagatgcctggaggacctgaccagcagaagacccgtgcacggcgagagcgacaccgagcagctgcaggacgacgacatcgagaccaccaaggtggagatgctgagactgagcctggccagaaacctggccagagccatcatcagagagggcagcctggagggcagctag

SEQ ID NO: 91765 - DNA, 846 bp, Artificial Sequence
  Description of Artificial Sequence: Synthetic coding sequence
atgaagctggccgccatgatcaagaagatgtgccccagcgacagcgagctgagcatccccgccaagaactgctacagaatggtgatcctgggcagcagcaaggtgggcaagaccgccatcgtgagcagattcctgaccggcagattcgaggacgcctacacccccaccatcgaggacttccacagaaagttctacagcatcagaggcgaggtgtaccagctggacatcctggacaccagcggcaaccaccccttccccgccatgagaagactgagcatcctgaccggcgacgtgttcatcctggtgttcagcctggacaacagagacagcttcgaggaggtgcagagactgagacagcagatcctggacaccaagagctgcctgaagaacaagaccaaggagaacgtggacgtgcccctggtgatctgcggcaacaagggcgacagagacttctacagagaggtggaccagagagagatcgagcagctggtgggcgacgacccccagagatgcgcctacttcgagatcagcgccaagaagaacagcagcctggaccagatgttcagagccctgttcgccatggccaagctgcccagcgagatgagccccgacctgcacagaaaggtgagcgtgcagtactgcgacgtgctgcacaagaaggccctgagaaacaagaagctgctgagagccggcagcggcggcggcggcggcgaccccggcgacgccttcggcatcgtggcccccttcgccagaagacccagcgtgcacagcgacctgatgtacatcagagagaaggccagcgccggcagccaggccaaggacaaggagagatgcgtgatcagctag

SEQ ID NO: 91766 - DNA, 1881 bp, Artificial Sequence
  Description of Artificial Sequence: Synthetic coding sequence
atggtgctggagctgcccaagagatggggcaagaacagcgagttcgagggcggcaagagcaccgtgaactgcagcaccacccccgtggccgagagattcttcaccagcagcaccagcctgaccctgaagcacgccgcctggtaccccagcgagatcctggacccccacgtggtgctgctgaccagcgacaacgtgatcagaatctacagcctgagagagccccagacccccaccaacgtgatcatcctgagcgaggccgaggaggagagcctggtgctgaacaagggcagagcctacaccgccagcctgggcgagaccgccgtggccttcgacttcggccccctggccgccgtgcccaagaccctgttcggccagaacggcaaggacgaggtggtggcctaccccctgtacatcctgtacgagaacggcgagaccttcctgacctacatcagcctgctgcacagccccggcaacatcggcaagctgctgggccccctgcccatgcaccccgccgccgaggacaactacggctacgacgcctgcgccgtgctgtgcctgccctgcgtgcccaacatcctggtgatcgccaccgagagcggcatgctgtaccactgcgtggtgctggagggcgaggaggaggacgaccacaccagcgagaagagctgggacagcagaatcgacctgatccccagcctgtacgtgttcgagtgcgtggagctggagctggccctgaagctggccagcggcgaggacgaccccttcgacagcgacttcagctgccccgtgaagctgcacagagaccccaagtgccccagcagataccactgcacccacgaggccggcgtgcacagcgtgggcctgacctggatccacaagctgcacaagttcctgggcagcgacgaggaggacaaggacagcctgcaggagctgagcaccgagcagaagtgcttcgtggagcacatcctgtgcaccaagcccctgccctgcagacagcccgcccccatcagaggcttctggatcgtgcccgacatcctgggccccaccatgatctgcatcaccagcacctacgagtgcctgatctggcccctgctgagcaccgtgcaccccgccagcccccccctgctgtgcaccagagaggacgtggaggtggccgagagccccctgagagtgctggccgagacccccgacagcttcgagaagcacatcagaagcatcctgcagagaagcgtggccaaccccgccttcctgaactgcttcacccagctgagaaagatcaaggtggagaccctgttcctgagagccagcgagaaggacatcgcccccccccccgaggagtgcctgcagctgctgagcagagccacccaggtgttcagagagcagtacatcctgaagcaggacctggccaaggaggagatccagagaagagtgaagctgctgtgcgaccagaagaagaagcagctggaggacctgagctactgcagagaggagagaaagagcctgagagagatggccgagagactggccgacaagtacgaggaggccaaggagaagcaggaggacatcatgaacagaatgaagaagctgctgcacagcttccacagcgagctgcccgtgctgagcgacagcgagagagacatgaagaaggagctgcagctgatccccgaccagctgagacacctgggcaacgccatcaagcaggtgaccatgaagaaggactaccagcagcagaagatggagaaggtgctgagcctgcccaagcccaccatcatcctgagcgcctaccagagaaagtgcatccagagcatcctgaaggaggagggcgagcacatcagagagatggtgaagcagatcaacgacatcagaaaccacgtgaacttctag

SEQ ID NO: 91767 - DNA, 2226 bp, Artificial Sequence; identical to SEQ ID NO: 77359
  Description of Artificial Sequence: Synthetic coding sequence

SEQ ID NO: 91768 - DNA, 2460 bp, Artificial Sequence
  Description of Artificial Sequence: Synthetic coding sequence
atggacaccgagggcttcggcgagctgctgcagcaggccgagcagctggccgccgagaccgagggcatcagcgagctgccccacgtggagagaaacctgcaggagatccagcaggccggcgagagactgagaagcagaaccctgaccagaaccagccaggagaccgccgacgtgaaggccagcgtgctgctgggcagcagaggcctggacatcagccacatcagccagagactggagagcctgagcgccgccaccaccttcgagcccctggagcccgtgaaggacaccgacatccagggcttcctgaagaacgagaaggacaacgccctgctgagcgccatcgaggagagcagaaagagaaccttcggcatggccgaggagtaccacagagagagcatgctggtggagtgggagcaggtgaagcagagaatcctgcacaccctgctggccagcggcgaggacgccctggacttcacccaggagagcgagcccagctacatcagcgacgtgggcccccccggcagaagcagcctggacaacatcgagatggcctacgccagacagatctacatctacaacgagaagatcgtgaacggccacctgcagcccaacctggtggacctgtgcgccagcgtggccgagctggacgacaagagcatcagcgacatgtggaccatggtgaagcagatgaccgacgtgctgctgacccccgccaccgacgccctgaagaacagaagcagcgtggaggtgagaatggagttcgtgagacaggccctggcctacctggagcagagctacaagaactacaccctggtgaccgtgttcggcaacctgcaccaggcccagctgggcggcgtgcccggcacctaccagctggtgagaagcttcctgaacatcaagctgcccgcccccctgcccggcctgcaggacggcgaggtggagggccaccccgtgtgggccctgatctactactgcatgagatgcggcgacctgctggccgccagccaggtggtgaacagagcccagcaccagctgggcgagttcaagacctggttccaggagtacatgaacagcaaggacagaagactgagccccgccaccgagaacaagctgagactgcactacagaagagccctgagaaacaacaccgacccctacaagagagccgtgtactgcatcatcggcagatgcgacgtgaccgacaaccagagcgaggtggccgacaagaccgaggactacctgtggctgaagctgaaccaggtgtgcttcgacgacgacggcaccagcagcccccaggacagactgaccctgagccagttccagaagcagctgctggaggactacggcgagagccacttcaccgtgaaccagcagcccttcctgtacttccaggtgctgttcctgaccgcccagttcgaggccgccgtggccttcctgttcagaatggagagactgagatgccacgccgtgcacgtggccctggtgctgttcgagctgaagctgctgctgaagagcagcggccagagcgcccagctgctgagccacgagcccggcgaccccccctgcctgagaagactgaacttcgtgagactgctgatgctgtacaccagaaagttcgagagcaccgaccccagagaggccctgcagtacttctacttcctgagagacgagaaggacagccagggcgagaacatgttcctgagatgcgtgagcgagctggtgatcgagagcagagagttcgacatgatcctgggcaagctggagaacgacggcagcagaaagcccggcgtgatcgacaagttcaccagcgacaccaagcccatcatcaacaaggtggccagcgtggccgagaacaagggcctgttcgaggaggccgccaagctgtacgacctggccaagaacgccgacaaggtgctggagctgatgaacaagctgctgagccccgtggtgccccagatcagcgccccccagagcaacaaggagagactgaagaacatggccctgagcatcgccgagagatacagagcccagggcatcagcgccaacaagttcgtggacagcaccttctacctgctgctggacctgatcaccttcttcgacgagtaccacagcggccacatcgacagagccttcgacatcatcgagagactgaagctggtgcccctgaaccaggagagcgtggaggagagagtggccgccttcagaaacttcagcgacgagatcagacacaacctgagcgaggtgctgctggccaccatgaacatcctgttcacccagttcaagagactgaagggcaccagccccagcagcagcagcagaccccagagagtgatcgaggacagagacagccagctgagaagccaggccagaaccctgatcaccttcgccggcatgatcccctacagaaccagcggcgacaccaacgccagactggtgcagatggaggtgctgatgaactag

SEQ ID NO: 91769 - DNA, 2091 bp, Artificial Sequence
  Description of Artificial Sequence: Synthetic coding sequence
atggccgaggagtaccacagagagagcatgctggtggagtgggagcaggtgaagcagagaatcctgcacaccctgctggccagcggcgaggacgccctggacttcacccaggagagcgagcccagctacatcagcgacgtgggcccccccggcagaagcagcctggacaacatcgagatggcctacgccagacagatctacatctacaacgagaagatcgtgaacggccacctgcagcccaacctggtggacctgtgcgccagcgtggccgagctggacgacaagagcatcagcgacatgtggaccatggtgaagcagatgaccgacgtgctgctgacccccgccaccgacgccctgaagaacagaagcagcgtggaggtgagaatggagttcgtgagacaggccctggcctacctggagcagagctacaagaactacaccctggtgaccgtgttcggcaacctgcaccaggcccagctgggcggcgtgcccggcacctaccagctggtgagaagcttcctgaacatcaagctgcccgcccccctgcccggcctgcaggacggcgaggtggagggccaccccgtgtgggccctgatctactactgcatgagatgcggcgacctgctggccgccagccaggtggtgaacagagcccagcaccagctgggcgagttcaagacctggttccaggagtacatgaacagcaaggacagaagactgagccccgccaccgagaacaagctgagactgcactacagaagagccctgagaaacaacaccgacccctacaagagagccgtgtactgcatcatcggcagatgcgacgtgaccgacaaccagagcgaggtggccgacaagaccgaggactacctgtggctgaagctgaaccaggtgtgcttcgacgacgacggcaccagcagcccccaggacagactgaccctgagccagttccagaagcagctgctggaggactacggcgagagccacttcaccgtgaaccagcagcccttcctgtacttccaggtgctgttcctgaccgcccagttcgaggccgccgtggccttcctgttcagaatggagagactgagatgccacgccgtgcacgtggccctggtgctgttcgagctgaagctgctgctgaagagcagcggccagagcgcccagctgctgagccacgagcccggcgaccccccctgcctgagaagactgaacttcgtgagactgctgatgctgtacaccagaaagttcgagagcaccgaccccagagaggccctgcagtacttctacttcctgagagacgagaaggacagccagggcgagaacatgttcctgagatgcgtgagcgagctggtgatcgagagcagagagttcgacatgatcctgggcaagctggagaacgacggcagcagaaagcccggcgtgatcgacaagttcaccagcgacaccaagcccatcatcaacaaggtggccagcgtggccgagaacaagggcctgttcgaggaggccgccaagctgtacgacctggccaagaacgccgacaaggtgctggagctgatgaacaagctgctgagccccgtggtgccccagatcagcgccccccagagcaacaaggagagactgaagaacatggccctgagcatcgccgagagatacagagcccagggcatcagcgccaacaagttcgtggacagcaccttctacctgctgctggacctgatcaccttcttcgacgagtaccacagcggccacatcgacagagccttcgacatcatcgagagactgaagctggtgcccctgaaccaggagagcgtggaggagagagtggccgccttcagaaacttcagcgacgagatcagacacaacctgagcgaggtgctgctggccaccatgaacatcctgttcacccagttcaagagactgaagggcaccagccccagcagcagcagcagaccccagagagtgatcgaggacagagacagccagctgagaagccaggccagaaccctgatcaccttcgccggcatgatcccctacagaaccagcggcgacaccaacgccagactggtgcagatggaggtgctgatgaactag

SEQ ID NO: 91770 - DNA, 2091 bp, Artificial Sequence; identical to SEQ ID NO: 91769
  Description of Artificial Sequence: Synthetic coding sequence

SEQ ID NO: 91771 - DNA, 5403 bp, Artificial Sequence
  Description of Artificial Sequence: Synthetic coding sequence
atgttcaacaagagcttcggcacccccttcggcggcggcaccggcggcttcggcaccaccagcaccttcggccagaacaccggcttcggcaccaccagcggcggcgccttcggcaccagcgccttcggcagcagcaacaacaccggcggcctgttcggcaacagccagaccaagcccggcggcctgttcggcaccagcagcttcagccagcccgccaccagcaccagcaccggcttcggcttcggcaccagcaccggcaccgccaacaccctgttcggcaccgccagcaccggcaccagcctgttcagcagccagaacaacgccttcgcccagaacaagcccaccggcttcggcaacttcggcaccagcaccagcagcggcggcctgttcggcaccaccaacaccaccagcaaccccttcggcagcaccagcggcagcctgttcggccccagcagcttcaccgccgcccccaccggcaccaccatcaagttcaacccccccaccggcaccgacaccatggtgaaggccggcgtgagcaccaacatcagcaccaagcaccagtgcatcaccgccatgaaggagtacgagagcaagagcctggaggagctgagactggaggactaccaggccaacagaaagggcccccagaaccaggtgggcgccggcaccaccaccggcctgttcggcagcagccccgccaccagcagcgccaccggcctgttcagcagcagcaccaccaacagcggcttcgcctacggccagaacaagaccgccttcggcaccagcaccaccggcttcggcaccaaccccggcggcctgttcggccagcagaaccagcagaccaccagcctgttcagcaagcccttcggccaggccaccaccacccagaacaccggcttcagcttcggcaacaccagcaccatcggccagcccagcaccaacaccatgggcctgttcggcgtgacccaggccagccagcccggcggcctgttcggcaccgccaccaacaccagcaccggcaccgccttcggcaccggcaccggcctgttcggccagaccaacaccggcttcggcgccgtgggcagcaccctgttcggcaacaacaagctgaccaccttcggcagcagcaccaccagcgcccccagcttcggcaccaccagcggcggcctgttcggcttcggcaccaacaccagcggcaacagcatcttcggcagcaagcccgcccccggcaccctgggcaccggcctgggcgccggcttcggcaccgccctgggcgccggccaggccagcctgttcggcaacaaccagcccaagatcggcggccccctgggcaccggcgccttcggcgcccccggcttcaacaccaccaccgccaccctgggcttcggcgccccccaggcccccgtggccctgaccgaccccaacgccagcgccgcccagcaggccgtgctgcagcagcacatcaacagcctgacctacagccccttcggcgacagccccctgttcagaaaccccatgagcgaccccaagaagaaggaggagagactgaagcccaccaaccccgccgcccagaaggccctgaccacccccacccactacaagctgacccccagacccgccaccagagtgagacccaaggccctgcagaccaccggcaccgccaagagccacctgttcgacggcctggacgacgacgagcccagcctggccaacggcgccttcatgcccaagaagagcatcaagaagctggtgctgaagaacctgaacaacagcaacctgttcagccccgtgaacagagacagcgagaacctggccagccccagcgagtaccccgagaacggcgagagattcagcttcctgagcaagcccgtggacgagaaccaccagcaggacggcgacgaggacagcctggtgagccacttctacaccaaccccatcgccaagcccatcccccagacccccgagagcgccggcaacaagcacagcaacagcaacagcgtggacgacaccatcgtggccctgaacatgagagccgccctgagaaacggcctggagggcagcagcgaggagaccagcttccacgacgagagcctgcaggacgacagagaggagatcgagaacaacagctaccacatgcaccccgccggcatcatcctgaccaaggtgggctactacaccatccccagcatggacgacctggccaagatcaccaacgagaagggcgagtgcatcgtgagcgacttcaccatcggcagaaagggctacggcagcatctacttcgagggcgacgtgaacctgaccaacctgaacctggacgacatcgtgcacatcagaagaaaggaggtggtggtgtacctggacgacaaccagaagccccccgtgggcgagggcctgaacagaaaggccgaggtgaccctggacggcgtgtggcccaccgacaagaccagcagatgcctgatcaagagccccgacagactggccgacatcaactacgagggcagactggaggccgtgagcagaaagcagggcgcccagttcaaggagtacagacccgagaccggcagctgggtgttcaaggtgagccacttcagcaagtacggcctgcaggacagcgacgaggaggaggaggagcaccccagcaagaccagcaccaagaagctgaagaccgcccccctgccccccgccagccagaccacccccctgcagatggccctgaacggcaagcccgccccccccccccagagccagagccccgaggtggagcagctgggcagagtggtggagctggacagcgacatggtggacatcacccaggagcccgtgctggacaccatgctggaggagagcatgcccgaggaccaggagcccgtgagcgccagcacccacatcgccagcagcctgggcatcaacccccacgtgctgcagatcatgaaggccagcctgctgaccgacgaggaggacgtggacatggccctggaccagagattcagcagactgcccagcaaggccgacaccagccaggagatctgcagccccagactgcccatcagcgccagccacagcagcaagaccagaagcctggtgggcggcctgctgcagagcaagttcaccagcggcgccttcctgagccccagcgtgagcgtgcaggagtgcagaacccccagagccgccagcctgatgaacatccccagcaccagcagctggagcgtgcccccccccctgaccagcgtgttcaccatgcccagccccgcccccgaggtgcccctgaagaccgtgggcaccagaagacagctgggcctggtgcccagagagaagagcgtgacctacggcaagggcaagctgctgatggacatggccctgttcatgggcagaagcttcagagtgggctggggccccaactggaccctggccaacagcggcgagcagctgaacggcagccacgagctggagaaccaccagatcgccgacagcatggagttcggcttcctgcccaaccccgtggccgtgaagcccctgaccgagagccccttcaaggtgcacctggagaagctgagcctgagacagagaaagcccgacgaggacatgaagctgtaccagacccccctggagctgaagctgaagcacagcaccgtgcacgtggacgagctgtgccccctgatcgtgcccaacctgggcgtggccgtgatccacgactacgccgactgggtgaaggaggccagcggcgacctgcccgaggcccagatcgtgaagcactggagcctgacctggaccctgtgcgaggccctgtggggccacctgaaggagctggacagccagctgaacgagcccagagagtacatccagatcctggagagaagaagagccttcagcagatggctgagctgcaccgccaccccccagatcgaggaggaggtgagcctgacccagaagaacagccccgtggaggccgtgttcagctacctgaccggcaagagaatcagcgaggcctgcagcctggcccagcagagcggcgaccacagactggccctgctgctgagccagttcgtgggcagccagagcgtgagagagctgctgaccatgcagctggtggactggcaccagctgcaggccgacagcttcatccaggacgagagactgagaatcttcgccctgctggccggcaagcccgtgtggcagctgagcgagaagaagcagatcaacgtgtgcagccagctggactggaagagaagcctggccatccacctgtggtacctgctgccccccaccgccagcatcagcagagccctgagcatgtacgaggaggccttccagaacaccagcgacagcgacagatacgcctgcagccccctgcccagctacctggagggcagcggctgcgtgatcgccgaggagcagaacagccagacccccctgagagacgtgtgcttccacctgctgaagctgtacagcgacagacactacgacctgaaccagctgctggagcccagaagcatcaccgccgaccccctggactacagactgagctggcacctgtgggaggtgctgagagccctgaactacacccacctgagcgcccagtgcgagggcgtgctgcaggccagctacgccggccagctggagagcgagggcctgtgggagtgggccatcttcgtgctgctgcacatcgacaacagcggcatcagagagaaggccgtgagagagctgctgaccagacactgccagctgctggagacccccgagagctgggccaaggagaccttcctgacccagaagctgagagtgcccgccaagtggatccacgaggccaaggccgtgagagcccacatggagagcgacaagcacctggaggccctgtgcctgttcaaggccgagcactggaacagatgccacaagctgatcatcagacacctggccagcgacgccatcatcaacgagaactacgactacctgaagggcttcctggaggacctggccccccccgagagaagcagcctgatccaggactgggagaccagcggcctggtgtacctggactacatcagagtgatcgagatgctgagacacatccagcaggtggactgcagcggcaacgacctggagcagctgcacatcaaggtgaccagcctgtgcagcagaatcgagcagatccagtgctacagcgccaaggacagactggcccagagcgacatggccaagagagtggccaacctgctgagagtggtgctgagcctgcaccacccccccgacagaaccagcgacagcacccccgacccccagagagtgcccctgagactgctggccccccacatcggcagactgcccatgcccgaggactacgccatggacgagctgagaagcctgacccagagctacctgagagagctggccgtgggcagcctgtag

SEQ ID NO: 91772 - DNA, 5181 bp, Artificial Sequence
  Description of Artificial Sequence: Synthetic coding sequence
atgttcaacaagagcttcggcacccccttcggcggcggcaccggcggcttcggcaccaccagcaccttcggccagaacaccggcttcggcaccaccagcggcggcgccttcggcaccagcgccttcggcagcagcaacaacaccggcggcctgttcggcaacagccagaccaagcccggcggcctgttcggcaccagcagcttcagccagcccgccaccagcaccagcaccggcttcggcttcggcaccagcaccggcaccgccaacaccctgttcggcaccgccagcaccggcaccagcctgttcagcagccagaacaacgccttcgcccagaacaagcccaccggcttcggcaacttcggcaccagcaccagcagcggcggcctgttcggcaccaccaacaccaccagcaaccccttcggcagcaccagcggcagcctgttcggccccagcagcttcaccgccgcccccaccggcaccaccatcaagttcaacccccccaccggcaccgacaccatggtgaaggccggcgtgagcaccaacatcagcaccaagcaccagtgcatcaccgccatgaaggagtacgagagcaagagcctggaggagctgagactggaggactaccaggccaacagaaagggcccccagaaccaggtgggcgccggcaccaccaccggcctgttcggcagcagccccgccaccagcagcgccaccggcctgttcagcagcagcaccaccaacagcggcttcgcctacggccagaacaagaccgccttcggcaccagcaccaccggcttcggcaccaaccccggcggcctgttcggccagcagaaccagcagaccaccagcctgttcagcaagcccttcggccaggccaccaccacccagaacaccggcttcagcttcggcaacaccagcaccatcggccagcccagcaccaacaccatgggcctgttcggcgtgacccaggccagccagcccggcggcctgttcggcaccgccaccaacaccagcaccggcaccgccttcggcaccggcaccggcctgttcggccagaccaacaccggcttcggcgccgtgggcagcaccctgttcggcaacaacaagctgaccaccttcggcagcagcaccaccagcgcccccagcttcggcaccaccagcggcggcctgttcggcttcggcaccaacaccagcggcaacagcatcttcggcagcaagcccgcccccggcaccctgggcaccggcctgggcgccggcttcggcaccgccctgggcgccggccaggccagcctgttcggcaacaaccagcccaagatcggcggccccctgggcaccggcgccttcggcgcccccggcttcaacaccaccaccgccaccctgggcttcggcgccccccaggcccccgtggccctgaccgaccccaacgccagcgccgcccagcaggccgtgctgcagcagcacatcaacagcctgacctacagccccttcggcgacagccccctgttcagaaaccccatgagcgaccccaagaagaaggaggagagactgaagcccaccaaccccgccgcccagaaggccctgaccacccccacccactacaagctgacccccagacccgccaccagagtgagacccaaggccctgcagaccaccggcaccgccaagagccacctgttcgacggcctggacgacgacgagcccagcctggccaacggcgccttcatgcccaagaagagcatcaagaagctggtgctgaagaacctgaacaacagcaacctgttcagccccgtgaacagagacagcgagaacctggccagccccagcgagtaccccgagaacggcgagagattcagcttcctgagcaagcccgtggacgagaaccaccagcaggacggcgacgaggacagcctggtgagccacttctacaccaaccccatcgccaagcccatcccccagacccccgagagcgccggcaacaagcacagcaacagcaacagcgtggacgacaccatcgtggccctgaacatgagagccgccctgagaaacggcctggagggcagcagcgaggagaccagcttccacgacgagagcctgcaggacgacagagaggagatcgagaacaacagctaccacatgcaccccgccggcatcatcctgaccaaggtgggctactacaccatccccagcatggacgacctggccaagatcaccaacgagaagggcgagtgcatcgtgagcgacttcaccatcggcagaaagggctacggcagcatctacttcgagggcgacgtgaacctgaccaacctgaacctggacgacatcgtgcacatcagaagaaaggaggtggtggtgtacctggacgacaaccagaagccccccgtgggcgagggcctgaacagaaaggccgaggtgaccctggacggcgtgtggcccaccgacaagaccagcagatgcctgatcaagagccccgacagactggccgacatcaactacgagggcagactggaggccgtgagcagaaagcagggcgcccagttcaaggagtacagacccgagaccggcagctgggtgttcaaggtgagccacttcagcaagtacggcctgcaggacagcgacgaggaggaggaggagcaccccagcaagaccagcaccaagaagctgaagaccgcccccctgccccccgccagccagaccacccccctgcagatggccctgaacggcaagcccgccccccccccccagagccagagccccgaggtggagcagctgggcagagtggtggagctggacagcgacatggtggacatcacccaggagcccgtgctggacaccatgctggaggagagcatgcccgaggaccaggagcccgtgagcgccagcacccacatcgccagcagcctgggcatcaacccccacgtgctgcagatcatgaaggccagcctgctgaccgacgaggaggacgtggacatggccctggaccagagattcagcagactgcccagcaaggccgacaccagccaggagatctgcagccccagactgcccatcagcgccagccacagcagcaagaccagaagcctggtgggcggcctgctgcagagcaagttcaccagcggcgccttcctgagccccagcgtgagcgtgcaggagtgcagaacccccagagccgccagcctgatgaacatccccagcaccagcagctggagcgtgcccccccccctgaccagcgtgttcaccatgcccagccccgcccccgaggtgcccctgaagaccgtgggcaccagaagacagctgggcctggtgcccagagagaagagcgtgacctacggcaagggcaagctgctgatggacatggccctgttcatgggcagaagcttcagagtgggctggggccccaactggaccctggccaacagcggcgagcagctgaacggcagccacgagctggagaaccaccagatcgccgacagcatggagttcggcttcctgcccaaccccgtggccgtgaagcccctgaccgagagccccttcaaggtgcacctggagaagctgagcctgagacagagaaagcccgacgaggacatgaagctgtaccagacccccctggagctgaagctgaagcacagcaccgtgcacgtggacgagctgtgccccctgatcgtgcccaacctgggcgtggccgtgatccacgactacgccgactgggtgaaggaggccagcggcgacctgcccgaggcccagatcgtgaagcactggagcctgacctggaccctgtgcgaggccctgtggggccacctgaaggagctggacagccagctgaacgagcccagagagtacatccagatcctggagagaagaagagccttcagcagatggctgagctgcaccgccaccccccagatcgaggaggaggtgagcctgacccagaagaacagccccgtggaggccgtgttcagctacctgaccggcaagagaatcagcgaggcctgcagcctggcccagcagagcggcgaccacagactggccctgctgctgagccagttcgtgggcagccagagcgtgagagagctgctgaccatgcagctggtggactggcaccagctgcaggccgacagcttcatccaggacgagagactgagaatcttcgccctgctggccggcaagcccgtgtggcagctgagcgagaagaagcagatcaacgtgtgcagccagctggactggaagagaagcctggccatccacctgtggtacctgctgccccccaccgccagcatcagcagagccctgagcatgtacgaggaggccttccagaacaccagcgacagcgacagatacgcctgcagccccctgcccagctacctggagggcagcggctgcgtgatcgccgaggagcagaacagccagacccccctgagagacgtgtgcttccacctgctgaagctgtacagcgacagcatcagagagaaggccgtgagagagctgctgaccagacactgccagctgctggagacccccgagagctgggccaaggagaccttcctgacccagaagctgagagtgcccgccaagtggatccacgaggccaaggccgtgagagcccacatggagagcgacaagcacctggaggccctgtgcctgttcaaggccgagcactggaacagatgccacaagctgatcatcagacacctggccagcgacgccatcatcaacgagaactacgactacctgaagggcttcctggaggacctggccccccccgagagaagcagcctgatccaggactgggagaccagcggcctggtgtacctggactacatcagagtgatcgagatgctgagacacatccagcaggtggactgcagcggcaacgacctggagcagctgcacatcaaggtgaccagcctgtgcagcagaatcgagcagatccagtgctacagcgccaaggacagactggcccagagcgacatggccaagagagtggccaacctgctgagagtggtgctgagcctgcaccacccccccgacagaaccagcgacagcacccccgacccccagagagtgcccctgagactgctggccccccacatcggcagactgcccatgcccgaggactacgccatggacgagctgagaagcctgacccagagctacctgagagagctggccgtgggcagcctgtag

SEQ ID NO: 91773 - DNA, 4917 bp, Artificial Sequence
  Description of Artificial Sequence: Synthetic coding sequence
atgttcaacaagagcttcggcacccccttcggcggcggcaccggcggcttcggcaccaccagcaccttcggccagaacaccggcttcggcaccaccagcggcggcgccttcggcaccagcgccttcggcagcagcaacaacaccggcggcctgttcggcaacagccagaccaagcccggcggcctgttcggcaccagcagcttcagccagcccgccaccagcaccagcaccggcttcggcttcggcaccagcaccggcaccgccaacaccctgttcggcaccgccagcaccggcaccagcctgttcagcagccagaacaacgccttcgcccagaacaagcccaccggcttcggcaacttcggcaccagcaccagcagcggcggcctgttcggcaccaccaacaccaccagcaaccccttcggcagcaccagcggcagcctgttcggccccagcagcttcaccgccgcccccaccggcaccaccatcaagttcaacccccccaccggcaccgacaccatggtgaaggccggcgtgagcaccaacatcagcaccaagcaccagtgcatcaccgccatgaaggagtacgagagcaagagcctggaggagctgagactggaggactaccaggccaacagaaagggcccccagaaccaggtgggcgccggcaccaccaccggcctgttcggcagcagccccgccaccagcagcgccaccggcctgttcagcagcagcaccaccaacagcggcttcgcctacggccagaacaagaccgccttcggcaccagcaccaccggcttcggcaccaaccccggcggcctgttcggccagcagaaccagcagaccaccagcctgttcagcaagcccttcggccaggccaccaccacccagaacaccggcttcagcttcggcaacaccagcaccatcggccagcccagcaccaacaccatgggcctgttcggcgtgacccaggccagccagcccggcggcctgttcggcaccgccaccaacaccagcaccggcaccgccttcggcaccggcaccggcctgttcggccagaccaacaccggcttcggcgccgtgggcagcaccctgttcggcaacaacaagctgaccaccttcggcagcagcaccaccagcgcccccagcttcggcaccaccagcggcggcctgttcggcttcggcaccaacaccagcggcaacagcatcttcggcagcaagcccgcccccggcaccctgggcaccggcctgggcgccggcttcggcaccgccctgggcgccggccaggccagcctgttcggcaacaaccagcccaagatcggcggccccctgggcaccggcgccttcggcgcccccggcttcaacaccaccaccgccaccctgggcttcggcgccccccaggcccccgtggccctgaccgaccccaacgccagcgccgcccagcaggccgtgctgcagcagcacatcaacagcctgacctacagccccttcggcgacagccccctgttcagaaaccccatgagcgaccccaagaagaaggaggagagactgaagcccaccaaccccgccgcccagaaggccctgaccacccccacccactacaagctgacccccagacccgccaccagagtgagacccaaggccctgcagaccaccggcaccgccaagagccacctgttcgacggcctggacgacgacgagcccagcctggccaacggcgccttcatgcccaagaagagcatcaagaagctggtgctgaagaacctgaacaacagcaacctgttcagccccgtgaacagagacagcgagaacctggccagccccagcgagtaccccgagaacggcgagagattcagcttcctgagcaagcccgtggacgagaaccaccagcaggacggcgacgaggacagcctggtgagccacttctacaccaaccccatcgccaagcccatcccccagacccccgagagcgccggcaacaagcacagcaacagcaacagcgtggacgacaccatcgtggccctgaacatgagagccgccctgagaaacggcctggagggcagcagcgaggagaccagcttccacgacgagagcctgcaggacgacagagaggagatcgagaacaacagctaccacatgcaccccgccggcatcatcctgaccaaggtgggctactacaccatccccagcatggacgacctggccaagatcaccaacgagaagggcgagtgcatcgtgagcgacttcaccatcggcagaaagggctacggcagcatctacttcgagggcgacgtgaacctgaccaacctgaacctggacgacatcgtgcacatcagaagaaaggaggtggtggtgtacctggacgacaaccagaagccccccgtgggcgagggcctgaacagaaaggccgaggtgaccctggacggcgtgtggcccaccgacaagaccagcagatgcctgatcaagagccccgacagactggccgacatcaactacgagggcagactggaggccgtgagcagaaagcagggcgcccagttcaaggagtacagacccgagaccggcagctgggtgttcaaggtgagccacttcagcaagtacggcctgcaggacagcgacgaggaggaggaggagcaccccagcaagaccagcaccaagaagctgaagaccgcccccctgccccccgccagccagaccacccccctgcagatggccctgaacggcaagcccgccccccccccccagagccagagccccgaggtggagcagctgggcagagtggtggagctggacagcgacatggtggacatcacccaggagcccgtgctggacaccatgctggaggagagcatgcccgaggaccaggagcccgtgagcgccagcacccacatcgccagcagcctgggcatcaacccccacgtgctgcagatcatgaaggccagcctgctgaccgacgaggaggacgtggacatggccctggaccagagattcagcagactgcccagcaaggccgacaccagccaggagatctgcagccccagactgcccatcagcgccagccacagcagcaagaccagaagcctggtgggcggcctgctgcagagcaagttcaccagcggcgccttcctgagccccagcgtgagcgtgcaggagtgcagaacccccagagccgccagcctgatgaacatccccagcaccagcagctggagcgtgcccccccccctgaccagcgtgttcaccatgcccagccccgcccccgaggtgcccctgaagaccgtgggcaccagaagacagctgggcctggtgcccagagagaagagcgtgacctacggcaagggcaagctgctgatggacatggccctgttcatgggcagaagcttcagagtgggctggggccccaactggaccctggccaacagcggcgagcagctgaacggcagccacgagctggagaaccaccagatcgccgacagcatggagttcggcttcctgcccaaccccgtggccgtgaagcccctgaccgagagccccttcaaggtgcacctggagaagctgagcctgagacagagaaagcccgacgaggacatgaagctgtaccagacccccctggagctgaagctgaagcacagcaccgtgcacgtggacgagctgtgccccctgatcgtgcccaacctgggcgtggccgtgatccacgactacgccgactgggtgaaggaggccagcggcgacctgcccgaggcccagatcgtgaagcactggagcctgacctggaccctgtgcgaggccctgtggggccacctgaaggagctggacagccagctgaacgagcccagagagtacatccagatcctggagagaagaagagccttcagcagatggctgagctgcaccgccaccccccagatcgaggaggaggtgagcctgacccagaagaacagccccgtggaggccgtgttcagctacctgaccggcaagagaatcagcgaggcctgcagcctggcccagcagagcggcgaccacagactggccctgctgctgagccagttcgtgggcagccagagcgtgagagagctgctgaccatgcagctggtggactggcaccagctgcaggccgacagcttcatccaggacgagagactgagaatcttcgccctgctggccggcaagcccgtgtggcagctgagcgagaagaagcagatcaacgtgtgcagccagctggactggaagagaagcctggccatccacctgtggtacctgctgccccccaccgccagcatcagcagagccctgagcatgtacgaggaggccttccagaacaccagcgacagcgacagatacgcctgcagccccctgcccagctacctggagggcagcggctgcgtgatcgccgaggagcagaacagccagacccccctgagagacgtgtgcttccacctgctgaagctgtacagcgacagcatcagagagaaggccgtgagagagctgctgaccagacactgccagctgctggagacccccgagagctgggccaaggagaccttcctgacccagaagctgagagtgcccgccaagtggatccacgaggccaaggccgtgagagcccacatggagagcgacaagcacctggaggccctgtgcctgttcaaggccgagcactggaacagatgccacaagctgatcatcagacacctggccagcgacgccatcatcaacgagaactacgactacctgaagggcttcctggaggacctggccccccccgagagaagcagcctgatccaggactgggagaccagcggcctggtgtacctggactacatcagagtgatcgagatgctgagacacatccagcagatcgccctgttctgcgtggagtggatcgcccaggtgatgacctggagcagctacaccagcaagtag

SEQ ID NO: 91774 - DNA, 2763 bp, Artificial Sequence
  Description of Artificial Sequence: Synthetic coding sequence
atgttcaacaagagcttcggcacccccttcggcggcggcaccggcggcttcggcaccaccagcaccttcggccagaacaccggcttcggcaccaccagcggcggcgccttcggcaccagcgccttcggcagcagcaacaacaccggcggcctgttcggcaacagccagaccaagcccggcggcctgttcggcaccagcagcttcagccagcccgccaccagcaccagcaccggcttcggcttcggcaccagcaccggcaccgccaacaccctgttcggcaccgccagcaccggcaccagcctgttcagcagccagaacaacgccttcgcccagaacaagcccaccggcttcggcaacttcggcaccagcaccagcagcggcggcctgttcggcaccaccaacaccaccagcaaccccttcggcagcaccagcggcagcctgttcggccccagcagcttcaccgccgcccccaccggcaccaccatcaagttcaacccccccaccggcaccgacaccatggtgaaggccggcgtgagcaccaacatcagcaccaagcaccagtgcatcaccgccatgaaggagtacgagagcaagagcctggaggagctgagactggaggactaccaggccaacagaaagggcccccagaaccaggtgggcgccggcaccaccaccggcctgttcggcagcagccccgccaccagcagcgccaccggcctgttcagcagcagcaccaccaacagcggcttcgcctacggccagaacaagaccgccttcggcaccagcaccaccggcttcggcaccaaccccggcggcctgttcggccagcagaaccagcagaccaccagcctgttcagcaagcccttcggccaggccaccaccacccagaacaccggcttcagcttcggcaacaccagcaccatcggccagcccagcaccaacaccatgggcctgttcggcgtgacccaggccagccagcccggcggcctgttcggcaccgccaccaacaccagcaccggcaccgccttcggcaccggcaccggcctgttcggccagaccaacaccggcttcggcgccgtgggcagcaccctgttcggcaacaacaagctgaccaccttcggcagcagcaccaccagcgcccccagcttcggcaccaccagcggcggcctgttcggcttcggcaccaacaccagcggcaacagcatcttcggcagcaagcccgcccccggcaccctgggcaccggcctgggcgccggcttcggcaccgccctgggcgccggccaggccagcctgttcggcaacaaccagcccaagatcggcggccccctgggcaccggcgccttcggcgcccccggcttcaacaccaccaccgccaccctgggcttcggcgccccccaggcccccgtggccctgaccgaccccaacgccagcgccgcccagcaggccgtgctgcagcagcacatcaacagcctgacctacagccccttcggcgacagccccctgttcagaaaccccatgagcgaccccaagaagaaggaggagagactgaagcccaccaaccccgccgcccagaaggccctgaccacccccacccactacaagctgacccccagacccgccaccagagtgagacccaaggccctgcagaccaccggcaccgccaagagccacctgttcgacggcctggacgacgacgagcccagcctggccaacggcgccttcatgcccaagaagagcatcaagaagctggtgctgaagaacctgaacaacagcaacctgttcagccccgtgaacagagacagcgagaacctggccagccccagcgagtaccccgagaacggcgagagattcagcttcctgagcaagcccgtggacgagaaccaccagcaggacggcgacgaggacagcctggtgagccacttctacaccaaccccatcgccaagcccatcccccagacccccgagagcgccggcaacaagcacagcaacagcaacagcgtggacgacaccatcgtggccctgaacatgagagccgccctgagaaacggcctggagggcagcagcgaggagaccagcttccacgacgagagcctgcaggacgacagagaggagatcgagaacaacagctaccacatgcaccccgccggcatcatcctgaccaaggtgggctactacaccatccccagcatggacgacctggccaagatcaccaacgagaagggcgagtgcatcgtgagcgacttcaccatcggcagaaagggctacggcagcatctacttcgagggcgacgtgaacctgaccaacctgaacctggacgacatcgtgcacatcagaagaaaggaggtggtggtgtacctggacgacaaccagaagccccccgtgggcgagggcctgaacagaaaggccgaggtgaccctggacggcgtgtggcccaccgacaagaccagcagatgcctgatcaagagccccgacagactggccgacatcaactacgagggcagactggaggccgtgagcagaaagcagggcgcccagttcaaggagtacagacccgagaccggcagctgggtgttcaaggtgagccacttcagcaagtacggcctgcaggacagcgacgaggaggaggaggagcaccccagcaagaccagcaccaagaagctgaagaccgcccccctgccccccgccagccagaccacccccctgcagatggccctgaacggcaagcccgccccccccccccaggtggagaagaagggccagtag

SEQ ID NO: 91775 - DNA, 2814 bp, Artificial Sequence
  Description of Artificial Sequence: Synthetic coding sequence
atgttcaacaagagcttcggcacccccttcggcggcggcaccggcggcttcggcaccaccagcaccttcggccagaacaccggcttcggcaccaccagcggcggcgccttcggcaccagcgccttcggcagcagcaacaacaccggcggcctgttcggcaacagccagaccaagcccggcggcctgttcggcaccagcagcttcagccagcccgccaccagcaccagcaccggcttcggcttcggcaccagcaccggcaccgccaacaccctgttcggcaccgccagcaccggcaccagcctgttcagcagccagaacaacgccttcgcccagaacaagcccaccggcttcggcaacttcggcaccagcaccagcagcggcggcctgttcggcaccaccaacaccaccagcaaccccttcggcagcaccagcggcagcctgttcggccccagcagcttcaccgccgcccccaccggcaccaccatcaagttcaacccccccaccggcaccgacaccatggtgaaggccggcgtgagcaccaacatcagcaccaagcaccagtgcatcaccgccatgaaggagtacgagagcaagagcctggaggagctgagactggaggactaccaggccaacagaaagggcccccagaaccaggtgggcgccggcaccaccaccggcctgttcggcagcagccccgccaccagcagcgccaccggcctgttcagcagcagcaccaccaacagcggcttcgcctacggccagaacaagaccgccttcggcaccagcaccaccggcttcggcaccaaccccggcggcctgttcggccagcagaaccagcagaccaccagcctgttcagcaagcccttcggccaggccaccaccacccagaacaccggcttcagcttcggcaacaccagcaccatcggccagcccagcaccaacaccatgggcctgttcggcgtgacccaggccagccagcccggcggcctgttcggcaccgccaccaacaccagcaccggcaccgccttcggcaccggcaccggcctgttcggccagaccaacaccggcttcggcgccgtgggcagcaccctgttcggcaacaacaagctgaccaccttcggcagcagcaccaccagcgcccccagcttcggcaccaccagcggcggcctgttcggcaacaagcccaccctgaccctgggcaccaacaccaacaccagcaacttcggcttcggcaccaacaccagcggcaacagcatcttcggcagcaagcccgcccccggcaccctgggcaccggcctgggcgccggcttcggcaccgccctgggcgccggccaggccagcctgttcggcaacaaccagcccaagatcggcggccccctgggcaccggcgccttcggcgcccccggcttcaacaccaccaccgccaccctgggcttcggcgccccccaggcccccgtggccctgaccgaccccaacgccagcgccgcccagcaggccgtgctgcagcagcacatcaacagcctgacctacagccccttcggcgacagccccctgttcagaaaccccatgagcgaccccaagaagaaggaggagagactgaagcccaccaaccccgccgcccagaaggccctgaccacccccacccactacaagctgacccccagacccgccaccagagtgagacccaaggccctgcagaccaccggcaccgccaagagccacctgttcgacggcctggacgacgacgagcccagcctggccaacggcgccttcatgcccaagaagagcatcaagaagctggtgctgaagaacctgaacaacagcaacctgttcagccccgtgaacagagacagcgagaacctggccagccccagcgagtaccccgagaacggcgagagattcagcttcctgagcaagcccgtggacgagaaccaccagcaggacggcgacgaggacagcctggtgagccacttctacaccaaccccatcgccaagcccatcccccagacccccgagagcgccggcaacaagcacagcaacagcaacagcgtggacgacaccatcgtggccctgaacatgagagccgccctgagaaacggcctggagggcagcagcgaggagaccagcttccacgacgagagcctgcaggacgacagagaggagatcgagaacaacagctaccacatgcaccccgccggcatcatcctgaccaaggtgggctactacaccatccccagcatggacgacctggccaagatcaccaacgagaagggcgagtgcatcgtgagcgacttcaccatcggcagaaagggctacggcagcatctacttcgagggcgacgtgaacctgaccaacctgaacctggacgacatcgtgcacatcagaagaaaggaggtggtggtgtacctggacgacaaccagaagccccccgtgggcgagggcctgaacagaaaggccgaggtgaccctggacggcgtgtggcccaccgacaagaccagcagatgcctgatcaagagccccgacagactggccgacatcaactacgagggcagactggaggccgtgagcagaaagcagggcgcccagttcaaggagtacagacccgagaccggcagctgggtgttcaaggtgagccacttcagcaagtacggcctgcaggacagcgacgaggaggaggaggagcaccccagcaagaccagcaccaagaagctgaagaccgcccccctgccccccgccagccagaccacccccctgcagatggccctgaacggcaagcccgccccccccccccaggtggagaagaagggccagtag

SEQ ID NO: 91776 - DNA, 1731 bp, Artificial Sequence
  Description of Artificial Sequence: Synthetic coding sequence
atgagcaccggcttcagcttcggcaccggcgccagcagcaaccccagcgtgggcctgaacttcggcaacctgggcagcaccagcacccccgccaccaccagcgcccccagcagcggcttcggcaccggcctgttcggcagcaagcccgccaccggcttcaccctgggcggcaccaacaccggcatcgccaccaccatcaccaccggcctgaccctgggcacccccgccaccaccagcgccgccaccaccggcttcagcctgggcttcaacaagcccgccgccagcgccacccccttcgccctgcccatcaccagcaccagcgccagcggcctgaccctgagcagcgccctgaccagcacccccgccgccagcaccggcttcaccctgaacaacctgggcggcaccaccgccaccaccaccaccgccagcaccggcctgagcctgggcggcgccctggccggcctgggcggcagcctgttccagagcaccaacaccggcaccagcggcctgggccagaacgccctgggcctgaccctgggcaccaccgccgccaccagcaccgccggcaacgagggcctgggcggcatcgacttcagcagcagcagcgacaagaagagcgacaagaccggcaccagacccgaggacagcaaggccctgaaggacgagaacctgccccccgtgatctgccaggacgtggagaacctgcagaagttcgtgaaggagcagaagcaggtgcaggaggagatcagcagaatgagcagcaaggccatgctgaaggtgcaggaggacatcaaggccctgaagcagctgctgagcctggccgccaacggcatccagagaaacaccctgaacatcgacaagctgaagatcgagaccgcccaggagctgaagaacgccgagatcgccctgagaacccagaagaccccccccggcctgcagcacgagtacgccgcccccgccgactacttcagaatcctggtgcagcagttcgaggtgcagctgcagcagtacagacagcagatcgaggagctggagaaccacctggccacccaggccaacaacagccacatcaccccccaggacctgagcatggccatgcagaagatctaccagaccttcgtggccctggccgcccagctgcagagcatccacgagaacgtgaaggtgctgaaggagcagtacctgggctacagaaagatgttcctgggcgacgccgtggacgtgttcgagaccagaagagccgaggccaagaagtggcagaacacccccagagtgaccaccggccccacccccttcagcaccatgcccaacgccgccgccgtggccatggccgccaccctgacccagcagcagcagcccgccaccggcccccagcccagcctgggcgtgagcttcggcacccccttcggcagcggcatcggcaccggcctgcagagcagcggcctgggcagcagcaacctgggcggcttcggcaccagcagcggcttcggctgcagcaccaccggcgccagcaccttcggcttcggcaccaccaacaagcccagcggcagcctgagcgccggcttcggcagcagcagcaccagcggcttcaacttcagcaaccccggcatcaccgccagcgccggcctgaccttcggcgtgagcaaccccgccagcgccggcttcggcaccggcggccagctgctgcagctgaagaagccccccgccggcaacaagagaggcaagagatag

SEQ ID NO: 91777 - DNA, 1764 bp, Artificial Sequence
  Description of Artificial Sequence: Synthetic coding sequence
atgagcaccggcttcagcttcggcagcggcaccctgggcagcaccaccgtggccgccggcggcaccagcaccggcggcgtgttcagcttcggcaccggcgccagcagcaaccccagcgtgggcctgaacttcggcaacctgggcagcaccagcacccccgccaccaccagcgcccccagcagcggcttcggcaccggcctgttcggcagcaagcccgccaccggcttcaccctgggcggcaccaacaccggcacccccgccaccaccagcgccgccaccaccggcttcagcctgggcttcaacaagcccgccgccagcgccacccccttcgccctgcccatcaccagcaccagcgccagcggcctgaccctgagcagcgccctgaccagcacccccgccgccagcaccggcttcaccctgaacaacctgggcggcaccaccgccaccaccaccaccgccagcaccggcctgagcctgggcggcgccctggccggcctgggcggcagcctgttccagagcaccaacaccggcaccagcggcctgggccagaacgccctgggcctgaccctgggcaccaccgccgccaccagcaccgccggcaacgagggcctgggcggcatcgacttcagcagcagcagcgacaagaagagcgacaagaccggcaccagacccgaggacagcaaggccctgaaggacgagaacctgccccccgtgatctgccaggacgtggagaacctgcagaagttcgtgaaggagcagaagcaggtgcaggaggagatcagcagaatgagcagcaaggccatgctgaaggtgcaggaggacatcaaggccctgaagcagctgctgagcctggccgccaacggcatccagagaaacaccctgaacatcgacaagctgaagatcgagaccgcccaggagctgaagaacgccgagatcgccctgagaacccagaagaccccccccggcctgcagcacgagtacgccgcccccgccgactacttcagaatcctggtgcagcagttcgaggtgcagctgcagcagtacagacagcagatcgaggagctggagaaccacctggccacccaggccaacaacagccacatcaccccccaggacctgagcatggccatgcagaagatctaccagaccttcgtggccctggccgcccagctgcagagcatccacgagaacgtgaaggtgctgaaggagcagtacctgggctacagaaagatgttcctgggcgacgccgtggacgtgttcgagaccagaagagccgaggccaagaagtggcagaacacccccagagtgaccaccggccccacccccttcagcaccatgcccaacgccgccgccgtggccatggccgccaccctgacccagcagcagcagcccgccaccggcccccagcccagcctgggcgtgagcttcggcacccccttcggcagcggcatcggcaccggcctgcagagcagcggcctgggcagcagcaacctgggcggcttcggcaccagcagcggcttcggctgcagcaccaccggcgccagcaccttcggcttcggcaccaccaacaagcccagcggcagcctgagcgccggcttcggcagcagcagcaccagcggcttcaacttcagcaaccccggcatcaccgccagcgccggcctgaccttcggcgtgagcaaccccgccagcgccggcttcggcaccggcggccagctgctgcagctgaagaagccccccgccggcaacaagagaggcaagagatag

SEQ ID NO: 91778 - DNA, 1800 bp, Artificial Sequence
  Description of Artificial Sequence: Synthetic coding sequence
atgagcaccggcttcagcttcggcagcggcaccctgggcagcaccaccgtggccgccggcggcaccagcaccggcggcgtgttcagcttcggcaccggcgccagcagcaaccccagcgtgggcctgaacttcggcaacctgggcagcaccagcacccccgccaccaccagcgcccccagcagcggcttcggcaccggcctgttcggcagcaagcccgccaccggcttcaccctgggcggcaccaacaccggcatcgccaccaccatcaccaccggcctgaccctgggcacccccgccaccaccagcgccgccaccaccggcttcagcctgggcttcaacaagcccgccgccagcgccacccccttcgccctgcccatcaccagcaccagcgccagcggcctgaccctgagcagcgccctgaccagcacccccgccgccagcaccggcttcaccctgaacaacctgggcggcaccaccgccaccaccaccaccgccagcaccggcctgagcctgggcggcgccctggccggcctgggcggcagcctgttccagagcaccaacaccggcaccagcggcctgggccagaacgccctgggcctgaccctgggcaccaccgccgccaccagcaccgccggcaacgagggcctgggcggcatcgacttcagcagcagcagcgacaagaagagcgacaagaccggcaccagacccgaggacagcaaggccctgaaggacgagaacctgccccccgtgatctgccaggacgtggagaacctgcagaagttcgtgaaggagcagaagcaggtgcaggaggagatcagcagaatgagcagcaaggccatgctgaaggtgcaggaggacatcaaggccctgaagcagctgctgagcctggccgccaacggcatccagagaaacaccctgaacatcgacaagctgaagatcgagaccgcccaggagctgaagaacgccgagatcgccctgagaacccagaagaccccccccggcctgcagcacgagtacgccgcccccgccgactacttcagaatcctggtgcagcagttcgaggtgcagctgcagcagtacagacagcagatcgaggagctggagaaccacctggccacccaggccaacaacagccacatcaccccccaggacctgagcatggccatgcagaagatctaccagaccttcgtggccctggccgcccagctgcagagcatccacgagaacgtgaaggtgctgaaggagcagtacctgggctacagaaagatgttcctgggcgacgccgtggacgtgttcgagaccagaagagccgaggccaagaagtggcagaacacccccagagtgaccaccggccccacccccttcagcaccatgcccaacgccgccgccgtggccatggccgccaccctgacccagcagcagcagcccgccaccggcccccagcccagcctgggcgtgagcttcggcacccccttcggcagcggcatcggcaccggcctgcagagcagcggcctgggcagcagcaacctgggcggcttcggcaccagcagcggcttcggctgcagcaccaccggcgccagcaccttcggcttcggcaccaccaacaagcccagcggcagcctgagcgccggcttcggcagcagcagcaccagcggcttcaacttcagcaaccccggcatcaccgccagcgccggcctgaccttcggcgtgagcaaccccgccagcgccggcttcggcaccggcggccagctgctgcagctgaagaagccccccgccggcaacaagagaggcaagagatag

SEQ ID NO: 91779 - DNA, 1515 bp, Artificial Sequence
  Description of Artificial Sequence: Synthetic coding sequence
atgagcaccggcttcagcttcggcagcggcaccctgggcagcaccaccgtggccgccggcggcaccagcaccggcggcgtgttcagcttcggcaccggcgccagcagcaaccccagcgtgggcctgaacttcggcaacctgggcagcaccagcacccccgccaccaccagcgcccccagcagcggcttcggcaccggcctgttcggcagcaagcccgccaccggcttcaccctgggcggcaccaacaccggcacccccgccaccaccagcgccgccaccaccggcttcagcctgggcttcaacaagcccgccgccagcgccacccccttcgccctgcccatcaccagcaccagcgccagcggcctgaccctgagcagcgccctgaccagcacccccgccgccagcaccggcttcaccctgaacaacctgggcggcaccaccgccaccaccaccaccgccagcaccggcctgagcctgggcggcgccctggccggcctgggcggcagcctgttccagagcaccaacaccggcaccagcggcctgggccagaacgccctgggcctgaccctgggcaccaccgccgccaccagcaccgccggcaacgagggcctgggcggcatcgacttcagcagcagcagcgacaagaagagcgacaagaccggcaccagacccgaggacagcaaggccctgaaggacgagaacctgccccccgtgatctgccaggacgtggagaacctgcagaagttcgtgaaggagcagaagcaggtgcaggaggagatcagcagaatgagcagcaaggccatgctgaaggtgcaggaggacatcaaggccctgaagcagctgctgagcctggccgccaacggcatccagagaaacaccctgaacatcgacaagctgaagatcgagaccgcccaggagctgaagaacgccgagatcgccctgagaacccagaagaccccccccggcctgcagcacgagtacgccgcccccgccgactacttcagaatcctggtgcagcagttcgaggtgcagctgcagcagtacagacagcagatcgaggagctggagaaccacctggccacccaggccaacaacagccacatcaccccccaggacctgagcatggccatgcagaagatctaccagaccttcgtggccctggccgcccagctgcagagcatccacgagaacgtgaaggtgctgaaggagcagtacctgggctacagaaagatgttcctgggcgacgccgtggacgtgttcgagaccagaagagccgaggccaagaagtggcagaacacccccagagtgaccaccggccccacccccttcagcaccatgcccaacgccgccgccgtggccatggccgccaccctgacccagcagcagcagcccgccaccggcgacaagtggtgcaacgtggccgagctgaagaacagaacccagctgagcctgttcgtgaacaagctggagctgagctgctactgcgtgatcgacctgctgtacaacgagcagtag

SEQ ID NO: 91780 - DNA, 1458 bp, Artificial Sequence
  Description of Artificial Sequence: Synthetic coding sequence
atgagcaccggcttcagcttcggcagcggcaccctgggcagcaccaccgtggccgccggcggcaccagcaccggcggcgtgttcagcttcggcaccggcgccagcagcaaccccagcgtgggcctgaacttcggcaacctgggcagcaccagcacccccgccaccaccagcgcccccagcagcggcttcggcaccggcctgttcggcagcaagcccgccaccggcttcaccctgggcggcaccaacaccggcatcgccaccaccatcaccaccggcctgaccctgggcacccccgccaccaccagcgccgccaccaccggcttcagcctgggcttcaacaagcccgccgccagcgccacccccttcgccctgcccatcaccagcaccagcgccagcggcctgaccctgagcagcgccctgaccagcacccccgccgccagcaccggcttcaccctgaacaacctgggcggcaccaccgccaccaccaccaccgccagcaccggcctgagcctgggcggcgccctggccggcctgggcggcagcctgttccagagcaccaacaccggcaccagcggcctgggccagaacgccctgggcctgaccctgggcaccaccgccgccaccagcaccgccggcaacgagggcctgggcggcatcgacttcagcagcagcagcgacaagaagagcgacaagaccggcaccagacccgaggacagcaaggccctgaaggacgagaacctgccccccgtgatctgccaggacgtggagaacctgcagaagttcgtgaaggagcagaagcaggtgcaggaggagatcagcagaatgagcagcaaggccatgctgaaggtgcaggaggacatcaaggccctgaagcagctgctgagcctggccgccaacggcatccagagaaacaccctgaacatcgacaagctgaagatcgagaccgcccaggagctgaagaacgccgagatcgccctgagaacccagaagaccccccccggcctgcagcacgagtacgccgcccccgccgactacttcagaatcctggtgcagcagttcgaggtgcagctgcagcagtacagacagcagatcgaggagctggagaaccacctggccacccaggccaacaacagccacatcaccccccaggacctgagcatggccatgcagaagatctaccagaccttcgtggccctggccgcccagctgcagagcatccacgagaacgtgaaggtgctgaaggagcagtacctgggctacagaaagatgttcctgggcgacgccgtggacgtgttcgagaccagaagagccgaggccaagaagtggcagaacacccccagagtgaccaccggccccacccccttcagcaccatgcccaacgccgccgccgtggccatggccgccaccctgacccagcagcagcagcccgccaccggcctgaacgccttcaagctgtag

SEQ ID NO: 91781 - DNA, 1308 bp, Artificial Sequence
  Description of Artificial Sequence: Synthetic coding sequence
atgagcggcttcctggaggagctgctgggcgagaagctggtgaccggcggcggcgaggaggtggacgtgcacagcctgggcgccagaggcatcagcctgctgggcctgtacttcggctgcagcctgagcgccccctgcgcccagctgagcgccagcctggccgccttctacggcagactgagaggcgacgccgccgccggccccggccccggcgccggcgccggcgccgccgccgagcccgagcccagaagaagactggagatcgtgttcgtgagcagcgaccaggaccagagacagtggcaggacttcgtgagagacatgccctggctggccctgccctacaaggagaagcacagaaagctgaagctgtggaacaagtacagaatcagcaacatccccagcctgatcttcctggacgccaccaccggcaaggtggtgtgcagaaacggcctgctggtgatcagagacgaccccgagggcctggagttcccctggggccccaagcccttcagagaggtgatcgccggccccctgctgagaaacaacggccagagcctggagagcagcagcctggagggcagccacgtgggcgtgtacttcagcgcccactggtgccccccctgcagaagcctgaccagagtgctggtggagagctacagaaagatcaaggaggccggccagaacttcgagatcatcttcgtgagcgccgacagaagcgaggagagcttcaagcagtacttcagcgagatgccctggctggccgtgccctacaccgacgaggccagaagaagcagactgaacagactgtacggcatccagggcatccccaccctgatcatgctggacccccagggcgaggtgatcaccagacagggcagagtggaggtgctgaacgacgaggactgcagagagttcccctggcaccccaagcccgtgctggagctgagcgacagcaacgccgcccagctgaacgagggcccctgcctggtgctgttcgtggacagcgaggacgacggcgagagcgaggccgccaagcagctgatccagcccatcgccgagaagatcatcgccaagtacaaggccaaggaggaggaggcccccctgctgttcttcgtggccggcgaggacgacatgaccgacagcctgagagactacaccaacctgcccgaggccgcccccctgctgaccatcctggacatgagcgccagagccaagtacgtgatggacgtggaggagatcacccccgccatcgtggaggccttcgtgaacgacttcctggccgagaagctgaagcccgagcccatctag

SEQ ID NO: 91782 - DNA, 984 bp, Artificial Sequence
  Description of Artificial Sequence: Synthetic coding sequence
atggccgacgtgagcctgcacagaaaccccgccaccctgaagctgtggaacaagtacagaatcagcaacatccccagcctgatcttcctggacgccaccaccggcaaggtggtgtgcagaaacggcctgctggtgatcagagacgaccccgagggcctggagttcccctggggccccaagcccttcagagaggtgatcgccggccccctgctgagaaacaacggccagagcctggagagcagcagcctggagggcagccacgtgggcgtgtacttcagcgcccactggtgccccccctgcagaagcctgaccagagtgctggtggagagctacagaaagatcaaggaggccggccagaacttcgagatcatcttcgtgagcgccgacagaagcgaggagagcttcaagcagtacttcagcgagatgccctggctggccgtgccctacaccgacgaggccagaagaagcagactgaacagactgtacggcatccagggcatccccaccctgatcatgctggacccccagggcgaggtgatcaccagacagggcagagtggaggtgctgaacgacgaggactgcagagagttcccctggcaccccaagcccgtgctggagctgagcgacagcaacgccgcccagctgaacgagggcccctgcctggtgctgttcgtggacagcgaggacgacggcgagagcgaggccgccaagcagctgatccagcccatcgccgagaagatcatcgccaagtacaaggccaaggaggaggaggcccccctgctgttcttcgtggccggcgaggacgacatgaccgacagcctgagagactacaccaacctgcccgaggccgcccccctgctgaccatcctggacatgagcgccagagccaagtacgtgatggacgtggaggagatcacccccgccatcgtggaggccttcgtgaacgacttcctggccgagaagctgaagcccgagcccatctag

SEQ ID NO: 91783 - DNA, 381 bp, Artificial Sequence
  Description of Artificial Sequence: Synthetic coding sequence
atgccctggctggccgtgccctacaccgacgaggccagaagaagcagactgaacagactgtacggcatccaggacagcgaggacgacggcgagagcgaggccgccaagcagctgatccagcccatcgccgagaagatcatcgccaagtacaaggccaaggaggaggaggcccccctgctgttcttcgtggccggcgaggacgacatgaccgacagcctgagagactacaccaacctgcccgaggccgcccccctgctgaccatcctggacatgagcgccagagccaagtacgtgatggacgtggaggagatcacccccgccatcgtggaggccttcgtgaacgacttcctggccgagaagctgaagcccgagcccatctag

SEQ ID NO: 91784 - DNA, 984 bp, Artificial Sequence; identical to SEQ ID NO: 91782
  Description of Artificial Sequence: Synthetic coding sequence

SEQ ID NO: 91785 - DNA, 1176 bp, Artificial Sequence
  Description of Artificial Sequence: Synthetic coding sequence
atggccgacatcgacaacaaggagcagagcgagctggaccaggacctggacgacgtggaggaggtggaggaggaggagaccggcgaggagaccaagctgaaggccagacagctgaccgtgcagatgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91786 - DNA, 1176 bp, Artificial Sequence; identical to SEQ ID NO: 91785
  Description of Artificial Sequence: Synthetic coding sequence

SEQ ID NO: 91787 - DNA, 972 bp, Artificial Sequence
  Description of Artificial Sequence: Synthetic coding sequence
atgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaaggaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91788 - DNA, 1050 bp, Artificial Sequence
  Description of Artificial Sequence: Synthetic coding sequence
atgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91789 - DNA, 627 bp, Artificial Sequence
  Description of Artificial Sequence: Synthetic coding sequence
atggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91790 - DNA, 987 bp, Artificial Sequence
  Description of Artificial Sequence: Synthetic coding sequence
atggccgacatcgacaacctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91791 - DNA, 1107 bp, Artificial Sequence
  Description of Artificial Sequence: Synthetic coding sequence
atggccgacatcgacaacaaggagcagagcgagctggaccaggacctggacgacgtggaggaggtggaggaggaggagaccggcgaggagaccaagctgaaggccagacagctgaccgtgcagatgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggtgatgttcaccaagtag

SEQ ID NO: 91792 - DNA, 795 bp, Artificial Sequence
  Description of Artificial Sequence: Synthetic coding sequence
atggccgacatcgacaacaaggagcagagcgagctggaccaggacctggacgacgtggaggaggtggaggaggaggagaccggcgaggagaccaagctgaaggccagacagctgaccgtgcagatgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagtag

SEQ ID NO: 91793 - DNA, 1158 bp, Artificial Sequence
  Description of Artificial Sequence: Synthetic coding sequence
aaggagcagagcgagctggaccaggacctggacgacgtggaggaggtggaggaggaggagaccggcgaggagaccaagctgaaggccagacagctgaccgtgcagatgatgcagaacccccagatcctggccgccctgcaggagagactggacggcctggtggagacccccaccggctacatcgagagcctgcccagagtggtgaagagaagagtgaacgccctgaagaacctgcaggtgaagtgcgcccagatcgaggccaagttctacgaggaggtgcacgacctggagagaaagtacgccgtgctgtaccagcccctgttcgacaagagattcgagatcatcaacgccatctacgagcccaccgaggaggagtgcgagtggaagcccgacgaggaggacgagatcagcgaggagctgaaggagaaggccaagatcgaggacgagaagaaggacgaggagaaggaggaccccaagggcatccccgagttctggctgaccgtgttcaagaacgtggacctgctgagcgacatggtgcaggagcacgacgagcccatcctgaagcacctgaaggacatcaaggtgaagttcagcgacgccggccagcccatgagcttcgtgctggagttccacttcgagcccaacgagtacttcaccaacgaggtgctgaccaagacctacagaatgagaagcgagcccgacgacagcgaccccttcagcttcgacggccccgagatcatgggctgcaccggctgccagatcgactggaagaagggcaagaacgtgaccctgaagaccatcaagaagaagcagaagcacaagggcagaggcaccgtgagaaccgtgaccaagaccgtgagcaacgacagcttcttcaacttcttcgccccccccgaggtgcccgagagcggcgacctggacgacgacgccgaggccatcctggccgccgacttcgagatcggccacttcctgagagagagaatcatccccagaagcgtgctgtacttcaccggcgaggccatcgaggacgacgacgacgactacgacgaggagggcgaggaggccgacgaggagggcgaggaggagggcgacgaggagaacgaccccgactacgaccccaagaaggaccagaaccccgccgagtgcaagcagcagtag

SEQ ID NO: 91794 - DNA, 1521 bp, Artificial Sequence
  Description of Artificial Sequence: Synthetic coding sequence
atggccgaggccgacttcaagatggtgagcgagcccgtggcccacggcgtggccgaggaggagatggccagcagcaccagcgacagcggcgaggagagcgacagcagcagcagcagcagcagcaccagcgacagcagcagcagcagcagcaccagcggcagcagcagcggcagcggcagcagcagcagcagcagcggcagcaccagcagcagaagcagactgtacagaaagaagagagtgcccgagcccagcagaagagccagaagagcccccctgggcaccaacttcgtggacagactgccccaggccgtgagaaacagagtgcaggccctgagaaacatccaggacgagtgcgacaaggtggacaccctgttcctgaaggccatccacgacctggagagaaagtacgccgagctgaacaagcccctgtacgacagaagattccagatcatcaacgccgagtacgagcccaccgaggaggagtgcgagtggaacagcgaggacgaggagttcagcagcgacgaggaggtgcaggacaacacccccagcgagatgccccccctggagggcgaggaggaggagaaccccaaggagaaccccgaggtgaaggccgaggagaaggaggtgcccaaggagatccccgaggtgaaggacgaggagaaggaggtgcccaaggagatccccgaggtgaaggccgaggagaaggccgacagcaaggactgcatggaggccacccccgaggtgaaggaggaccccaaggaggtgccccaggtgaaggccgacgacaaggagcagcccaaggccaccgaggccaaggccagagccgccgtgagagagacccacaagagagtgcccgaggagagactgcaggacagcgtggacctgaagagagccagaaagggcaagcccaagagagaggaccccaagggcatccccgactactggctgatcgtgctgaagaacgtggacaagctgggccccatgatccagaagtacgacgagcccatcctgaagttcctgagcgacgtgagcctgaagttcagcaagcccggccagcccgtgagctacaccttcgagttccacttcctgcccaacccctacttcagaaacgaggtgctggtgaagacctacatcatcaaggccaagcccgaccacaacgaccccttcttcagctggggctgggagatcgaggactgcaagggctgcaagatcgactggagaagaggcaaggacgtgaccgtgaccaccacccagagcagaaccaccgccaccggcgagatcgagatccagcccagagtggtgcccaacgccagcttcttcaacttcttcagcccccccgagatccccatgatcggcaagctggagcccagagaggacgccatcctggacgaggacttcgagatcggccagatcctgcacgacaacgtgatcctgaagagcatctactactacaccggcgaggtgaacggcacctactaccagttcggcaagcactacggcaacaagaagtacagaaagtag

SEQ ID NO: 91795 - DNA, 1500 bp, Artificial Sequence
  Description of Artificial Sequence: Synthetic coding sequence
atggtgagcgagcccgtggcccacggcgtggccgaggaggagatggccagcagcaccagcgacagcggcgaggagagcgacagcagcagcagcagcagcagcaccagcgacagcagcagcagcagcagcaccagcggcagcagcagcggcagcggcagcagcagcagcagcagcggcagcaccagcagcagaagcagactgtacagaaagaagagagtgcccgagcccagcagaagagccagaagagcccccctgggcaccaacttcgtggacagactgccccaggccgtgagaaacagagtgcaggccctgagaaacatccaggacgagtgcgacaaggtggacaccctgttcctgaaggccatccacgacctggagagaaagtacgccgagctgaacaagcccctgtacgacagaagattccagatcatcaacgccgagtacgagcccaccgaggaggagtgcgagtggaacagcgaggacgaggagttcagcagcgacgaggaggtgcaggacaacacccccagcgagatgccccccctggagggcgaggaggaggagaaccccaaggagaaccccgaggtgaaggccgaggagaaggaggtgcccaaggagatccccgaggtgaaggacgaggagaaggaggtgcccaaggagatccccgaggtgaaggccgaggagaaggccgacagcaaggactgcatggaggccacccccgaggtgaaggaggaccccaaggaggtgccccaggtgaaggccgacgacaaggagcagcccaaggccaccgaggccaaggccagagccgccgtgagagagacccacaagagagtgcccgaggagagactgcaggacagcgtggacctgaagagagccagaaagggcaagcccaagagagaggaccccaagggcatccccgactactggctgatcgtgctgaagaacgtggacaagctgggccccatgatccagaagtacgacgagcccatcctgaagttcctgagcgacgtgagcctgaagttcagcaagcccggccagcccgtgagctacaccttcgagttccacttcctgcccaacccctacttcagaaacgaggtgctggtgaagacctacatcatcaaggccaagcccgaccacaacgaccccttcttcagctggggctgggagatcgaggactgcaagggctgcaagatcgactggagaagaggcaaggacgtgaccgtgaccaccacccagagcagaaccaccgccaccggcgagatcgagatccagcccagagtggtgcccaacgccagcttcttcaacttcttcagcccccccgagatccccatgatcggcaagctggagcccagagaggacgccatcctggacgaggacttcgagatcggccagatcctgcacgacaacgtgatcctgaagagcatctactactacaccggcgaggtgaacggcacctactaccagttcggcaagcactacggcaacaagaagtacagaaagtag

SEQ ID NO: 91796 - DNA, 1128 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctggccggcgacatgaagagcaaggtggtggtgaccgagaaggccgccgccaccgccgaggagcccgaccccaagggcatccccgagttctggttcaccatcttcagaaacgtggacatgctgagcgagctggtgcaggagtacgacgagcccatcctgaagcacctgcaggacatcaaggtgaagttcagcgaccccggccagcccatgagcttcgtgctggagttccacttcgagcccaacgactacttcaccaacagcgtgctgaccaagacctacaagatgaagagcgagcccgacaaggccgaccccttcagcttcgagggccccgagatcgtggactgcgacggctgcaccatcgactggaagaagggcaagaacgtgaccgtgaagaccatcaagaagaagcagaagcacaagggcagaggcaccgtgagaaccatcaccaagcaggtgcccaacgagagcttcttcaacttcttcaaccccctgaaggccagcggcgacggcgagagcctggacgaggacagcgagttcaccctggccagcgacttcgagatcggccacttcttcagagagagaatcgtgcccagagccgtgctgtacttcaccggcgaggccatcgaggacgacgacaacttcgaggagggcgaggagggcgaggaggaggagctggagggcgacgaggagggcgaggacgaggacgacgccgagatcaaccccaaggtgtag

SEQ ID NO: 91797 - DNA, 1161 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctggccggcgacatgaagagcaaggtggtggtgaccgagaaggccgccgccaccgccgaggagcccgaccccaagggcatccccgagttctggttcaccatcttcagaaacgtggacatgctgagcgagctggtgcaggagtacgacgagcccatcctgaagcacctgcaggacatcaaggtgaagttcagcgaccccggccagcccatgagcttcgtgctggagttccacttcgagcccaacgactacttcaccaacagcgtgctgaccaagacctacaagatgaagagcgagcccgacaaggccgaccccttcagcttcgagggccccgagatcgtggactgcgacggctgcaccatcgactggaagaagggcaagaacgtgaccgtgaagaccatcaagaagaagcagaagcacaagggcagaggcaccgtgagaaccatcaccaagcaggtgcccaacgagagcttcttcaacttcttcaaccccctgaagggcaagggccagagcaagagcaaggacgaggacagcgagttcaccctggccagcgacttcgagatcggccacttcttcagagagagaatcgtgcccagagccgtgctgtacttcaccggcgaggccatcgaggacgacgacaacttcgaggagggcgaggagggcgaggaggaggagctggagggcgacgaggagggcgaggacgaggacgacgccgagatcaaccccaagaaggagcccagccagcccgccgagtgcaagcagcagtag

SEQ ID NO: 91798 - DNA, 537 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctggccggcgacatgaagagcaaggtggtggtgaccgagaaggccgccgccaccgccgaggagcccgaccccaagggcatccccgagttctggttcaccatcttcagaaacgtggacatgctgagcgagctggtgcagtag

SEQ ID NO: 91799 - DNA, 1161 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctggccggcgacatgaagagcaaggtggtggtgaccgagaaggccgccgccaccgccgaggagcccgaccccaagggcatccccgagttctggttcaccatcttcagaaacgtggacatgctgagcgagctggtgcaggagtacgacgagcccatcctgaagcacctgcaggacatcaaggtgaagttcagcgaccccggccagcccatgagcttcgtgctggagttccacttcgagcccaacgactacttcaccaacagcgtgctgaccaagacctacaagatgaagagcgagcccgacaaggccgaccccttcagcttcgagggccccgagatcgtggactgcgacggctgcaccatcgactggaagaagggcaagaacgtgaccgtgaagaccatcaagaagaagcagaagcacaagggcagaggcaccgtgagaaccatcaccaagcaggtgcccaacgagagcttcttcaacttcttcaaccccctgaaggccagcggcgacggcgagagcctggacgaggacagcgagttcaccctggccagcgacttcgagatcggccacttcttcagagagagaatcgtgcccagagccgtgctgtacttcaccggcgaggccatcgaggacgacgacaacttcgaggagggcgaggagggcgaggaggaggagctggagggcgacgaggagggcgaggacgaggacgacgccgagatcaaccccaagaaggagcccagccagcccgccgagtgcaagcagcagtag

SEQ ID NO: 91800 - DNA, 387 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgagtag

SEQ ID NO: 91801 - DNA, 423 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctggccggcgacatgaagagcaagtag

SEQ ID NO: 91802 - DNA, 402 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagagagttcatcaccggcgacgtggagcccaccgacgccgagagcgagtggcacagcgagaacgaggaggaggagaagctgtag

SEQ ID NO: 91803 - DNA, 324 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcccacatcgaggccaagttctacgaggaggtgcacgacctggagagaaagtacgccgccctgtaccagcccctgttcgacaagagaagatag

SEQ ID NO: 91804 - DNA, 237 bp, Artificial Sequence
  Description of Artificial Sequence: Synthetic coding sequence
atggccgaccacagcttcagcgacggcgtgcccagcgacagcgtggaggccgccaagaacgccagcaacaccgagaagctgaccgaccaggtgatgcagaaccccagagtgctggccgccctgcaggagagactggacaacgtgccccacacccccagcagctacatcgagaccctgcccaaggccgtgaagagaagaatcaacgccctgaagcagctgcaggtgagatgcgcctag

SEQ ID NO: 91805 - DNA, 549 bp, Artificial Sequence
  Description of Artificial Sequence: Synthetic coding sequence
atggccgacagcgagaaccagggccccgccgagcccagccaggccgccgccgccgccgaggccgccgccgaggaggtgatggccgagggcggcgcccagggcggcgactgcgacagcgccgccggcgaccccgacagcgccgccggccagatggccgaggagccccagacccccgccgagaacgcccccaagcccaagaacgacttcatcgagagcctgcccaacagcgtgaagtgcagagtgctggccctgaagaagctgcagaagagatgcgacaagatcgaggccaagttcgacaaggagttccaggccctggagaagaagtacaacgacatctacaagcccctgctggccaagatccaggagctgaccggcgagatggagggctgcgcctggaccctggagggcgaggaggaggaggaggaggagtacgaggacgacgaggaggagggcgaggacgaggaggaggaggaggccgccgccgaggccgccgccggcgccaagcacgacgacgcccacgccgagatgcccgacgacgccaagaagtag

SEQ ID NO: 91806 - DNA, 438 bp, Artificial Sequence
  Description of Artificial Sequence: Synthetic coding sequence
atggccgacagcgagaaccagggccccgccgagcccagccaggccgccgccgccgccgaggccgccgccgaggaggtgatggccgagggcggcgcccagggcggcgactgcgacagcgccgccggcgaccccgacagcgccgccggccagatggccgaggagccccagacccccgccgagaacgcccccaagcccaagaacgacttcatcgagagcctgcccaacagcgtgaagtgcagagtgctggccctgaagaagctgcagaagagatgcgacaagatcgaggccaagttcgacaaggagttccaggccctggagaagaagtacaacgacatctacaagcccctgctggccaagatccaggagctgaccggcgagatggagggctgcgcctggaccctggagggcgaggagagaagaaagagagtgagaggctag

SEQ ID NO: 91807 - DNA, 963 bp, Artificial Sequence
  Description of Artificial Sequence: Synthetic coding sequence
atggaggaggtgccccacgactgccccggcgccgacagcgcccaggccggcagaggcgccagctgccagggctgccccaaccagagactgtgcgccagcggcgccggcgccacccccgacaccgccatcgaggagatcaaggagaagatgaagaccgtgaagcacaagatcctggtgctgagcggcaagggcggcgtgggcaagagcaccttcagcgcccacctggcccacggcctggccgaggacgagaacacccagatcgccctgctggacatcgacatctgcggccccagcatccccaagatcatgggcctggagggcgagcaggtgcaccagagcggcagcggctggagccccgtgtacgtggaggacaacctgggcgtgatgagcgtgggcttcctgctgagcagccccgacgacgccgtgatctggagaggccccaagaagaacggcatgatcaagcagttcctgagagacgtggactggggcgaggtggactacctgatcgtggacaccccccccggcaccagcgacgagcacctgagcgtggtgagatacctggccaccgcccacatcgacggcgccgtgatcatcaccaccccccaggaggtgagcctgcaggacgtgagaaaggagatcaacttctgcagaaaggtgaagctgcccatcatcggcgtggtggagaacatgagcggcttcatctgccccaagtgcaagaaggagagccagatcttcccccccaccaccggcggcgccgagctgatgtgccaggacctggaggtgcccctgctgggcagagtgcccctggaccccctgatcggcaagaactgcgacaagggccagagcttcttcatcgacgcccccgacagccccgccaccctggcctacagaagcatcatccagagaatccaggagttctgcaacctgcaccagagcaaggaggagaacctgatcagcagctag

SEQ ID NO: 91808 - DNA, 930 bp, Artificial Sequence
  Description of Artificial Sequence: Synthetic coding sequence
atggaggaggtgccccacgactgccccggcgccgacagcgcccaggccggcagaggcgccagctgccagggctgccccaaccagagactgtgcgccagcggcgccggcgccacccccgacaccgccatcgaggagatcaaggagaagatgaagaccgtgaagcacaagatcctggtgctgagcggcaagggcggcgtgggcaagagcaccttcagcgcccacctggcccacggcctggccgaggacgagaacacccagatcgccctgctggacatcgacatctgcggccccagcatccccaagatcatgggcctggagggcgagcagtacgtggaggacaacctgggcgtgatgagcgtgggcttcctgctgagcagccccgacgacgccgtgatctggagaggccccaagaagaacggcatgatcaagcagttcctgagagacgtggactggggcgaggtggactacctgatcgtggacaccccccccggcaccagcgacgagcacctgagcgtggtgagatacctggccaccgcccacatcgacggcgccgtgatcatcaccaccccccaggaggtgagcctgcaggacgtgagaaaggagatcaacttctgcagaaaggtgaagctgcccatcatcggcgtggtggagaacatgagcggcttcatctgccccaagtgcaagaaggagagccagatcttcccccccaccaccggcggcgccgagctgatgtgccaggacctggaggtgcccctgctgggcagagtgcccctggaccccctgatcggcaagaactgcgacaagggccagagcttcttcatcgacgcccccgacagccccgccaccctggcctacagaagcatcatccagagaatccaggagttctgcaacctgcaccagagcaaggaggagaacctgatcagcagctag

SEQ ID NO: 91809 - DNA, 816 bp, Artificial Sequence
  Description of Artificial Sequence: Synthetic coding sequence
atggaggccgccgccgagcccggcaacctggccggcgtgagacacatcatcctggtgctgagcggcaagggcggcgtgggcaagagcaccatcagcaccgagctggccctggccctgagacacgccggcaagaaggtgggcatcctggacgtggacctgtgcggccccagcatccccagaatgctgggcgcccagggcagagccgtgcaccagtgcgacagaggctgggcccccgtgttcctggacagagagcagagcatcagcctgatgagcgtgggcttcctgctggagaagcccgacgaggccgtggtgtggagaggccccaagaagaacgccctgatcaagcagttcgtgagcgacgtggcctggggcgagctggactacctggtggtggacaccccccccggcaccagcgacgagcacatggccaccatcgaggccctgagaccctaccagcccctgggcgccctggtggtgaccaccccccaggccgtgagcgtgggcgacgtgagaagagagctgaccttctgcagaaagaccggcctgagagtgatgggcatcgtggagaacatgagcggcttcacctgcccccactgcaccgagtgcaccagcgtgttcagcagaggcggcggcgaggagctggcccagctggccggcgtgcccttcctgggcagcgtgcccctggaccccgccctgatgagaaccctggaggagggccacgacttcatccaggagttccccggcagccccgccttcgccgccctgaccagcatcgcccagaagatcctggacgccacccccgcctgcctgccctag

SEQ ID NO: 91810 - DNA, 393 bp, Artificial Sequence
  Description of Artificial Sequence: Synthetic coding sequence
atggccaccatcgaggccctgagaccctaccagcccctgggcgccctggtggtgaccaccccccaggccgtgagcgtgggcgacgtgagaagagagctgaccttctgcagaaagaccggcctgagagtgatgggcatcgtggagaacatgagcggcttcacctgcccccactgcaccgagtgcaccagcgtgttcagcagaggcggcggcgaggagctggcccagctggccggcgtgcccttcctgggcagcgtgcccctggaccccgccctgatgagaaccctggaggagggccacgacttcatccaggagttccccggcagccccgccttcgccgccctgaccagcatcgcccagaagatcctggacgccacccccgcctgcctgccctag

SEQ ID NO: 91811 - DNA, 960 bp, Artificial Sequence
  Description of Artificial Sequence: Synthetic coding sequence
atgggcatctggcagagactgctgctgttcggcggcgtgagcctgagagccggcggcggcgccaccgcccccctgggcggcagcagagccatggtgtgcggcagacagctgagcggcgccggcagcgagaccctgaagcagagaagaacccagatcatgagcagaggcctgcccaagcagaagcccatcgagggcgtgaagcaggtgatcgtggtggccagcggcaagggcggcgtgggcaagagcaccaccgccgtgaacctggccctggccctggccgccaacgacagcagcaaggccatcggcctgctggacgtggacgtgtacggccccagcgtgcccaagatgatgaacctgaagggcaaccccgagctgagccagagcaacctgatgagacccctgctgaactacggcatcgcctgcatgagcatgggcttcctggtggaggagagcgagcccgtggtgtggagaggcctgatggtgatgagcgccatcgagaagctgctgagacaggtggactggggccagctggactacctggtggtggacatgccccccggcaccggcgacgtgcagctgagcgtgagccagaacatccccatcaccggcgccgtgatcgtgagcaccccccaggacatcgccctgatggacgcccacaagggcgccgagatgttcagaagagtgcacgtgcccgtgctgggcctggtgcagaacatgagcgtgttccagtgccccaagtgcaagcacaagacccacatcttcggcgccgacggcgccagaaagctggcccagaccctgggcctggaggtgctgggcgacatccccctgcacctgaacatcagagaggccagcgacaccggccagcccatcgtgttcagccagcccgagagcgacgaggccaaggcctacctgagaatcgccgtggaggtggtgagaagactgcccagccccagcgagtag

SEQ ID NO: 91812 - DNA, 672 bp, Artificial Sequence
  Description of Artificial Sequence: Synthetic coding sequence
atgagcaaggccatcggcctgctggacgtggacgtgtacggccccagcgtgcccaagatgatgaacctgaagggcaaccccgagctgagccagagcaacctgatgagacccctgctgaactacggcatcgcctgcatgagcatgggcttcctggtggaggagagcgagcccgtggtgtggagaggcctgatggtgatgagcgccatcgagaagctgctgagacaggtggactggggccagctggactacctggtggtggacatgccccccggcaccggcgacgtgcagctgagcgtgagccagaacatccccatcaccggcgccgtgatcgtgagcaccccccaggacatcgccctgatggacgcccacaagggcgccgagatgttcagaagagtgcacgtgcccgtgctgggcctggtgcagaacatgagcgtgttccagtgccccaagtgcaagcacaagacccacatcttcggcgccgacggcgccagaaagctggcccagaccctgggcctggaggtgctgggcgacatccccctgcacctgaacatcagagaggccagcgacaccggccagcccatcgtgttcagccagcccgagagcgacgaggccaaggcctacctgagaatcgccgtggaggtggtgagaagactgcccagccccagcgagtag

SEQ ID NO: 91813 - DNA, 3123 bp, Artificial Sequence
  Description of Artificial Sequence: Synthetic coding sequence
atgggcgaggagggcggcagcgccagccacgacgaggaggagagagccagcgtgctgctgggccacagccccggctgcgagatgtgcagccaggaggccttccaggcccagagaagccagctggtggagctgctggtgagcggcagcctggagggcttcgagagcgtgctggactggctgctgagctgggaggtgctgagctgggaggactacgagggcttccacctgctgggccagcccctgagccacctggccagaagactgctggacaccgtgtggaacaagggcacctgggcctgccagaagctgatcgccgccgcccaggaggcccaggccgacagccagagccccaagctgcacggctgctgggacccccacagcctgcaccccgccagagacctgcagagccacagacccgccatcgtgagaagactgcacagccacgtggagaacatgctggacctggcctgggagagaggcttcgtgagccagtacgagtgcgacgagatcagactgcccatcttcacccccagccagagagccagaagactgctggacctggccaccgtgaaggccaacggcctggccgccttcctgctgcagcacgtgcaggagctgcccgtgcccctggccctgcccctggaggccgccacctgcaagaagtacatggccaagctgagaaccaccgtgagcgcccagagcagattcctgagcacctacgacggcgccgagaccctgtgcctggaggacatctacaccgagaacgtgctggaggtgtgggccgacgtgggcatggccggccccccccagaagagccccgccaccctgggcctggaggagctgttcagcacccccggccacctgaacgacgacgccgacaccgtgctggtggtgggcgaggccggcagcggcaagagcaccctgctgcagagactgcacctgctgtgggccgccggccaggacttccaggagttcctgttcgtgttccccttcagctgcagacagctgcagtgcatggccaagcccctgagcgtgagaaccctgctgttcgagcactgctgctggcccgacgtgggccaggaggacatcttccagctgctgctggaccaccccgacagagtgctgctgaccttcgacggcttcgacgagttcaagttcagattcaccgacagagagagacactgcagccccaccgaccccaccagcgtgcagaccctgctgttcaacctgctgcagggcaacctgctgaagaacgccagaaaggtggtgaccagcagacccgccgccgtgagcgccttcctgagaaagtacatcagaaccgagttcaacctgaagggcttcagcgagcagggcatcgagctgtacctgagaaagagacaccacgagcccggcgtggccgacagactgatcagactgctgcaggagaccagcgccctgcacggcctgtgccacctgcccgtgttcagctggatggtgagcaagtgccaccaggagctgctgctgcaggagggcggcagccccaagaccaccaccgacatgtacctgctgatcctgcagcacttcctgctgcacgccaccccccccgacagcgccagccagggcctgggccccagcctgctgagaggcagactgcccaccctgctgcacctgggcagactggccctgtggggcctgggcatgtgctgctacgtgttcagcgcccagcagctgcaggccgcccaggtgagccccgacgacatcagcctgggcttcctggtgagagccaagggcgtggtgcccggcagcaccgcccccctggagttcctgcacatcaccttccagtgcttcttcgccgccttctacctggccctgagcgccgacgtgccccccgccctgctgagacacctgttcaactgcggcagacccggcaacagccccatggccagactgctgcccaccatgtgcatccaggccagcgagggcaaggacagcagcgtggccgccctgctgcagaaggccgagccccacaacctgcagatcaccgccgccttcctggccggcctgctgagcagagagcactggggcctgctggccgagtgccagaccagcgagaaggccctgctgagaagacaggcctgcgccagatggtgcctggccagaagcctgagaaagcacttccacagcatcccccccgccgcccccggcgaggccaagagcgtgcacgccatgcccggcttcatctggctgatcagaagcctgtacgagatgcaggaggagagactggccagaaaggccgccagaggcctgaacgtgggccacctgaagctgaccttctgcagcgtgggccccaccgagtgcgccgccctggccttcgtgctgcagcacctgagaagacccgtggccctgcagctggactacaacagcgtgggcgacatcggcgtggagcagctgctgccctgcctgggcgtgtgcaaggccctgtacctgagagacaacaacatcagcgacagaggcatctgcaagctgatcgagtgcgccctgcactgcgagcagctgcagaagctggccctgttcaacaacaagctgaccgacggctgcgcccacagcatggccaagctgctggcctgcagacagaacttcctggccctgagactgggcaacaactacatcaccgccgccggcgcccaggtgctggccgagggcctgagaggcaacaccagcctgcagttcctgggcttctggggcaacagagtgggcgacgagggcgcccaggccctggccgaggccctgggcgaccaccagagcctgagatggctgagcctggtgggcaacaacatcggcagcgtgggcgcccaggccctggccctgatgctggccaagaacgtgatgctggaggagctgtgcctggaggagaaccacctgcaggacgagggcgtgtgcagcctggccgagggcctgaagaagaacagcagcctgaagatcctgaagctgagcaacaactgcatcacctacctgggcgccgaggccctgctgcaggccctggagagaaacgacaccatcctggaggtgtggctgagaggcaacaccttcagcctggaggaggtggacaagctgggctgcagagacaccagactgctgctgtag

SEQ ID NO: 91814 - DNA, 543 bp, Artificial Sequence
  Description of Artificial Sequence: Synthetic coding sequence
atgtggctgctgccccccggccaggtgttcaacgccttcttccccagcagactgggcaacaactacatcaccgccgccggcgcccaggtgctggccgagggcctgagaggcaacaccagcctgcagttcctgggcttctggggcaacagagtgggcgacgagggcgcccaggccctggccgaggccctgggcgaccaccagagcctgagatggctgagcctggtgggcaacaacatcggcagcgtgggcgcccaggccctggccctgatgctggccaagaacgtgatgctggaggagctgtgcctggaggagaaccacctgcaggacgagggcgtgtgcagcctggccgagggcctgaagaagaacagcagcctgaagatcctgaagctgagcaacaactgcatcacctacctgggcgccgaggccctgctgcaggccctggagagaaacgacaccatcctggaggtgtggctgagaggcaacaccttcagcctggaggaggtggacaagctgggctgcagagacaccagactgctgctgtag

SEQ ID NO: 91815 - DNA, 1008 bp, Artificial Sequence
  Description of Artificial Sequence: Synthetic coding sequence
atggaggacagcggcaagaccttcagcagcgaggaggaggaggccaactactggaaggacctggccatgacctacaagcagagagccgagaacacccaggaggagctgagagagttccaggagggcagcagagagtacgaggccgagctggagacccagctgcagcagatcgagaccagaaacagagacctgctgagcgagaacaacagactgagaatggagctggagaccatcaaggagaagttcgaggtgcagcacagcgagggctacagacagatcagcgccctggaggacgacctggcccagaccaaggccatcaaggaccagctgcagaagtacatcagagagctggagcaggccaacgacgacctggagagagccaagagagccaccatcatgagcctggaggacttcgagcagagactgaaccaggccatcgagagaaacgccttcctggagagcgagctggacgagaaggagaacctgctggagagcgtgcagagactgaaggacgaggccagagacctgagacaggagctggccgtgcagcagaagcaggagaagcccagaacccccatgcccagcagcgtggaggccgagagaaccgacaccgccgtgcaggccaccggcagcgtgcccagcacccccatcgcccacagaggccccagcagcagcctgaacacccccggcagcttcagaagaggcctggacgacagcaccggcggcacccccctgacccccgccgccagaatcagcgccctgaacatcgtgggcgacctgctgagaaaggtgggcgccctggagagcaagctggccagctgcagaaacctggtgtacgaccagagccccaacagaaccggcggccccgccagcggcagaagcagcaagaacagagacggcggcgagagaagacccagcagcaccagcgtgcccctgggcgacaagggcctggacaccagctgcagatggctgagcaagagcaccaccagaagcagcagcagctgctag

SEQ ID NO: 91816 - DNA, 1041 bp, Artificial Sequence
  Description of Artificial Sequence: Synthetic coding sequence
atggaggacagcggcaagaccttcagcagcgaggaggaggaggccaactactggaaggacctggccatgacctacaagcagagagccgagaacacccaggaggagctgagagagttccaggagggcagcagagagtacgaggccgagctggagacccagctgcagcagatcgagaccagaaacagagacctgctgagcgagaacaacagactgagaatggagctggagaccatcaaggagaagttcgaggtgcagcacagcgagggctacagacagatcagcgccctggaggacgacctggcccagaccaaggccatcaaggaccagctgcagaagtacatcagagagctggagcaggccaacgacgacctggagagagccaagagagccaccatcatgagcctggaggacttcgagcagagactgaaccaggccatcgagagaaacgccttcctggagagcgagctggacgagaaggagaacctgctggagagcgtgcagagactgaaggacgaggccagagacctgagacaggagctggccgtgcagcagaagcaggagaagcccagaacccccatgcccagcagcgtggaggccgagagaaccgacaccgccgtgcaggccaccggcagcgtgcccagcacccccatcgcccacagaggccccagcagcagcctgaacacccccggcagcttcagaagaggcctggacgacagcaccggcggcacccccctgacccccgccgccagaatcagcgccctgaacatcgtgggcgacctgctgagaaaggtgggcgccctggagagcaagctggccagctgcagaaacctggtgtacgaccagagccccaacagaaccggcggccccgccagcggcagaagcagcaagaacagagacggcggcgagagaagacccagcagcaccagcgtgcccctgggcgacaagggcctgggcaagagactggagttcggcaagccccccagccacatgagcagcagccccctgcccagcgcccagggcgtggtgaagatgctgctgtag

SEQ ID NO: 91817 - DNA, 1008 bp, Artificial Sequence; identical to SEQ ID NO: 91815
  Description of Artificial Sequence: Synthetic coding sequence

SEQ ID NO: 91818 - DNA, 1008 bp, Artificial Sequence; identical to SEQ ID NO: 91815
  Description of Artificial Sequence: Synthetic coding sequence

SEQ ID NO: 91819 - DNA, 471 bp, Artificial Sequence
  Description of Artificial Sequence: Synthetic coding sequence
atgggcgccagcagactgtacaccctggtgctggtgctgcagccccagagagtgctgctgggcatgaagaagagaggcttcggcgccggcagatggaacggcttcggcggcaaggtgcaggagggcgagaccatcgaggacggcgccagaagagagctgcaggaggagagcggcctgaccgtggacgccctgcacaaggtgggccagatcgtgttcgagttcgtgggcgagcccgagctgatggacgtgcacgtgttctgcaccgacagcatccagggcacccccgtggagagcgacgagatgagaccctgctggttccagctggaccagatccccttcaaggacatgtggcccgacgacagctactggttccccctgctgctgcagaagaagaagttccacggctacttcaagttccagggccaggacaccatcctggactacaccctgagagaggtggacaccgtgtag

SEQ ID NO: 91820 - DNA, 540 bp, Artificial Sequence
  Description of Artificial Sequence: Synthetic coding sequence
atgagcggcatcagcccccagcagatgggcgagcccgagggcagctggagcggcaagaaccccggcaccatgggcgccagcagactgtacaccctggtgctggtgctgcagccccagagagtgctgctgggcatgaagaagagaggcttcggcgccggcagatggaacggcttcggcggcaaggtgcaggagggcgagaccatcgaggacggcgccagaagagagctgcaggaggagagcggcctgaccgtggacgccctgcacaaggtgggccagatcgtgttcgagttcgtgggcgagcccgagctgatggacgtgcacgtgttctgcaccgacagcatccagggcacccccgtggagagcgacgagatgagaccctgctggttccagctggaccagatccccttcaaggacatgtggcccgacgacagctactggttccccctgctgctgcagaagaagaagttccacggctacttcaagttccagggccaggacaccatcctggactacaccctgagagaggtggacaccgtgtag

SEQ ID NO: 91821 - DNA, 471 bp, Artificial Sequence; identical to SEQ ID NO: 91819
  Description of Artificial Sequence: Synthetic coding sequence

SEQ ID NO: 91822 - DNA, 471 bp, Artificial Sequence; identical to SEQ ID NO: 91819
  Description of Artificial Sequence: Synthetic coding sequence

SEQ ID NO: 91823 - DNA, 540 bp, Artificial Sequence; identical to SEQ ID NO: 91820
  Description of Artificial Sequence: Synthetic coding sequence

SEQ ID NO: 91824 - DNA, 540 bp, Artificial Sequence; identical to SEQ ID NO: 91820
  Description of Artificial Sequence: Synthetic coding sequence

SEQ ID NO: 91825 - DNA, 114 bp, Artificial Sequence
  Description of Artificial Sequence: Synthetic coding sequence
atgggcgccagcagactgtacaccctggtgctggtgctgcagccccagagagtgctgctgggcatgaagaagagaggcttcggcgccggcagatggaacggcttcggcggctag

SEQ ID NO: 91826 - DNA, 495 bp, Artificial Sequence
  Description of Artificial Sequence: Synthetic coding sequence
atgaagtgcaagcccaaccagaccagaacctacgaccccgagggcttcaagaagagagccgcctgcctgtgcttcagaagcgagagagaggacgaggtgctgctggtgagcagcagcagataccccgacagatggatcgtgcccggcggcggcatggagcccgaggaggagcccggcggcgccgccgtgagagaggtgtacgaggaggccggcgtgaagggcaagctgggcagactgctgggcgtgttcgagcagaaccaggaccccaagcacagaacctacgtgtacgtgctgaccgtgaccgagctgctggaggactgggaggacagcgtgagcatcggcagaaagagagagtggttcaaggtggaggacgccatcaaggtgctgcagtgccacaagcccgtgcacgccgagtacctggagaagctgaagctgggcggcagccccaccaacggcaacagcatggcccccagcagccccgacagcgacccctag

SEQ ID NO: 91827 - DNA, 495 bp, Artificial Sequence; identical to SEQ ID NO: 91826
  Description of Artificial Sequence: Synthetic coding sequence

SEQ ID NO: 91828 - DNA, 444 bp, Artificial Sequence
  Description of Artificial Sequence: Synthetic coding sequence
atggccctgagagcctgcggcctgatcatcttcagaagatgcctgatccccaaggtggacaacaacgccatcgagttcctgctgctgcaggccagcgacggcatccaccactggaccccccccaagggccacgtggagcccggcgaggacgacctggagaccgccctgagagagacccaggaggaggccggcatcgaggccggccagctgaccatcatcgagggcttcaagagagagctgaactacgtggccagaaacaagcccaagaccgtgatctactggctggccgaggtgaaggactacgacgtggagatcagactgagccacgagcaccaggcctacagatggctgggcctggaggaggcctgccagctggcccagttcaaggagatgaaggccgccctgcaggagggccaccagttcctgtgcagcatcgaggcctag

SEQ ID NO: 91829 - DNA, 444 bp, Artificial Sequence; identical to SEQ ID NO: 91828
  Description of Artificial Sequence: Synthetic coding sequence

SEQ ID NO: 91830 - DNA, 444 bp, Artificial Sequence; identical to SEQ ID NO: 91828
  Description of Artificial Sequence: Synthetic coding sequence

SEQ ID NO: 91831 - DNA, 444 bp, Artificial Sequence; identical to SEQ ID NO: 91828
  Description of Artificial Sequence: Synthetic coding sequence

SEQ ID NO: 91832 - DNA, 444 bp, Artificial Sequence; identical to SEQ ID NO: 91828
  Description of Artificial Sequence: Synthetic coding sequence

SEQ ID NO: 91833 - DNA, 1395 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatcatcaacttcatccacttcagagaggcctgcagagagacctacatggagttcctgtggcagtacaagagcagcgccgacaagatgcagcagctgaacgccgcccaccaggaggccctgatgaagctggagagactggacagcgtgcccgtggaggagcaggaggagttcaagcagctgagcgacggcatccaggagctgcagcagagcctgaaccaggacttccaccagaagaccatcgtgctgcaggagggcaacagccagaagaagagcaacatcagcgagaagaccaagagactgaacgagctgaagctgagcgtggtgagcctgaaggagatccaggagagcctgaagaccaagatcgtggacagccccgagaagctgaagaactacaaggagaagatgaaggacaccgtgcagaagctgaagaacgccagacaggaggtggtggagaagtacgagatctacggcgacagcgtggactgcctgcccagctgccagctggaggtgcagctgtaccagaagaagatccaggacctgagcgacaacagagagaagctggccagcatcctgaaggagagcctgaacctggaggaccagatcgagagcgacgagagcgagctgaagaagctgaagaccgaggagaacagcttcaagagactgatgatcgtgaagaaggagaagctggccaccgcccagttcaagatcaacaagaagcacgaggacgtgaagcagtacaagagaaccgtgatcgaggactgcaacaaggtgcaggagaagagaggcgccgtgtacgagagagtgaccaccatcaaccaggagatccagaagatcaagctgggcatccagcagctgaaggacgccgccgagagagagaagctgaagagccaggagatcttcctgaacctgaagaccgccctggagaagtaccacgacggcatcgagaaggccgccgaggacagctacgccaagatcgacgagaagaccgccgagctgaagagaaagatgttcaagatgagcacctag

SEQ ID NO: 91834 - DNA, 1395 bp, Artificial Sequence; identical to SEQ ID NO: 91833
  Description of Artificial Sequence: Synthetic coding sequence

SEQ ID NO: 91835 - DNA, 609 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatcatcaacttcatccacttcagagaggcctgcagagagacctacatggagttcctgtggcagtacaagagcagcgccgacaagatgcagcagctgaacgccgcccaccaggaggccctgatgaagctggagagactggacagcgtgcccgtggaggagcaggaggagttcaagcagctgagcgacggcatccaggagctgcagcagagcctgaaccaggacttccaccagaagacctag

SEQ ID NO: 91836 - DNA, 438 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatcatcaacttcatccacttcagagaggcctgcagagagacctacatggagttcctgtggcagtactag

SEQ ID NO: 91837 - DNA, 666 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatcatcaacttcatccacttcagagaggcctgcagagagacctacatggagttcctgtggcagtacaagagcagcgccgacaagatgcagcagctgaacgccgcccaccaggaggccctgatgaagctggagagactggacagcgtgcccgtggaggagcaggaggagttcaagcagctgagcgacggcatccaggagctgcagcagagcctgaaccaggacttccaccagaagacctgctgcaagagagagatccccaagagaagccagatcttccagagaaagcccagcgtgtag

SEQ ID NO: 91838 - DNA, 1254 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatcatcaacttcatccacttcagagaggcctgcagagagacctacatggagttcctgtggcagtacaagagcagcgccgacaagatgcagcagctgaacgccgcccaccaggaggccctgatgaagctggagagactggacagcgtgcccgtggaggagcaggaggagttcaagcagctgagcgacggcatccaggagctgcagcagagcctgaaccaggacttccaccagaagaccatcgtgctgcaggagggcaacagccagaagaagagcaacatcagcgagaagaccaagagactgaacgagctgaagctgagcgtggtgagcctgaaggagatccaggagagcctgaagaccaagatcgtggacagccccgagaagctgaagaactacaaggagaagatgaaggacaccgtgcagaagctgaagaacgccagaagcctgaacctggaggaccagatcgagagcgacgagagcgagctgaagaagctgaagaccgaggagaacagcttcaagagactgatgatcgtgaagaaggagaagctggccaccgcccagttcaagatcaacaagaagcacgaggacgtgaagcagtacaagagaaccgtgatcgaggactgcaacaaggtgcaggagaagagaggcgccgtgtacgagagagtgaccaccatcaaccaggagatccagaagatcaagctgggcatccagcagctgaaggacgccgccgagagagagaagctgaagagccaggagatcttcctgaacctgaagaccgccctggagaagtaccacgacggcatcgagaaggccgccgaggacagctacgccaagatcgacgagaagaccgccgagctgaagagaaagatgttcaagatgagcacctag

SEQ ID NO: 91839 - DNA, 375 bp, Artificial Sequence
  Description of Artificial Sequence: Synthetic coding sequence
atggagaccctgagcttccccagatacaacgtggccgagatcgtgatccacatcagaaacaagatcctgaccggcgccgacggcaagaacctgaccaagaacgacctgtaccccaaccccaagcccgaggtgctgcacatgatctacatgagagccctgcagatcgtgtacggcatcagactggagcacttctacatgatgcccgtgaacagcgaggtgatgtacccccacctgatggagggcttcctgcccttcagcaacctggtgacccacctggacagcttcctgcccatctgcagagtgaacgacttcgagaccgccgacatcctgtgccccaaggccaagagaaccagcagattcctgagcggcatctag

SEQ ID NO: 91840 - DNA, 702 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccccacgccatccccagaagacacgcccccatcgagtag

SEQ ID NO: 91841 - DNA, 1956 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccgagagaaagttcttcaagggcttcttcggcaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccccacgccatccccagaagacacgcccccatcgagcagctggccagacagggcagcttcagaggcttccccgccctgagccagaagatgagccccttcaagagacagctgagcctgagaatcaacgagctgcccagcaccatgcagagaaagaccgacttccccatcaagaacgccgtgcccgaggtggagggcgaggccgagagcatcagcagcctgtgcagccagatcaccaacgccttcagcacccccgaggaccccttcagcagcgcccccatgaccaagcccgtgaccgtggtggccccccagagccccaccttccaggccaacggcaccgacagcgccttccacgtgctggccaagcccgcccacaccgccctggcccccgtggccatgcccgtgagagagaccaacccctgggcccacgcccccgacgccgccaacaaggagatcgccgccacctgcagcggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91842 - DNA, 1812 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccgagagaaagttcttcaagggcttcttcggcaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccccacgccatccccagaagacacgcccccatcgagcagctggccagacagggcagcttcagaggcttccccgccctgagccagaagatgagccccttcaagagacagctgagcctgagaatcaacgagctgcccagcaccatgcagagaaagaccgacttccccatcaagaacgccgtgcccgaggtggagggcgaggccgagagcatcagcagcctgtgcagccagatcaccaacgccttcagcacccccgaggaccccttcagcagcgcccccatgaccaagcccgtgaccgtggtggccccccagagccccaccttccagggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91843 - DNA, 1923 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccccacgccatccccagaagacacgcccccatcgagcagctggccagacagggcagcttcagaggcttccccgccctgagccagaagatgagccccttcaagagacagctgagcctgagaatcaacgagctgcccagcaccatgcagagaaagaccgacttccccatcaagaacgccgtgcccgaggtggagggcgaggccgagagcatcagcagcctgtgcagccagatcaccaacgccttcagcacccccgaggaccccttcagcagcgcccccatgaccaagcccgtgaccgtggtggccccccagagccccaccttccaggccaacggcaccgacagcgccttccacgtgctggccaagcccgcccacaccgccctggcccccgtggccatgcccgtgagagagaccaacccctgggcccacgcccccgacgccgccaacaaggagatcgccgccacctgcagcggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91844 - DNA, 1518 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccgagagaaagttcttcaagggcttcttcggcaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggtgcccgaggtggagggcgaggccgagagcatcagcagcctgtgcagccagatcaccaacgccttcagcacccccgaggaccccttcagcagcgcccccatgaccaagcccgtgaccgtggtggccccccagagccccaccttccagggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91845 - DNA, 1923 bp, Artificial Sequence; identical to SEQ ID NO: 91843
  Description of Artificial Sequence: Synthetic coding sequence

SEQ ID NO: 91846 - DNA, 1371 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccgagagaaagttcttcaagggcttcttcggcaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaagggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91847 - DNA, 777 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccgagagaaagttcttcaagggcttcttcggcaagaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccctag

SEQ ID NO: 91848 - DNA, 1779 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggccaccggcaagaaggccgtgaaggccgtgctgtgggtgagcgccgacggcctgagagtggtggacgagaagaccaaggacctgatcgtggaccagaccatcgagaaggtgagcttctgcgcccccgacagaaacttcgacagagccttcagctacatctgcagagacggcaccaccagaagatggatctgccactgcttcatggccgtgaaggacaccggcgagagactgagccacgccgtgggctgcgccttcgccgcctgcctggagagaaagcagaagagagagaaggagtgcggcgtgaccgccaccttcgacgccagcagaaccaccttcaccagagagggcagcttcagagtgaccaccgccaccgagcaggccgagagagaggagatcatgaagcagatgcaggacgccaagaaggccgagaccgacaagatcgtggtgggcagcagcgtggcccccggcaacaccgcccccagccccagcagccccaccagccccaccagcgacgccaccaccagcctggagatgaacaacccccacgccatccccagaagacacgcccccatcgagcagctggccagacagggcagcttcagaggcttccccgccctgagccagaagatgagccccttcaagagacagctgagcctgagaatcaacgagctgcccagcaccatgcagagaaagaccgacttccccatcaagaacgccgtgcccgaggtggagggcgaggccgagagcatcagcagcctgtgcagccagatcaccaacgccttcagcacccccgaggaccccttcagcagcgcccccatgaccaagcccgtgaccgtggtggccccccagagccccaccttccagggcaccgagtggggccagagcagcggcgccgccagccccggcctgttccaggccggccacagaagaacccccagcgaggccgacagatggctggaggaggtgagcaagagcgtgagagcccagcagccccaggccagcgccgcccccctgcagcccgtgctgcagccccccccccccaccgccatcagccagcccgccagccccttccagggcaacgccttcctgaccagccagcccgtgcccgtgggcgtggtgcccgccctgcagcccgccttcgtgcccgcccagagctaccccgtggccaacggcatgccctaccccgcccccaacgtgcccgtggtgggcatcacccccagccagatggtggccaacgtgttcggcaccgccggccacccccaggccgcccacccccaccagagccccagcctggtgagacagcagaccttcccccactacgaggccagcagcgccaccaccagccccttcttcaagccccccgcccagcacctgaacggcagcgccgccttcaacggcgtggacgacggcagactggccagcgccgacagacacaccgaggtgcccaccggcacctgccccgtggaccccttcgaggcccagtgggccgccctggagaacaagagcaagcagagaaccaaccccagccccaccaaccccttcagcagcgacctgcagaagaccttcgagatcgagctgtag

SEQ ID NO: 91849 - DNA, 204 bp, Artificial Sequence
  Description of Artificial Sequence: Synthetic coding sequence
atgaacaagctgagacagagcttcagaagaaagaaggacgtgtacgtgcccgaggccagcagaccccaccagtggcagaccgacgaggagggcgtgagaaccggcaagtgcagcttccccgtgaagtacctgggccacgtggaggtggacgagagcagaggcatgcacatctgcgaggacgccgtgaagagactgaaggcctag

SEQ ID NO: 91850 - DNA, 1956 bp, Artificial Sequence; identical to SEQ ID NO: 91841
  Description of Artificial Sequence: Synthetic coding sequence

SEQ ID NO: 91851 - DNA, 777 bp, Artificial Sequence; identical to SEQ ID NO: 91847
  Description of Artificial Sequence: Synthetic coding sequence

SEQ ID NO: 91852 - DNA, 1812 bp, Artificial Sequence; identical to SEQ ID NO: 91842
  Description of Artificial Sequence: Synthetic coding sequence

SEQ ID NO: 91853 - DNA, 1923 bp, Artificial Sequence; identical to SEQ ID NO: 91843
  Description of Artificial Sequence: Synthetic coding sequence

SEQ ID NO: 91854 - DNA, 1830 bp, Artificial Sequence
  Description of Artificial Sequence: Synthetic coding sequence
atgagcagaagcgccgccgccagcggcggccccagaagacccgagagacacctgccccccgccccctgcggcgcccccggcccccccgagacctgcagaaccgagcccgacggcgccggcaccatgaacaagctgagacagagcctgagaagaagaaagcccgcctacgtgcccgaggccagcagaccccaccagtggcaggccgacgaggacgccgtgagaaagggcacctgcagcttccccgtgagatacctgggccacgtggaggtggaggagagcagaggcatgcacgtgtgcgaggacgccgtgaagaagctgaaggccatgggcagaaagagcgtgaagagcgtgctgtgggtgagcgccgacggcctgagagtggtggacgacaagaccaaggacctgctggtggaccagaccatcgagaaggtgagcttctgcgcccccgacagaaacctggacaaggccttcagctacatctgcagagacggcaccaccagaagatggatctgccactgcttcctggccctgaaggacagcggcgagagactgagccacgccgtgggctgcgccttcgccgcctgcctggagagaaagcagagaagagagaaggagtgcggcgtgaccgccgccttcgacgccagcagaaccagcttcgccagagagggcagcttcagactgagcggcggcggcagacccgccgagagagaggcccccgacaagaagaaggccgaggccgccgccgcccccaccgtggcccccggccccgcccagcccggccacgtgagccccacccccgccaccaccagccccggcgagaagggcgaggccggcacccccgtggccgccggcaccaccgccgccgccatccccagaagacacgcccccctggagcagctggtgagacagggcagcttcagaggcttccccgccctgagccagaagaacagccccttcaagagacagctgagcctgagactgaacgagctgcccagcaccctgcagagaagaaccgacttccaggtgaagggcaccgtgcccgagatggagccccccggcgccggcgacagcgacagcatcaacgccctgtgcacccagatcagcagcagcttcgccagcgccggcgcccccgcccccggccccccccccgccaccaccggcaccagcgcctggggcgagcccagcgtgccccccgccgccgccttccagcccggccacaagagaacccccagcgaggccgagagatggctggaggaggtgagccaggtggccaaggcccagcagcagcagcagcagcagcagcagcagcagcagcagcagcagcagcagcagcagcaggccgccagcgtggcccccgtgcccaccatgccccccgccctgcagcccttccccgcccccgtgggccccttcgacgccgcccccgcccaggtggccgtgttcctgccccccccccacatgcagccccccttcgtgcccgcctaccccggcctgggctacccccccatgcccagagtgcccgtggtgggcatcacccccagccagatggtggccaacgccttctgcagcgccgcccagctgcagccccagcccgccaccctgctgggcaaggccggcgccttccccccccccgccatccccagcgcccccggcagccaggccagacccagacccaacggcgccccctggccccccgagcccgcccccgcccccgcccccgagctggaccccttcgaggcccagtgggccgccctggagggcaaggccaccgtggagaagcccagcaaccccttcagcggcgacctgcagaagaccttcgagatcgagctgtag

SEQ ID NO: 91855 - DNA, 1707 bp, Artificial Sequence
  Description of Artificial Sequence: Synthetic coding sequence
atgaacaagctgagacagagcctgagaagaagaaagcccgcctacgtgcccgaggccagcagaccccaccagtggcaggccgacgaggacgccgtgagaaagggcacctgcagcttccccgtgagatacctgggccacgtggaggtggaggagagcagaggcatgcacgtgtgcgaggacgccgtgaagaagctgaaggccatgggcagaaagagcgtgaagagcgtgctgtgggtgagcgccgacggcctgagagtggtggacgacaagaccaaggacctgctggtggaccagaccatcgagaaggtgagcttctgcgcccccgacagaaacctggacaaggccttcagctacatctgcagagacggcaccaccagaagatggatctgccactgcttcctggccctgaaggacagcggcgagagactgagccacgccgtgggctgcgccttcgccgcctgcctggagagaaagcagagaagagagaaggagtgcggcgtgaccgccgccttcgacgccagcagaaccagcttcgccagagagggcagcttcagactgagcggcggcggcagacccgccgagagagaggcccccgacaagaagaaggccgaggccgccgccgcccccaccgtggcccccggccccgcccagcccggccacgtgagccccacccccgccaccaccagccccggcgagaagggcgaggccggcacccccgtggccgccggcaccaccgccgccgccatccccagaagacacgcccccctggagcagctggtgagacagggcagcttcagaggcttccccgccctgagccagaagaacagccccttcaagagacagctgagcctgagactgaacgagctgcccagcaccctgcagagaagaaccgacttccaggtgaagggcaccgtgcccgagatggagccccccggcgccggcgacagcgacagcatcaacgccctgtgcacccagatcagcagcagcttcgccagcgccggcgcccccgcccccggccccccccccgccaccaccggcaccagcgcctggggcgagcccagcgtgccccccgccgccgccttccagcccggccacaagagaacccccagcgaggccgagagatggctggaggaggtgagccaggtggccaaggcccagcagcagcagcagcagcagcagcagcagcagcagcagcagcagcagcagcagcagcaggccgccagcgtggcccccgtgcccaccatgccccccgccctgcagcccttccccgcccccgtgggccccttcgacgccgcccccgcccaggtggccgtgttcctgccccccccccacatgcagccccccttcgtgcccgcctaccccggcctgggctacccccccatgcccagagtgcccgtggtgggcatcacccccagccagatggtggccaacgccttctgcagcgccgcccagctgcagccccagcccgccaccctgctgggcaaggccggcgccttccccccccccgccatccccagcgcccccggcagccaggccagacccagacccaacggcgccccctggccccccgagcccgcccccgcccccgcccccgagctggaccccttcgaggcccagtgggccgccctggagggcaaggccaccgtggagaagcccagcaaccccttcagcggcgacctgcagaagaccttcgagatcgagctgtag

SEQ ID NO: 91856 - DNA, 1446 bp, Artificial Sequence
  Description of Artificial Sequence: Synthetic coding sequence
atgaagggcagaggcatgctggtgctgctgctgcacgccgtggtgctgggcctgcccagcgcctgggccgtgggcgcctgcgccagagcctgccccgccgcctgcgcctgcagcaccgtggagagaggctgcagcgtgagatgcgacagagccggcctgctgagagtgcccgccgagctgccctgcgaggccgtgagcatcgacctggacagaaacggcctgagattcctgggcgagagagccttcggcaccctgcccagcctgagaagactgagcctgagacacaacaacctgagcttcatcacccccggcgccttcaagggcctgcccagactggccgagctgagactggcccacaacggcgacctgagatacctgcacgccagaaccttcgccgccctgagcagactgagaagactggacctggccgcctgcagactgttcagcgtgcccgagagactgctggccgagctgcccgccctgagagagctggccgccttcgacaacctgttcagaagagtgcccggcgccctgagaggcctggccaacctgacccacgcccacctggagagaggcagaatcgaggccgtggccagcagcagcctgcagggcctgagaagactgagaagcctgagcctgcaggccaacagagtgagagccgtgcacgccggcgccttcggcgactgcggcgtgctggagcacctgctgctgaacgacaacctgctggccgagctgcccgccgacgccttcagaggcctgagaagactgagaaccctgaacctgggcggcaacgccctggacagagtggccagagcctggttcgccgacctggccgagctggagctgctgtacctggacagaaacagcatcgccttcgtggaggagggcgccttccagaacctgagcggcctgctggccctgcacctgaacggcaacagactgaccgtgctggcctgggtggccttccagcccggcttcttcctgggcagactgttcctgttcagaaacccctggtgctgcgactgcagactggagtggctgagagactggatggagggcagcggcagagtgaccgacgtgccctgcgccagccccggcagcgtggccggcctggacctgagccaggtgaccttcggcagaagcagcgacggcctgtgcgtggaccccgaggagctgaacctgaccaccagcagccccggccccagccccgagcccgccgccaccaccgtgagcagattcagcagcctgctgagcaagctgctggcccccagagtgcccgtggaggaggccgccaacaccaccggcggcctggccaacgccagcctgagcgacagcctgagcagcagaggcgtgggcggcgccggcagacagccctggttcctgctggccagctgcctgctgcccagcgtggcccagcacgtggtgttcggcctgcagatggactag

SEQ ID NO: 91857 - DNA, 1446 bp, Artificial Sequence; identical to SEQ ID NO: 91856
  Description of Artificial Sequence: Synthetic coding sequence

SEQ ID NO: 91858 - DNA, 1191 bp, Artificial Sequence
  Description of Artificial Sequence: Synthetic coding sequence
atgccccccaagaagggcggcgacggcatcaagcccccccccatcatcggcagattcggcaccagcctgaagatcggcatcgtgggcctgcccaacgtgggcaagagcaccttcttcaacgtgctgaccaacagccaggccagcgccgagaacttccccttctgcaccatcgaccccaacgagagcagagtgcccgtgcccgacgagagattcgacttcctgtgccagtaccacaagcccgccagcaagatccccgccttcctgaacgtggtggacatcgccggcctggtgaagggcgcccacaacggccagggcctgggcaacgccttcctgagccacatcagcgcctgcgacggcatcttccacctgaccagagccttcgaggacgacgacatcacccacgtggagggcagcgtggaccccatcagagacatcgagatcatccacgaggagctgcagctgaaggacgaggagatgatcggccccatcatcgacaagctggagaaggtggccgtgagaggcggcgacaagaagctgaagcccgagtacgacatcatgtgcaaggtgaagagctgggtgatcgaccagaagaagcccgtgagattctaccacgactggaacgacaaggagatcgaggtgctgaacaagcacctgttcctgaccagcaagcccatggtgtacctggtgaacctgagcgagaaggactacatcagaaagaagaacaagtggctgatcaagatcaaggagtgggtggacaagtacgaccccggcgccctggtgatccccttcagcggcgccctggagctgaagctgcaggagctgagcgccgaggagagacagaagtacctggaggccaacatgacccagagcgccctgcccaagatcatcaaggccggcttcgccgccctgcagctggagtacttcttcaccgccggccccgacgaggtgagagcctggaccatcagaaagggcaccaaggccccccaggccgccggcaagatccacaccgacttcgagaagggcttcatcatggccgaggtgatgaagtacgaggacttcaaggaggagggcagcgagaacgccgtgaaggccgccggcaagtacagacagcagggcagaaactacatcgtggaggacggcgacatcatcttcttcaagttcaacaccccccagcagcccaagaagaagtag

SEQ ID NO: 91859 - DNA, 717 bp, Artificial Sequence
  Description of Artificial Sequence: Synthetic coding sequence
atgatcggccccatcatcgacaagctggagaaggtggccgtgagaggcggcgacaagaagctgaagcccgagtacgacatcatgtgcaaggtgaagagctgggtgatcgaccagaagaagcccgtgagattctaccacgactggaacgacaaggagatcgaggtgctgaacaagcacctgttcctgaccagcaagcccatggtgtacctggtgaacctgagcgagaaggactacatcagaaagaagaacaagtggctgatcaagatcaaggagtgggtggacaagtacgaccccggcgccctggtgatccccttcagcggcgccctggagctgaagctgcaggagctgagcgccgaggagagacagaagtacctggaggccaacatgacccagagcgccctgcccaagatcatcaaggccggcttcgccgccctgcagctggagtacttcttcaccgccggccccgacgaggtgagagcctggaccatcagaaagggcaccaaggccccccaggccgccggcaagatccacaccgacttcgagaagggcttcatcatggccgaggtgatgaagtacgaggacttcaaggaggagggcagcgagaacgccgtgaaggccgccggcaagtacagacagcagggcagaaactacatcgtggaggacggcgacatcatcttcttcaagttcaacaccccccagcagcccaagaagaagtag

SEQ ID NO: 91860 - DNA, 1251 bp, Artificial Sequence
  Description of Artificial Sequence: Synthetic coding sequence
atgagcagaaccttcagcgccaagggcggcagagacctggtggagggcccccagtacctgatgccccccaagaagggcggcgacggcatcaagcccccccccatcatcggcagattcggcaccagcctgaagatcggcatcgtgggcctgcccaacgtgggcaagagcaccttcttcaacgtgctgaccaacagccaggccagcgccgagaacttccccttctgcaccatcgaccccaacgagagcagagtgcccgtgcccgacgagagattcgacttcctgtgccagtaccacaagcccgccagcaagatccccgccttcctgaacgtggtggacatcgccggcctggtgaagggcgcccacaacggccagggcctgggcaacgccttcctgagccacatcagcgcctgcgacggcatcttccacctgaccagagccttcgaggacgacgacatcacccacgtggagggcagcgtggaccccatcagagacatcgagatcatccacgaggagctgcagctgaaggacgaggagatgatcggccccatcatcgacaagctggagaaggtggccgtgagaggcggcgacaagaagctgaagcccgagtacgacatcatgtgcaaggtgaagagctgggtgatcgaccagaagaagcccgtgagattctaccacgactggaacgacaaggagatcgaggtgctgaacaagcacctgttcctgaccagcaagcccatggtgtacctggtgaacctgagcgagaaggactacatcagaaagaagaacaagtggctgatcaagatcaaggagtgggtggacaagtacgaccccggcgccctggtgatccccttcagcggcgccctggagctgaagctgcaggagctgagcgccgaggagagacagaagtacctggaggccaacatgacccagagcgccctgcccaagatcatcaaggccggcttcgccgccctgcagctggagtacttcttcaccgccggccccgacgaggtgagagcctggaccatcagaaagggcaccaaggccccccaggccgccggcaagatccacaccgacttcgagaagggcttcatcatggccgaggtgatgaagtacgaggacttcaaggaggagggcagcgagaacgccgtgaaggccgccggcaagtacagacagcagggcagaaactacatcgtggaggacggcgacatcatcttcttcaagttcaacaccccccagcagcccaagaagaagtag

SEQ ID NO: 91861 - DNA, 351 bp, Artificial Sequence
  Description of Artificial Sequence: Synthetic coding sequence
atgccccccaagaagggcggcgacggcatcaagcccccccccatcatcggcagattcggcaccagcctgaagatcggcatcgtgggcctgcccaacgtgggcaagagcaccttcttcaacgtgctgaccaacagccaggccagcgccgagaacttccccttctgcaccatcgaccccaacgagagcagagtgcccgtgcccgacgagagattcgacttcctgtgccagtaccacaagcccgccagcaagatccccgccttcctgaacgtggtggacatcgccggcctggtgaagggcgcccacaacggccagggcctgggcaacgccttcctgagccacatcagcgcctag

SEQ ID NO: 91862 - DNA, 837 bp, Artificial Sequence
  Description of Artificial Sequence: Synthetic coding sequence
atgccccccaagaagggcggcgacggcatcaagcccccccccatcatcggcagattcggcaccagcctgaagatcggcatcgtgggcctgcccaacgtgggcaagagcaccttcttcaacgtgctgaccaacagccaggccagcgccgagaacttccccttctgcaccatcgaccccaacgagagcagagtgcccgtgcccgacgagagattcgacttcctgtgccagtaccacaagcccgccagcaagatccccgccttcctgaacgtggtggacatcgccggcctggtgaagggcgcccacaacggccagggcctgggcaacgccttcctgagccacatcagcgcctgcgacggcatcttccacctgaccagagccttcgaggacgacgacatcacccacgtggagggcagcgtggaccccatcagagacatcgagatcatccacgaggagctgcagctgaaggacgaggagatgatcggccccatcatcgacaagctggagaaggtggccgtgagaggcggcgacaagaagctgaagcccgagtacgacatcatgtgcaaggtgaagagctgggtgatcgaccagaagaagcccgtgagattctaccacgactggaacgacaaggagatcgaggtgctgaacaagcacctgttcctgaccagcaagcccatggtgtacctggtgaacctgagcgagaaggactacatcagaaagaagaacaagtggctgctggagagcaccgacaacaaggccgagatcatcctgctgaagatggagatcctgagcagcagcaacctgacccacctgaacaacagaagaagaaacaagatctag

SEQ ID NO: 91863 - DNA, 312 bp, Artificial Sequence
  Description of Artificial Sequence: Synthetic coding sequence
atgatcggccccatcatcgacaagctggagaaggtggccgtgagaggcggcgacaagaagctgaagcccgagtacgacatcatgtgcaaggtgaagagctgggtgatcgaccagaagaagcccgtgagattctaccacgactggaacgacaaggagatcgaggtgctgaacaagcacctgttcctgaccagcaagcccatggtgtacctggtgaacctgagcgagaaggactacatcagaaagaagaacaagtggctgatcaagatcaaggagtgggtggacaagtacgaccccggcgccctggtgatctag

SEQ ID NO: 91864 - DNA, 1329 bp, Artificial Sequence
  Description of Artificial Sequence: Synthetic coding sequence
atgtgcgagctgagcagagaggacgcccccgtgagatggtacaaggacggcctggaggtggaggagagcgaggccctggtgctggagagagacggccccagatgcagactggtgctgcccgccgcccagcccgaggacggcggcgagttcgtgtgcgacgccggcgacgacagcgccttcttcaccgtgaccgtgaccgccccccccgagagaatcgtgcaccccgccgccagaagcctggacctgcacttcggcgcccccggcagagtggagctgagatgcgaggtggcccccgccggcagccaggtgagatggtacaaggacggcctggaggtggaggccagcgacgccctgcagctgggcgccgagggccccaccagaaccctgaccctgccccacgcccagcccgaggacgccggcgagtacgtgtgcgagaccagacacgaggccatcaccttcaacgtgatcctggccgagccccccgtgcagttcctggccctggagaccacccccagccccctgtgcgtggcccccggcgagcccgtggtgctgagctgcgagctgagcagagccggcgcccccgtggtgtggagccacaacggcagacccgtgcaggagggcgagggcctggagctgcacgccgagggccccagaagagtgctgtgcatccaggccgccggccccgcccacgccggcctgtacacctgccagagcggcgccgcccccggcgcccccagcctgagcttcaccgtgcaggtggccgagcccctgctggtgaagctggtgagcgagctgacccccctgaccgtgcacgagggcgacgacgccaccttcagatgcgaggtgagcccccccgacgccgacgtgacctggctgagaaacggcgccgtggtgacccccggcccccaggtggagatggcccagaacggcagcagcagaatcctgaccctgagaggctgccagctgggcgacgccggcaccgtgaccctgagagccggcagcaccgccaccagcgccagactgcacgtgagagagaccgagctgctgttcctgagaagactgcaggacgtgagagccgaggagggccaggacgtgtgcctggaggtggagaccggcagagtgggcgccgccggcgccgtgagatgggtgagaggcggccagcccctgccccacgacagcagactgagcatggcccaggacggccacatccacagactgttcatccacggcgtgatcctggccgaccagggcacctacggctgcgagagccaccacgacagaaccctggccagactgagcgtgagaagagagtgccccgtgctgagctag

SEQ ID NO: 91865 - DNA, 4206 bp, Artificial Sequence
  Description of Artificial Sequence: Synthetic coding sequence
atgaaggccagcagcggcgaccagggcagccccccctgcttcctgagattccccagacccgtgagagtggtgagcggcgccgaggccgagctgaagtgcgtggtgctgggcgagcccccccccgtggtggtgtgggagaagggcggccagcagctggccgccagcgagagactgagcttccccgccgacggcgccgagcacggcctgctgctgaccgccgccctgcccaccgacgccggcgtgtacgtgtgcagagccagaaacgccgccggcgaggcctacgccgccgccgccgtgaccgtgctggagccccccgccagcgaccccgagctgcagcccgccgagagacccctgcccagccccggcagcggcgagggcgcccccgtgttcctgaccggccccagaagccagtgggtgctgagaggcgccgaggtggtgctgacctgcagagccggcggcctgcccgagcccaccctgtactgggagaaggacggcatggccctggacgaggtgtgggacagcagccacttcgccctgcagcccggcagagccgaggacggccccggcgccagcctggccctgagaatcctggccgccagactgcccgacagcggcgtgtacgtgtgccacgccagaaacgcccacggccacgcccaggccggcgccctgctgcaggtgcaccagccccccgagagcccccccgccgaccccgacgaggcccccgcccccgtggtggagcccctgaagtgcgcccccaagaccttctgggtgaacgagggcaagcacgccaagttcagatgctacgtgatgggcaagcccgagcccgagatcgagtggcactgggagggcagacccctgctgcccgacagaagaagactgatgtacagagacagagacggcggcttcgtgctgaaggtgctgtactgccaggccaaggacagaggcctgtacgtgtgcgccgccagaaacagcgccggccagaccctgagcgccgtgcagctgcacgtgaaggagcccagactgagattcaccagacccctgcaggacgtggagggcagagagcacggcatcgccgtgctggagtgcaaggtgcccaacagcagaatccccaccgcctggttcagagaggaccagagactgctgccctgcagaaagtacgagcagatcgaggagggcaccgtgagaagactgatcatccacagactgaaggccgacgacgacggcatctacctgtgcgagatgagaggcagagtgagaaccgtggccaacgtgaccgtgaagggccccatcctgaagagactgcccagaaagctggacgtgctggagggcgagaacgccgtgctgctggtggagaccctggaggccggcgtggagggcagatggagcagagacggcgaggagctgcccgtgatctgccagagcagcagcggccacatgcacgccctggtgctgcccggcgtgaccagagaggacgccggcgaggtgaccttcagcctgggcaacagcagaaccaccaccctgctgagagtgaagtgcgtgaagcacagcccccccggcccccccatcctggccgagatgttcaagggccacaagaacaccgtgctgctgacctggaagccccccgagcccgcccccgagacccccttcatctacagactggagagacaggaggtgggcagcgaggactggatccagtgcttcagcatcgagaaggccggcgccgtggaggtgcccggcgactgcgtgcccagcgagggcgactacagattcagaatctgcaccgtgagcggccacggcagaagcccccacgtggtgttccacggcagcgcccacctggtgcccaccgccagactggtggccggcctggaggacgtgcaggtgtacgacggcgaggacgccgtgttcagcctggacctgagcaccatcatccagggcacctggttcctgaacggcgaggagctgaagagcaacgagcccgagggccaggtggagcccggcgccctgagatacagaatcgagcagaagggcctgcagcacagactgatcctgcacgccgtgaagcaccaggacagcggcgccctggtgggcttcagctgccccggcgtgcaggacagcgccgccctgaccatccaggagagccccgtgcacatcctgagcccccaggacagagtgagcctgaccttcaccaccagcgagagagtggtgctgacctgcgagctgagcagagtggacttccccgccacctggtacaaggacggccagaaggtggaggagagcgagctgctggtggtgaagatggacggcagaaagcacagactgatcctgcccgaggccaaggtgcaggacagcggcgagttcgagtgcagaaccgagggcgtgagcgccttcttcggcgtgaccgtgcaggacccccccgtgcacatcgtggaccccagagagcacgtgttcgtgcacgccatcaccagcgagtgcgtgatgctggcctgcgaggtggacagagaggacgcccccgtgagatggtacaaggacggccaggaggtggaggagagcgacttcgtggtgctggagaacgagggcccccacagaagactggtgctgcccgccacccagcccagcgacggcggcgagttccagtgcgtggccggcgacgagtgcgcctacttcaccgtgaccatcaccgacgtgagcagctggatcgtgtaccccagcggcaaggtgtacgtggccgccgtgagactggagagagtggtgctgacctgcgagctgtgcagaccctgggccgaggtgagatggaccaaggacggcgaggaggtggtggagagccccgccctgctgctgcagaaggaggacaccgtgagaagactggtgctgcccgccgtgcagctggaggacagcggcgagtacctgtgcgagatcgacgacgagagcgccagcttcaccgtgaccgtgaccgagccccccgtgagaatcatctaccccagagacgaggtgaccctgatcgccgtgaccctggagtgcgtggtgctgatgtgcgagctgagcagagaggacgcccccgtgagatggtacaaggacggcctggaggtggaggagagcgaggccctggtgctggagagagacggccccagatgcagactggtgctgcccgccgcccagcccgaggacggcggcgagttcgtgtgcgacgccggcgacgacagcgccttcttcaccgtgaccgtgaccgagccccccgtgcagttcctggccctggagaccacccccagccccctgtgcgtggcccccggcgagcccgtggtgctgagctgcgagctgagcagagccggcgcccccgtggtgtggagccacaacggcagacccgtgcaggagggcgagggcctggagctgcacgccgagggccccagaagagtgctgtgcatccaggccgccggccccgcccacgccggcctgtacacctgccagagcggcgccgcccccggcgcccccagcctgagcttcaccgtgcaggtggccgagccccccgtgagagtggtggcccccgaggccgcccagaccagagtgagaagcacccccggcggcgacctggagctggtggtgcacctgagcggccccggcggccccgtgagatggtacaaggacggcgagagactggccagccagggcagagtgcagctggagcaggccggcgccagacaggtgctgagagtgcagggcgccagaagcggcgacgccggcgagtacctgtgcgacgccccccaggacagcagaatcttcctggtgagcgtggaggagcccctgctggtgaagctggtgagcgagctgacccccctgaccgtgcacgagggcgacgacgccaccttcagatgcgaggtgagcccccccgacgccgacgtgacctggctgagaaacggcgccgtggtgacccccggcccccagagacagagctgctgcagctacggcggctgcagaatgtgcggccagagaaaggccagaatgtgcgtgagcaagtggagacaggccgagtgggtgcagagaggcccctgcgccggctgcgaggtgggcagcccctgccccaccaccctggcctgcccctggcccagaatgggcaccagcaccgccagcagcagcatggtgagctactggcccaccagagcccccaccgccgccagagccaccaccatcgccccctggcccggcagcgcctag

SEQ ID NO: 91866 - DNA, 3078 bp, Artificial Sequence
  Description of Artificial Sequence: Synthetic coding sequence
atgaaggccagcagcggcgaccagggcagccccccctgcttcctgagattccccagacccgtgagagtggtgagcggcgccgaggccgagctgaagtgcgtggtgctgggcgagcccccccccgtggtggtgtgggagaagggcggccagcagctggccgccagcgagagactgagcttccccgccgacggcgccgagcacggcctgctgctgaccgccgccctgcccaccgacgccggcgtgtacgtgtgcagagccagaaacgccgccggcgaggcctacgccgccgccgccgtgaccgtgctggagccccccgccagcgaccccgagctgcagcccgccgagagacccctgcccagccccggcagcggcgagggcgcccccgtgttcctgaccggccccagaagccagtgggtgctgagaggcgccgaggtggtgctgacctgcagagccggcggcctgcccgagcccaccctgtactgggagaaggacggcatggccctggacgaggtgtgggacagcagccacttcgccctgcagcccggcagagccgaggacggccccggcgccagcctggccctgagaatcctggccgccagactgcccgacagcggcgtgtacgtgtgccacgccagaaacgcccacggccacgcccaggccggcgccctgctgcaggtgcaccagccccccgagagcccccccgccgaccccgacgaggcccccgcccccgtggtggagcccctgaagtgcgcccccaagaccttctgggtgaacgagggcaagcacgccaagttcagatgctacgtgatgggcaagcccgagcccgagatcgagtggcactgggagggcagacccctgctgcccgacagaagaagactgatgtacagagacagagacggcggcttcgtgctgaaggtgctgtactgccaggccaaggacagaggcctgtacgtgtgcgccgccagaaacagcgccggccagaccctgagcgccgtgcagctgcacgtgaaggagcccagactgagattcaccagacccctgcaggacgtggagggcagagagcacggcatcgccgtgctggagtgcaaggtgcccaacagcagaatccccaccgcctggttcagagaggaccagagactgctgccctgcagaaagtacgagcagatcgaggagggcaccgtgagaagactgatcatccacagactgaaggccgacgacgacggcatctacctgtgcgagatgagaggcagagtgagaaccgtggccaacgtgaccgtgaagggccccatcctgaagagactgcccagaaagctggacgtgctggagggcgagaacgccgtgctgctggtggagaccctggaggccggcgtggagggcagatggagcagagacggcgaggagctgcccgtgatctgccagagcagcagcggccacatgcacgccctggtgctgcccggcgtgaccagagaggacgccggcgaggtgaccttcagcctgggcaacagcagaaccaccaccctgctgagagtgaagtgcgtgaagcacagcccccccggcccccccatcctggccgagatgttcaagggccacaagaacaccgtgctgctgacctggaagccccccgagcccgcccccgagacccccttcatctacagactggagagacaggaggtgggcagcgaggactggatccagtgcttcagcatcgagaaggccggcgccgtggaggtgcccggcgactgcgtgcccagcgagggcgactacagattcagaatctgcaccgtgagcggccacggcagaagcccccacgtggtgttccacggcagcgcccacctggtgcccaccgccagactggtggccggcctggaggacgtgcaggtgtacgacggcgaggacgccgtgttcagcctggacctgagcaccatcatccagggcacctggttcctgaacggcgaggagctgaagagcaacgagcccgagggccaggtggagcccggcgccctgagatacagaatcgagcagaagggcctgcagcacagactgatcctgcacgccgtgaagcaccaggacagcggcgccctggtgggcttcagctgccccggcgtgcaggacagcgccgccctgaccatccaggagagccccgtgcacatcctgagcccccaggacagagtgagcctgaccttcaccaccagcgagagagtggtgctgacctgcgagctgagcagagtggacttccccgccacctggtacaaggacggccagaaggtggaggagagcgagctgctggtggtgaagatggacggcagaaagcacagactgatcctgcccgaggccaaggtgcaggacagcggcgagttcgagtgcagaaccgagggcgtgagcgccttcttcggcgtgaccgtgcaggacccccccgtgcacatcgtggaccccagagagcacgtgttcgtgcacgccatcaccagcgagtgcgtgatgctggcctgcgaggtggacagagaggacgcccccgtgagatggtacaaggacggccaggaggtggaggagagcgacttcgtggtgctggagaacgagggcccccacagaagactggtgctgcccgccacccagcccagcgacggcggcgagttccagtgcgtggccggcgacgagtgcgcctacttcaccgtgaccatcaccgacgtgagcagctggatcgtgtaccccagcggcaaggtgtacgtggccgccgtgagactggagagagtggtgctgacctgcgagctgtgcagaccctgggccgaggtgagatggaccaaggacggcgaggaggtggtggagagccccgccctgctgctgcagaaggaggacaccgtgagaagactggtgctgcccgccgtgcagctggaggacagcggcgagtacctgtgcgagatcgacgacgagagcgccagcttcaccgtgaccgtgaccgagagctaccagagccaggacagcagcaacaacaaccccgagctgtgcgtgctgctgaagaagcccaagaccagaagactgtggagcagattccccccctggagaagaaccgccggcaccgagtag

SEQ ID NO: 91867 - DNA, 5691 bp, Artificial Sequence
  Description of Artificial Sequence: Synthetic coding sequence
atgaaggccagcagcggcgaccagggcagccccccctgcttcctgagattccccagacccgtgagagtggtgagcggcgccgaggccgagctgaagtgcgtggtgctgggcgagcccccccccgtggtggtgtgggagaagggcggccagcagctggccgccagcgagagactgagcttccccgccgacggcgccgagcacggcctgctgctgaccgccgccctgcccaccgacgccggcgtgtacgtgtgcagagccagaaacgccgccggcgaggcctacgccgccgccgccgtgaccgtgctggagccccccgccagcgaccccgagctgcagcccgccgagagacccctgcccagccccggcagcggcgagggcgcccccgtgttcctgaccggccccagaagccagtgggtgctgagaggcgccgaggtggtgctgacctgcagagccggcggcctgcccgagcccaccctgtactgggagaaggacggcatggccctggacgaggtgtgggacagcagccacttcgccctgcagcccggcagagccgaggacggccccggcgccagcctggccctgagaatcctggccgccagactgcccgacagcggcgtgtacgtgtgccacgccagaaacgcccacggccacgcccaggccggcgccctgctgcaggtgcaccagccccccgagagcccccccgccgaccccgacgaggcccccgcccccgtggtggagcccctgaagtgcgcccccaagaccttctgggtgaacgagggcaagcacgccaagttcagatgctacgtgatgggcaagcccgagcccgagatcgagtggcactgggagggcagacccctgctgcccgacagaagaagactgatgtacagagacagagacggcggcttcgtgctgaaggtgctgtactgccaggccaaggacagaggcctgtacgtgtgcgccgccagaaacagcgccggccagaccctgagcgccgtgcagctgcacgtgaaggagcccagactgagattcaccagacccctgcaggacgtggagggcagagagcacggcatcgccgtgctggagtgcaaggtgcccaacagcagaatccccaccgcctggttcagagaggaccagagactgctgccctgcagaaagtacgagcagatcgaggagggcaccgtgagaagactgatcatccacagactgaaggccgacgacgacggcatctacctgtgcgagatgagaggcagagtgagaaccgtggccaacgtgaccgtgaagggccccatcctgaagagactgcccagaaagctggacgtgctggagggcgagaacgccgtgctgctggtggagaccctggaggccggcgtggagggcagatggagcagagacggcgaggagctgcccgtgatctgccagagcagcagcggccacatgcacgccctggtgctgcccggcgtgaccagagaggacgccggcgaggtgaccttcagcctgggcaacagcagaaccaccaccctgctgagagtgaagtgcgtgaagcacagcccccccggcccccccatcctggccgagatgttcaagggccacaagaacaccgtgctgctgacctggaagccccccgagcccgcccccgagacccccttcatctacagactggagagacaggaggtgggcagcgaggactggatccagtgcttcagcatcgagaaggccggcgccgtggaggtgcccggcgactgcgtgcccagcgagggcgactacagattcagaatctgcaccgtgagcggccacggcagaagcccccacgtggtgttccacggcagcgcccacctggtgcccaccgccagactggtggccggcctggaggacgtgcaggtgtacgacggcgaggacgccgtgttcagcctggacctgagcaccatcatccagggcacctggttcctgaacggcgaggagctgaagagcaacgagcccgagggccaggtggagcccggcgccctgagatacagaatcgagcagaagggcctgcagcacagactgatcctgcacgccgtgaagcaccaggacagcggcgccctggtgggcttcagctgccccggcgtgcaggacagcgccgccctgaccatccaggagagccccgtgcacatcctgagcccccaggacagagtgagcctgaccttcaccaccagcgagagagtggtgctgacctgcgagctgagcagagtggacttccccgccacctggtacaaggacggccagaaggtggaggagagcgagctgctggtggtgaagatggacggcagaaagcacagactgatcctgcccgaggccaaggtgcaggacagcggcgagttcgagtgcagaaccgagggcgtgagcgccttcttcggcgtgaccgtgcaggacccccccgtgcacatcgtggaccccagagagcacgtgttcgtgcacgccatcaccagcgagtgcgtgatgctggcctgcgaggtggacagagaggacgcccccgtgagatggtacaaggacggccaggaggtggaggagagcgacttcgtggtgctggagaacgagggcccccacagaagactggtgctgcccgccacccagcccagcgacggcggcgagttccagtgcgtggccggcgacgagtgcgcctacttcaccgtgaccatcaccgacgtgagcagctggatcgtgtaccccagcggcaaggtgtacgtggccgccgtgagactggagagagtggtgctgacctgcgagctgtgcagaccctgggccgaggtgagatggaccaaggacggcgaggaggtggtggagagccccgccctgctgctgcagaaggaggacaccgtgagaagactggtgctgcccgccgtgcagctggaggacagcggcgagtacctgtgcgagatcgacgacgagagcgccagcttcaccgtgaccgtgaccgagccccccgtgagaatcatctaccccagagacgaggtgaccctgatcgccgtgaccctggagtgcgtggtgctgatgtgcgagctgagcagagaggacgcccccgtgagatggtacaaggacggcctggaggtggaggagagcgaggccctggtgctggagagagacggccccagatgcagactggtgctgcccgccgcccagcccgaggacggcggcgagttcgtgtgcgacgccggcgacgacagcgccttcttcaccgtgaccgtgaccgccccccccgagagaatcgtgcaccccgccgccagaagcctggacctgcacttcggcgcccccggcagagtggagctgagatgcgaggtggcccccgccggcagccaggtgagatggtacaaggacggcctggaggtggaggccagcgacgccctgcagctgggcgccgagggccccaccagaaccctgaccctgccccacgcccagcccgaggacgccggcgagtacgtgtgcgagaccagacacgaggccatcaccttcaacgtgatcctggccgagccccccgtgcagttcctggccctggagaccacccccagccccctgtgcgtggcccccggcgagcccgtggtgctgagctgcgagctgagcagagccggcgcccccgtggtgtggagccacaacggcagacccgtgcaggagggcgagggcctggagctgcacgccgagggccccagaagagtgctgtgcatccaggccgccggccccgcccacgccggcctgtacacctgccagagcggcgccgcccccggcgcccccagcctgagcttcaccgtgcaggtggccgagccccccgtgagagtggtggcccccgaggccgcccagaccagagtgagaagcacccccggcggcgacctggagctggtggtgcacctgagcggccccggcggccccgtgagatggtacaaggacggcgagagactggccagccagggcagagtgcagctggagcaggccggcgccagacaggtgctgagagtgcagggcgccagaagcggcgacgccggcgagtacctgtgcgacgccccccaggacagcagaatcttcctggtgagcgtggaggagcccctgctggtgaagctggtgagcgagctgacccccctgaccgtgcacgagggcgacgacgccaccttcagatgcgaggtgagcccccccgacgccgacgtgacctggctgagaaacggcgccgtggtgacccccggcccccaggtggagatggcccagaacggcagcagcagaatcctgaccctgagaggctgccagctgggcgacgccggcaccgtgaccctgagagccggcagcaccgccaccagcgccagactgcacgtgagagagaccgagctgctgttcctgagaagactgcaggacgtgagagccgaggagggccaggacgtgtgcctggaggtggagaccggcagagtgggcgccgccggcgccgtgagatgggtgagaggcggccagcccctgccccacgacagcagactgagcatggcccaggacggccacatccacagactgttcatccacggcgtgatcctggccgaccagggcacctacggctgcgagagccaccacgacagaaccctggccagactgagcgtgagacccagacagctgagagtgctgagacccctggaggacgtgaccatcagcgagggcggcagcgccaccttccagctggagctgagccaggagggcgtgaccggcgagtgggccagaggcggcgtgcagctgtaccccggccccaagtgccacatccacagcgacggccacagacacagactggtgctgaacggcctgggcctggccgacagcggctgcgtgagcttcaccgccgacagcctgagatgcgccgccagactgatcgtgagagaggtgcccgtgaccatcgtgagaggcccccacgacctggaggtgaccgagggcgacaccgccaccttcgagtgcgagctgagccaggccctggccgacgtgacctgggagaaggacggcaacgccctgacccccagccccagactgagactgcaggccctgggcaccagaagactgctgcagctgagaagatgcggccccagcgacgccggcacctacagctgcgccgtgggcaccgccagagccggccccgtgagactgaccgtgagagagagaaccgtggccgtgctgagcgagctgagaagcgtgagcgccagagagggcgacggcgccaccttcgagtgcaccgtgagcgaggtggagaccaccggcagatgggagctgggcggcagacccctgagacccggcgccagagtgagaatcagacaggagggcaagaagcacatcctggtgctgagcgagctgagagccgaggacgccggcgaggtgagattccaggccggccccgcccagagcctggccctgctggaggtggaggccctgcccctgcagatgtgcagacacccccccagagagaagaccgtgctggtgggcagaagagccgtgctggaggtgaccgtgagcagaagcggcggccacgtgtgctggctgagagagggcgccgagctgtgccccggcgacaagtacgagatgagaagccacggccccacccacagcctggtgatccacgacgtgagacccgaggaccagggcacctactgctgccaggccggccaggacagcacccacaccagactgctggtggagggcaactag

SEQ ID NO: 91868 - DNA, 2682 bp, Artificial Sequence
  Description of Artificial Sequence: Synthetic coding sequence
atggagccccccctgcccgtgggcgcccagcccctggccaccgtggagggcatggagatgaagggccccctgagagagccctgcgccctgaccctggcccagagaaacggccagtacgagctgatcatccagctgcacgagaaggagcagcacgtgcaggacatcatccccatcaacagccacttcagatgcgtgcaggaggccgaggagaccctgctgatcgacatcgccagcaacagcggctgcaagatcagagtgcagggcgactggatcagagagagaagattcgagatccccgacgaggagcactgcctgaagttcctgagcgccgtgctggccgcccagaaggcccagagccagctgctggtgcccgagcagaaggacagcagcagctggtaccagaagctggacaccaaggacaagcccagcgtgttcagcggcctgctgggcttcgaggacaacttcagcagcatgaacctggacaagaagatcaacagccagaaccagcccaccggcatccacagagagcccccccccccccccttcagcgtgaacaagatgctgcccagagagaaggaggccagcaacaaggagcagcccaaggtgaccaacaccatgagaaagctgttcgtgcccaacacccagagcggccagagagagggcctgatcaagcacatcctggccaagagagagaaggagtacgtgaacatccagaccttcagattcttcgtgggcacctggaacgtgaacggccagagccccgacagcggcctggagccctggctgaactgcgaccccaacccccccgacatctactgcatcggcttccaggagctggacctgagcaccgaggccttcttctacttcgagagcgtgaaggagcaggagtggagcatggccgtggagagaggcctgcacagcaaggccaagtacaagaaggtgcagctggtgagactggtgggcatgatgctgctgatcttcgccagaaaggaccagtgcagatacatcagagacatcgccaccgagaccgtgggcaccggcatcatgggcaagatgggcaacaagggcggcgtggccgtgagattcgtgttccacaacaccaccttctgcatcgtgaacagccacctggccgcccacgtggaggacttcgagagaagaaaccaggactacaaggacatctgcgccagaatgagcttcgtggtgcccaaccagaccctgccccagctgaacatcatgaagcacgaggtggtgatctggctgggcgacctgaactacagactgtgcatgcccgacgccaacgaggtgaagagcctgatcaacaagaaggacctgcagagactgctgaagttcgaccagctgaacatccagagaacccagaagaaggccttcgtggacttcaacgagggcgagatcaagttcatccccacctacaagtacgacagcaagaccgacagatgggacagcagcggcaagtgcagagtgcccgcctggtgcgacagaatcctgtggagaggcaccaacgtgaaccagctgaactacagaagccacatggagctgaagaccagcgaccacaagcccgtgagcgccctgttccacatcggcgtgaaggtggtggacgagagaagatacagaaaggtgttcgaggacagcgtgagaatcatggacagaatggagaacgacttcctgcccagcctggagctgagcagaagagagttcgtgttcgagaacgtgaagttcagacagctgcagaaggagaagttccagatcagcaacaacggccaggtgccctgccacttcagcttcatccccaagctgaacgacagccagtactgcaagccctggctgagagccgagcccttcgagggctacctggagcccaacgagaccgtggacatcagcctggacgtgtacgtgagcaaggacagcgtgaccatcctgaacagcggcgaggacaagatcgaggacatcctggtgctgcacctggacagaggcaaggactacttcctgaccatcagcggcaactacctgcccagctgcttcggcaccagcctggaggccctgtgcagaatgaagagacccatcagagaggtgcccgtgaccaagctgatcgacctggagaagagcctgctgcagatggtgcccctggacgagggcgccagcgagagacccctgcaggtgcccaaggagatctggctgctggtggaccacctgttcaagtacgcctgccaccaggaggacctgttccagacccccggcatgcaggaggagctgcagcagatcatcgactgcctggacaccagcatccccgagaccatccccggcagcaaccacagcgtggccgaggccctgctgatcttcctggaggccctgcccgagcccgtgatctgctacgagctgtaccagagatgcctggacagcgcctacgaccccagaatctgcagacaggtgatcagccagctgcccagatgccacagaaacgtgttcagatacctgatggccttcctgagagagctgctgaagttcagcgagtacaacagcgtgaacgccaacatgatcgccaccctgttcaccagcctgctgctgagacccccccccaacctgatggccagacagacccccagcgacagacagagagccatccagttcctgctgggcttcctgctgggcagcgaggaggactag

SEQ ID NO: 91869 - DNA, 2706 bp, Artificial Sequence
  Description of Artificial Sequence: Synthetic coding sequence
atggagccccccctgcccgtgggcgcccagcccctggccaccgtggagggcatggagatgaagggccccctgagagagccctgcgccctgaccctggcccagagaaacggccagtacgagctgatcatccagctgcacgagaaggagcagcacgtgcaggacatcatccccatcaacagccacttcagatgcgtgcaggaggccgaggagaccctgctgatcgacatcgccagcaacagcggctgcaagatcagagtgcagggcgactggatcagagagagaagattcgagatccccgacgaggagcactgcctgaagttcctgagcgccgtgctggccgcccagaaggcccagagccagctgctggtgcccgagcagaaggacagcagcagctggtaccagaagctggacaccaaggacaagcccagcgtgttcagcggcctgctgggcttcgaggacaacttcagcagcatgaacctggacaagaagatcaacagccagaaccagcccaccggcatccacagagagcccccccccccccccttcagcgtgaacaagatgctgcccagagagaaggaggccagcaacaaggagcagcccaaggtgaccaacaccatgagaaagctgttcgtgcccaacacccagagcggccagagagagggcctgatcaagcacatcctggccaagagagagaaggagtacgtgaacatccagaccttcagattcttcgtgggcacctggaacgtgaacggccagagccccgacagcggcctggagccctggctgaactgcgaccccaacccccccgacatctactgcatcggcttccaggagctggacctgagcaccgaggccttcttctacttcgagagcgtgaaggagcaggagtggagcatggccgtggagagaggcctgcacagcaaggccaagtacaagaaggtgcagctggtgagactggtgggcatgatgctgctgatcttcgccagaaaggaccagtgcagatacatcagagacatcgccaccgagaccgtgggcaccggcatcatgggcaagatgggcaacaagggcggcgtggccgtgagattcgtgttccacaacaccaccttctgcatcgtgaacagccacctggccgcccacgtggaggacttcgagagaagaaaccaggactacaaggacatctgcgccagaatgagcttcgtggtgcccaaccagaccctgccccagctgaacatcatgaagcacgaggtggtgatctggctgggcgacctgaactacagactgtgcatgcccgacgccaacgaggtgaagagcctgatcaacaagaaggacctgcagagactgctgaagttcgaccagctgaacatccagagaacccagaagaaggccttcgtggacttcaacgagggcgagatcaagttcatccccacctacaagtacgacagcaagaccgacagatgggacagcagcggcaagtgcagagtgcccgcctggtgcgacagaatcctgtggagaggcaccaacgtgaaccagctgaactacagaagccacatggagctgaagaccagcgaccacaagcccgtgagcgccctgttccacatcggcgtgaaggtggtggacgagagaagatacagaaaggtgttcgaggacagcgtgagaatcatggacagaatggagaacgacttcctgcccagcctggagctgagcagaagagagttcgtgttcgagaacgtgaagttcagacagctgcagaaggagaagttccagatcagcaacaacggccaggtgccctgccacttcagcttcatccccaagctgaacgacagccagtactgcaagccctggctgagagccgagcccttcgagggctacctggagcccaacgagaccgtggacatcagcctggacgtgtacgtgagcaaggacagcgtgaccatcctgaacagcggcgaggacaagatcgaggacatcctggtgctgcacctggacagaggcaaggactacttcctgaccatcagcggcaactacctgcccagctgcttcggcaccagcctggaggccctgtgcagaatgaagagacccatcagagaggtgcccgtgaccaagctgatcgacctggaggaggacagcttcctggagaaggagaagagcctgctgcagatggtgcccctggacgagggcgccagcgagagacccctgcaggtgcccaaggagatctggctgctggtggaccacctgttcaagtacgcctgccaccaggaggacctgttccagacccccggcatgcaggaggagctgcagcagatcatcgactgcctggacaccagcatccccgagaccatccccggcagcaaccacagcgtggccgaggccctgctgatcttcctggaggccctgcccgagcccgtgatctgctacgagctgtaccagagatgcctggacagcgcctacgaccccagaatctgcagacaggtgatcagccagctgcccagatgccacagaaacgtgttcagatacctgatggccttcctgagagagctgctgaagttcagcgagtacaacagcgtgaacgccaacatgatcgccaccctgttcaccagcctgctgctgagacccccccccaacctgatggccagacagacccccagcgacagacagagagccatccagttcctgctgggcttcctgctgggcagcgaggaggactag

SEQ ID NO: 91870 - DNA, 2445 bp, Artificial Sequence
  Description of Artificial Sequence: Synthetic coding sequence
atgcacctggagggcagagacggcagaagataccccggcgcccccgccgtggagctgctgcagaccagcgtgcccagcggcctggccgagctggtggccggcaagagaagactgcccagaggcgccggcggcgccgaccccagccacagctgccccagaggcgccgccggccagagcagctgggcccccgccggccaggagttcgccagcttcctgaccaagggcagaagccacagcagcctgccccagatgagcagcagcagaagcaaggacagctgcttcaccgagaacacccccctgctgagaaacagcctgcaggagaagggcagcagatgcatccccgtgtaccaccccgagttcatcaccgccgaggagagctgggaggacagcagcgccgactgggagagaagatacctgctgagcagagaggtgagcggcctgagcgccagcgccagcagcgagaagggcgacctgctggacagcccccacatcagactgagactgagcaagctgagaagatgcgtgcagtggctgaaggtgatgggcctgttcgccttcgtggtgctgtgcagcatcctgttcagcctgtaccccgaccagggcaagctgtggcagctgctggccctgagccccctggagaactacagcgtgaacctgagcagccacgtggacagcaccctgctgcaggtggacctggccggcgccctggtggccagcggccccagcagacccggcagagaggagcacatcgtggtggagctgacccaggccgacgccctgggcagcagatggagaagaccccagcaggtgacccacaactggaccgtgtacctgaaccccagaagaagcgagcacagcgtgatgagcagaaccttcgaggtgctgaccagagagaccgtgagcatcagcatcagagccagcctgcagcagacccaggccgtgcccctgctgatggcccaccagtacctgagaggcagcgtggagacccaggtgaccatcgccaccgccatcctggccggcgtgtacgccctgatcatcttcgagagacccagcctgacccacgtggtggagtggatcgacttcgagaccctggccctgctgttcggcatgatgatcctggtggccatcttcagcgagaccggcttcttcgactactgcgccgtgaaggcctacagactgagcagaggcagagtgtgggccatgatcatcatgctgtgcctgatcgccgccgtgctgagcgccttcctggacaacgtgaccaccatgctgctgttcacccccgtgaccatcagactgtgcgaggtgctgaacctggaccccagacaggtgctgatcgccgaggtgatcttcaccaacatcggcggcgccgccaccgccatcggcgacccccccaacgtgatcatcgtgagcaaccaggagctgagaaagatgggcctggacttcgccggcttcaccgcccacatgttcatcggcatctgcctggtgctgctggtgtgcttccccctgctgagactgctgtactggaacagaaagctgtacaacaaggagcccagcgagatcgtggagctgaagcacgagatccacgtgtggagactgaccgcccagagaatcagccccgccagcagagaggagaccgccgtgagaagactgctgctgggcaaggtgctggccctggagcacctgctggccagaagactgcacaccttccacagacagatcagccaggaggacaagaactgggagaccaacatccaggagctgcagaagaagcacagaatcagcgacggcatcctgctggccaagtgcctgaccgtgctgggcttcgtgatcttcatgttcttcctgaacagcttcgtgcccggcatccacctggacctgggctggatcgccatcctgggcgccatctggctgctgatcctggccgacatccacgacttcgagatcatcctgcacagagtggagtgggccaccctgctgttcttcgccgccctgttcgtgctgatggaggccctggcccacctgcacctgatcgagtacgtgggcgagcagaccgccctgctgatcaagatggtgcccgaggagcagagactgatcgccgccatcgtgctggtggtgtgggtgagcgccctggccagcagcctgatcgacaacatccccttcaccgccaccatgatccccgtgctgctgaacctgagccacgaccccgaggtgggcctgcccgccccccccctgatgtacgccctggccttcggcgcctgcctgggcggcaacggcaccctgatcggcgccagcgccaacgtggtgtgcgccggcatcgccgagcagcacggctacggcttcagcttcatggagttcttcagactgggcttccccatgatggtggtgagctgcaccgtgggcatgtgctacctgctggtggcccacgtggtggtgggctggaactag

SEQ ID NO: 91871 - DNA, 2517 bp, Artificial Sequence
  Description of Artificial Sequence: Synthetic coding sequence
atgcacctggagggcagagacggcagaagataccccggcgcccccgccgtggagctgctgcagaccagcgtgcccagcggcctggccgagctggtggccggcaagagaagactgcccagaggcgccggcggcgccgaccccagccacagctgccccagaggcgccgccggccagagcagctgggcccccgccggccaggagttcgccagcttcctgaccaagggcagaagccacagcagcctgccccagatgagcagcagcagaagcaaggacagctgcttcaccgagaacacccccctgctgagaaacagcctgcaggagaagggcagcagatgcatccccgtgtaccaccccgagttcatcaccgccgaggagagctgggaggacagcagcgccgactgggagagaagatacctgctgagcagagaggtgagcggcctgagcgccagcgccagcagcgagaagggcgacctgctggacagcccccacatcagactgagactgagcaagctgagaagatgcgtgcagtggctgaaggtgatgggcctgttcgccttcgtggtgctgtgcagcatcctgttcagcctgtaccccgaccagggcaagctgtggcagctgctggccctgagccccctggagaactacagcgtgaacctgagcagccacgtggacagcaccctgctgcaggtggacctggccggcgccctggtggccagcggccccagcagacccggcagagaggagcacatcgtggtggagctgacccaggccgacgccctgggcagcagatggagaagaccccagcaggtgacccacaactggaccgtgtacctgaaccccagaagaagcgagcacagcgtgatgagcagaaccttcgaggtgctgaccagagagaccgtgagcatcagcatcagagccagcctgcagcagacccaggccgtgcccctgctgatggcccaccagtacctgagaggcagcgtggagacccaggtgaccatcgccaccgccatcctggccggcgtgtacgccctgatcatcttcgagatcgtgcacagaaccctggccgccatgctgggcagcctggccgccctggccgccctggccgtgatcggcgacagacccagcctgacccacgtggtggagtggatcgacttcgagaccctggccctgctgttcggcatgatgatcctggtggccatcttcagcgagaccggcttcttcgactactgcgccgtgaaggcctacagactgagcagaggcagagtgtgggccatgatcatcatgctgtgcctgatcgccgccgtgctgagcgccttcctggacaacgtgaccaccatgctgctgttcacccccgtgaccatcagactgtgcgaggtgctgaacctggaccccagacaggtgctgatcgccgaggtgatcttcaccaacatcggcggcgccgccaccgccatcggcgacccccccaacgtgatcatcgtgagcaaccaggagctgagaaagatgggcctggacttcgccggcttcaccgcccacatgttcatcggcatctgcctggtgctgctggtgtgcttccccctgctgagactgctgtactggaacagaaagctgtacaacaaggagcccagcgagatcgtggagctgaagcacgagatccacgtgtggagactgaccgcccagagaatcagccccgccagcagagaggagaccgccgtgagaagactgctgctgggcaaggtgctggccctggagcacctgctggccagaagactgcacaccttccacagacagatcagccaggaggacaagaactgggagaccaacatccaggagctgcagaagaagcacagaatcagcgacggcatcctgctggccaagtgcctgaccgtgctgggcttcgtgatcttcatgttcttcctgaacagcttcgtgcccggcatccacctggacctgggctggatcgccatcctgggcgccatctggctgctgatcctggccgacatccacgacttcgagatcatcctgcacagagtggagtgggccaccctgctgttcttcgccgccctgttcgtgctgatggaggccctggcccacctgcacctgatcgagtacgtgggcgagcagaccgccctgctgatcaagatggtgcccgaggagcagagactgatcgccgccatcgtgctggtggtgtgggtgagcgccctggccagcagcctgatcgacaacatccccttcaccgccaccatgatccccgtgctgctgaacctgagccacgaccccgaggtgggcctgcccgccccccccctgatgtacgccctggccttcggcgcctgcctgggcggcaacggcaccctgatcggcgccagcgccaacgtggtgtgcgccggcatcgccgagcagcacggctacggcttcagcttcatggagttcttcagactgggcttccccatgatggtggtgagctgcaccgtgggcatgtgctacctgctggtggcccacgtggtggtgggctggaactag

SEQ ID NO: 91872 - DNA, 2007 bp, Artificial Sequence
  Description of Artificial Sequence: Synthetic coding sequence
atgcacctggagggcagagacggcagaagataccccggcgcccccgccgtggagctgctgcagaccagcgtgcccagcggcctggccgagctggtggccggcaagagaagactgcccagaggcgccggcggcgccgaccccagccacagctgccccagaggcgccgccggccagagcagctgggcccccgccggccaggagttcgccagcttcctgaccaagggcagaagccacagcagcctgccccagatgagcagcagcagaagcaaggacagctgcttcaccgagaacacccccctgctgagaaacagcctgcaggagaagggcagcagatgcatccccgtgtaccaccccgagttcatcaccgccgaggagagctgggaggacagcagcgccgactgggagagaagatacctgctgagcagagaggtgagcggcctgagcgccagcgccagcagcgagaagggcgacctgctggacagcccccacatcagactgagactgagcaagctgagaagatgcgtgcagtggctgaaggtgatgggcctgttcgccttcgtggtgctgtgcagcatcctgttcagcctgtaccccgaccagggcaagctgtggcagctgctggccctgagccccctggagaactacagcgtgaacctgagcagccacgtggacagcaccctgctgcaggtggacctggccggcgccctggtggccagcggccccagcagacccggcagagaggagcacatcgtggtggagctgacccaggccgacgccctgggcagcagatggagaagaccccagcaggtgacccacaactggaccgtgtacctgaaccccagaagaagcgagcacagcgtgatgagcagaaccttcgaggtgctgaccagagagaccgtgagcatcagcatcagagccagcctgcagcagacccaggccgtgcccctgctgatggcccaccagtacctgagaggcagcgtggagacccaggtgaccatcgccaccgccatcctggccggcgtgtacgccctgatcatcttcgagatcgtgcacagaaccctggccgccatgctgggcagcctggccgccctggccgccctggccgtgatcggcgacagacccagcctgacccacgtggtggagtggatcgacttcgagaccctggccctgctgttcggcatgatgatcctggtggccatcttcagcgagaccggcttcttcgactactgcgccgtgaaggcctacagactgagcagaggcagagtgtgggccatgatcatcatgctgtgcctgatcgccgccgtgctgagcgccttcctggacaacgtgaccaccatgctgctgttcacccccgtgaccatcagactgtgcgaggtgctgaacctggaccccagacaggtgctgatcgccgaggtgatcttcaccaacatcggcggcgccgccaccgccatcggcgacccccccaacgtgatcatcgtgagcaaccaggagctgagaaagatgggcctggacttcgccggcttcaccgcccacatgttcatcggcatctgcctggtgctgctggtgtgcttccccctgctgagactgctgtactggaacagaaagctgtacaacaaggagcccagcgagatcgtggagctgaagcacgagatccacgtgtggagactgaccgcccagagaatcagccccgccagcagagaggagaccgccgtgagaagactgctgctgggcaaggtgctggccctggagcacctgctggccagaagactgcacaccttccacagacagatcagccaggaggacaagaactgggagaccaacatccaggagctgcagaagaagcacagaatcagcgacggcatcctgctggccaagtgcctgaccgtgctgggcttcgtgatcttcatgttcttcctgaacagcttcgtgcccggcatccacctggacctgggcggcctgggcctggtgcaggccggcagatactacctgagcacccccgagagctag

SEQ ID NO: 91873 - DNA, 795 bp, Artificial Sequence
  Description of Artificial Sequence: Synthetic coding sequence
atgcacctggagggcagagacggcagaagataccccggcgcccccgccgtggagctgctgcagaccagcgtgcccagcggcctggccgagctggtggccggcaagagaagactgcccagaggcgccggcggcgccgaccccagccacagctgccccagaggcgccgccggccagagcagctgggcccccgccggccaggagttcgccagcttcctgaccaagggcagaagccacagcagcctgccccagatgagcagcagcagaagcaaggacagctgcttcaccgagaacacccccctgctgagaaacagcctgcaggagaagggcagcagatgcatccccgtgtaccaccccgagttcatcaccgccgaggagagctgggaggacagcagcgccgactgggagagaagatacctgctgagcagagaggtgagcggcctgagcgccagcgccagcagcgagaagggcgacctgctggacagcccccacatcagactgagactgagcaagctgagaagatgcgtgcagtggctgaaggtgatgggcctgttcgccttcgtggtgctgtgcagcatcctgttcagcctgtaccccgaccagggcaagctgtggcagctgctggccctgagccccctggagaactacagcgtgaacctgagcagccacgtggacagcaccctgctgcaggtggacctggccggcgccctggtggccagcggccccagcagacccggcagagaggagcacatcgtggtggagctgacccaggccgacgccctgggcagcagatggtag

SEQ ID NO: 91874 - DNA, 657 bp, Artificial Sequence
  Description of Artificial Sequence: Synthetic coding sequence
atgcacctggagggcagagacggcagaagataccccggcgcccccgccgtggagctgctgcagaccagcgtgcccagcggcctggccgagctggtggccggcaagagaagactgcccagaggcgccggcggcgccgaccccagccacagctgccccagaggcgccgccggccagagcagctgggcccccgccggccaggagttcgccagcttcctgaccaagggcagaagccacagcagcctgccccagatgagcagcagcagaagcaaggacagctgcttcaccgagaacacccccctgctgagaaacagcctgcaggagaagggcagcagatgcatccccgtgtaccaccccgagttcatcaccgccgaggagagctgggaggacagcagcgccgactgggagagaagatacctgctgagcagagaggtgagcggcctgagcgccagcgccagcagcgagaagggcgacctgctggacagcccccacatcagactgagactgagcaagctgagaagatgcgtgcagtggctgaaggtgatgggcctgttcgccttcgtggtgctgtgcagcgtgacccacaactggaccgtgtacctgaaccccagaagaagcgagcacagcgtgatgagcagaaccttcgaggtgctgacctag

SEQ ID NO: 91875 - DNA, 801 bp, Artificial Sequence
  Description of Artificial Sequence: Synthetic coding sequence
atgggcagcaagaccctgcccgcccccgtgcccatccaccccagcctgcagctgaccaactacagcttcctgcaggccgtgaacggcctgcccaccgtgcccagcgaccacctgcccaacctgtacggcttcagcgccctgcacgccgtgcacctgcaccagtggaccctgggctaccccgccatgcacctgcccagaagcagcttcagcaaggtgcccggcaccgtgagcagcctggtggacgccagattccagctgcccgccttcccctggttcccccacgtgatccagcccaagcccgagatcaccgccggcggcagcgtgcccgccctgaagaccaagcccagattcgacttcgccaacctggccctggccgccacccaggaggaccccgccaagctgggcagaggcgagggccccggcagccccgccggcggcctgggcgccctgctggacgtgaccaagctgagccccgagaagaagcccaccagaggcagactgcccagcaagaccaagaaggagttcgtgtgcaagttctgcggcagacacttcaccaagagctacaacctgctgatccacgagagaacccacaccgacgagagaccctacacctgcgacatctgccacaaggccttcagaagacaggaccacctgagagaccacagatacatccacagcaaggagaagcccttcaagtgccaggagtgcggcaagggcttctgccagagcagaaccctggccgtgcacaagaccctgcacagccaggtgaaggagctgaagaccagcaagatcaagtgctag

SEQ ID NO: 91876 - DNA, 801 bp, Artificial Sequence; identical to SEQ ID NO: 91875
  Description of Artificial Sequence: Synthetic coding sequence

SEQ ID NO: 91877 - DNA, 939 bp, Artificial Sequence
  Description of Artificial Sequence: Synthetic coding sequence
atgggcagcaaggccctgcccgcccccatccccctgcaccccagcctgcagctgaccaactacagcttcctgcaggccgtgaacaccttccccgccaccgtggaccacctgcagggcctgtacggcctgagcgccgtgcagaccatgcacatgaaccactggaccctgggctaccccaacgtgcacgagatcaccagaagcaccatcaccgagatggccgccgcccagggcctggtggacgccagattccccttccccgccctgcccttcaccacccacctgttccaccccaagcagggcgccatcgcccacgtgctgcccgccctgcacaaggacagacccagattcgacttcgccaacctggccgtggccgccacccaggaggacccccccaagatgggcgacctgagcaagctgagccccggcctgggcagccccatcagcggcctgagcaagctgacccccgacagaaagcccagcagaggcagactgcccagcaagaccaagaaggagttcatctgcaagttctgcggcagacacttcaccaagagctacaacctgctgatccacgagagaacccacaccgacgagagaccctacacctgcgacatctgccacaaggccttcagaagacaggaccacctgagagaccacagatacatccacagcaaggagaagcccttcaagtgccaggagtgcggcaagggcttctgccagagcagaaccctggccgtgcacaagaccctgcacatgcaggagagcccccacaagtgccccacctgcggcagaaccttcaaccagagaagcaacctgaagacccacctgctgacccacaccgacatcaagccctacagctgcgagcagtgcggcaaggtgttcagaagaaactgcgacctgagaagacacagcctgacccacacccccagacaggacttctag

SEQ ID NO: 91878 - DNA, 831 bp, Artificial Sequence
  Description of Artificial Sequence: Synthetic coding sequence
atgggcagcaaggccctgcccgcccccatccccctgcaccccagcctgcagctgaccaactacagcttcctgcaggccgtgaacaccttccccgccaccgtggaccacctgcagggcctgtacggcctgagcgccgtgcagaccatgcacatgaaccactggaccctgggctaccccaacgtgcacgagatcaccagaagcaccatcaccgagatggccgccgcccagggcctggtggacgccagattccccttccccgccctgcccttcaccacccacctgttccaccccaagcagggcgccatcgcccacgtgctgcccgccctgcacaaggacagacccagattcgacttcgccaacctggccgtggccgccacccaggaggacccccccaagatgggcgacctgagcaagctgagccccggcctgggcagccccatcagcggcctgagcaagctgacccccgacagaaagcccagcagaggcagactgcccagcaagaccaagaaggagttcatctgcaagttctgcggcagacacttcaccaagagctacaacctgctgatccacgagagaacccacaccgacgagagaccctacacctgcgacatctgccacaaggccttcagaagacaggaccacctgagagaccacagatacatccacagcaaggagaagcccttcaagtgccaggagtgcggcaagggcttctgccagagcagaaccctggccgtgcacaagaccctgcacatgcagaccagcagccccaccgccgccagcagcgccgccaagtgcagcggcgagaccgtgatctgcggcggcaccgcctag

SEQ ID NO: 91879 - DNA, 1302 bp, Artificial Sequence
  Description of Artificial Sequence: Synthetic coding sequence
atgggcctgagagccgaggagggcaagagaaagccccccagaagcgtgagaggcgaggtgagccccagccagggccccctggcccaggaggacgaggccagaagactgagaagctgcacccccgcctgccaccccggcaagagaggcaagggcggccacagagccagaagacagagaagcgcctgggacctgaccacccaccccctgacccacagaagccaggagctgagaggcgccgccgccaccgagggcttcctgtacgtgctgctgagccactgggtgttcgtgggcgcccccagaccccccgccagcgacagctggaagaagggcctggtgcccagcgccccccccgccagcagaaagatgggcagcaaggccctgcccgcccccatccccctgcaccccagcctgcagctgaccaactacagcttcctgcaggccgtgaacaccttccccgccaccgtggaccacctgcagggcctgtacggcctgagcgccgtgcagaccatgcacatgaaccactggaccctgggctaccccaacgtgcacgagatcaccagaagcaccatcaccgagatggccgccgcccagggcctggtggacgccagattccccttccccgccctgcccttcaccacccacctgttccaccccaagcagggcgccatcgcccacgtgctgcccgccctgcacaaggacagacccagattcgacttcgccaacctggccgtggccgccacccaggaggacccccccaagatgggcgacctgagcaagctgagccccggcctgggcagccccatcagcggcctgagcaagctgacccccgacagaaagcccagcagaggcagactgcccagcaagaccaagaaggagttcatctgcaagttctgcggcagacacttcaccaagagctacaacctgctgatccacgagagaacccacaccgacgagagaccctacacctgcgacatctgccacaaggccttcagaagacaggaccacctgagagaccacagatacatccacagcaaggagaagcccttcaagtgccaggagtgcggcaagggcttctgccagagcagaaccctggccgtgcacaagaccctgcacatgcaggagagcccccacaagtgccccacctgcggcagaaccttcaaccagagaagcaacctgaagacccacctgctgacccacaccgacatcaagccctacagctgcgagcagtgcggcaaggtgttcagaagaaactgcgacctgagaagacacagcctgacccacacccccagacaggacttctag

SEQ ID NO: 91880 - DNA, 642 bp, Artificial Sequence
  Description of Artificial Sequence: Synthetic coding sequence
atgggcagcaaggccctgcccgcccccatccccctgcaccccagcctgcagctgaccaactacagcttcctgcaggccgtgaacaccttccccgccaccgtggaccacctgcagggcctgtacggcctgagcgccgtgcagaccatgcacatgaaccactggaccctgggctaccccaacgtgcacgagatcaccagaagcaccatcaccgagatggccgccgcccagggcctggtggacgccagattccccttccccgccctgcccttcaccacccacctgttccaccccaagcagggcgccatcgcccacgtgctgcccgccctgcacaaggacagacccagattcgacttcgccaacctggccgtggccgccacccaggaggacccccccaagatgggcgacctgagcaagctgagccccggcctgggcagccccatcagcggcctgagcaagctgacccccgacagaaagcccagcagaggcagactgcccagcaagaccaagaaggagttcatctgcaagttctgcggcagacacttcaccaagagctacaacctgctgatccacgagagaacccacaccgacgagagaccctacacctgcgacatctgccacaaggccttcagaagacaggactag

SEQ ID NO: 91881 - DNA, 939 bp, Artificial Sequence; identical to SEQ ID NO: 91877
  Description of Artificial Sequence: Synthetic coding sequence

SEQ ID NO: 91882 - DNA, 687 bp, Artificial Sequence
  Description of Artificial Sequence: Synthetic coding sequence
atgaagaccctgttcctgggcgtgaccctgggcctggccgccgccctgagcttcaccctggaggaggaggacatcaccggcacctggtacgtgaaggccatggtggtggacaaggacttccccgaggacagaagacccagaaaggtgagccccgtgaaggtgaccgccctgggcggcggcaacctggaggccaccttcaccttcatgagagaggacagatgcatccagaagaagatcctgatgagaaagaccgaggagcccggcaagttcagcgcctacggcggcagaaagctgatctacctgcaggagctgcccggcaccgacgactacgtgttctactgcaaggaccagagaagaggcggcctgagatacatgggcaagctggtggccagcgccccctgcagagccgtgcccctgagccccccctggctgacctggcccccccacctgcaggtgggcatcctgatccccacctggagaccctggaagaacctgagaaactggtgcagcaccagagacagcagaagaagaaccttcagctgcccctgcagaagagaggccgccttcagcaacaccagacagccccccggcctgcacctgcagagccccccctaccaccagacccagagccccgaccacctggacctgcccagcagccacgaccccagcctgctgccccccacctag

SEQ ID NO: 91883 - DNA, 444 bp, Artificial Sequence
  Description of Artificial Sequence: Synthetic coding sequence
atgaagaccctgttcctgggcgtgaccctgggcctggccgccgccctgagcttcaccctggaggaggaggacgagggcggcagcgtgcaccccgaggagaaccccgacgccgaggacggcggcgcctggcagatccagagactgtggggccaggaggcccacatccccgccggcgccgccagagacggcagactgagactgctgctgcagagacccgccccctggggccccgccctgcacggcaaggcctgcggcatctgcagcctgcagggcagagccgccgtgcccaccctggcccacctggccaccagccccgccggcagaaaccccaacaccaacctggaggccctggaggagttcaagaagctggtgcagcacaagggcctgagcgaggaggacatcttcatgcccctgcagaccggcagctgcgtgctggagcactag

SEQ ID NO: 91884 - DNA, 513 bp, Artificial Sequence
  Description of Artificial Sequence: Synthetic coding sequence
atgaagaccctgttcctgggcgtgaccctgggcctggccgccgccctgagcttcaccctggaggaggaggacatcaccggcacctggtacgtgaaggccatggtggtggacaaggacttccccgaggacagaagacccagaaaggtgagccccgtgaaggtgaccgccctgggcggcggcaacctggaggccaccttcaccttcatgagagaggacagatgcatccagaagaagatcctgatgagaaagaccgaggagcccggcaagttcagcgcctacggcggcagaaagctgatctacctgcaggagctgcccggcaccgacgactacgtgttctactgcaaggaccagagaagaggcggcctgagatacatgggcaagctggtgggcagaaaccccaacaccaacctggaggccctggaggagttcaagaagctggtgcagcacaagggcctgagcgaggaggacatcttcatgcccctgcagaccggcagctgcgtgctggagcactag

SEQ ID NO: 91885 - DNA, 513 bp, Artificial Sequence; identical to SEQ ID NO: 91884
  Description of Artificial Sequence: Synthetic coding sequence

SEQ ID NO: 91886 - DNA, 258 bp, Artificial Sequence
  Description of Artificial Sequence: Synthetic coding sequence
atgaagaccctgttcctgggcgtgaccctgggcctggccgccgccctgagcttcaccctggaggaggaggacgacggcccctgggtgcaccccgaggagaaccccgacgccgaggacggcggcgcctggcagatccagagactgtggggccaggaggcccacgtgcccgccggcgccgcccaggagggccccctgcacctgctgctgcagagacccgccccctggggccccgccccccacggcaaggcctgcggctag

SEQ ID NO: 91887 - DNA, 513 bp, Artificial Sequence
  Description of Artificial Sequence: Synthetic coding sequence
atgaagaccctgttcctgggcgtgaccctgggcctggccgccgccctgagcttcaccctggaggaggaggacatcaccggcacctggtacgtgaaggccatggtggtggacaaggacttccccgaggacagaagacccagaaaggtgagccccgtgaaggtgaccgccctgggcggcggcaagctggaggccaccttcaccttcatgagagaggacagatgcatccagaagaagatcctgatgagaaagaccgaggagcccggcaagtacagcgcctacggcggcagaaagctgatgtacctgcaggagctgcccagaagagaccactacatcttctactgcaaggaccagcaccacggcggcctgctgcacatgggcaagctggtgggcagaaacagcgacaccaacagagaggccctggaggagttcaagaagctggtgcagagaaagggcctgagcgaggaggacatcttcacccccctgcagaccggcagctgcgtgcccgagcactag

SEQ ID NO: 91888 - DNA, 8310 bp, Artificial Sequence
  Description of Artificial Sequence: Synthetic coding sequence
atggacgtgaaggagagaaagccctacagaagcctgaccagaagaagagacgccgagagaagatacaccagcagcagcgccgacagcgaggagggcaaggccccccagaagagctacagcagcagcgagaccctgaaggcctacgaccaggacgccagactggcctacggcagcagagtgaaggacatcgtgccccaggaggccgaggagttctgcagaaccggcgccaacttcaccctgagagagctgggcctggaggaggtgacccccccccacggcaccctgtacagaaccgacatcggcctgccccactgcggctacagcatgggcgccggcagcgacgccgacatggaggccgacaccgtgctgagccccgagcaccccgtgagactgtggggcagaagcaccagaagcggcagaagcagctgcctgagcagcagagccaacagcaacctgaccctgaccgacaccgagcacgagaacaccgagaccgaccaccccggcggcctgcagaaccacgccagactgagaaccccccccccccccctgagccacgcccacacccccaaccagcaccacgccgccagcatcaacagcctgaacagaggcaacttcacccccagaagcaaccccagccccgcccccaccgaccacagcctgagcggcgagccccccgccggcggcgcccaggagcccgcccacgcccaggagaactggctgctgaacagcaacatccccctggagaccagaaacctgggcaagcagcccttcctgggcaccctgcaggacaacctgatcgagatggacatcctgggcgccagcagacacgacggcgcctacagcgacggccacttcctgttcaagcccggcggcaccagccccctgttctgcaccaccagccccggctaccccctgaccagcagcaccgtgtacagccccccccccagacccctgcccagaagcaccttcgccagacccgccttcaacctgaagaagcccagcaagtactgcaactggaagtgcgccgccctgagcgccatcgtgatcagcgccaccctggtgatcctgctggcctacttcgtggccatgcacctgttcggcctgaactggcacctgcagcccatggagggccagatgtacgagatcaccgaggacaccgccagcagctggcccgtgcccaccgacgtgagcctgtaccccagcggcggcaccggcctggagacccccgacagaaagggcaagggcaccaccgagggcaagcccagcagcttcttccccgaggacagcttcatcgacagcggcgagatcgacgtgggcagaagagccagccagaagatcccccccggcaccttctggagaagccaggtgttcatcgaccaccccgtgcacctgaagttcaacgtgagcctgggcaaggccgccctggtgggcatctacggcagaaagggcctgccccccagccacacccagttcgacttcgtggagctgctggacggcagaagactgctgacccaggaggccagaagcctggagggcacccccagacagagcagaggcaccgtgccccccagcagccacgagaccggcttcatccagtacctggacagcggcatctggcacctggccttctacaacgacggcaaggagagcgaggtggtgagcttcctgaccaccgccatcgagagcgtggacaactgccccagcaactgctacggcaacggcgactgcatcagcggcacctgccactgcttcctgggcttcctgggccccgactgcggcagagccagctgccccgtgctgtgcagcggcaacggccagtacatgaagggcagatgcctgtgccacagcggctggaagggcgccgagtgcgacgtgcccaccaaccagtgcatcgacgtggcctgcagcaaccacggcacctgcatcaccggcacctgcatctgcaaccccggctacaagggcgagagctgcgaggaggtggactgcatggaccccacctgcagcggcagaggcgtgtgcgtgagaggcgagtgccactgcagcgtgggctggggcggcaccaactgcgagacccccagagccacctgcctggaccagtgcagcggccacggcaccttcctgcccgacaccggcctgtgcagctgcgaccccagctggaccggccacgactgcagcatcgagatctgcgccgccgactgcggcggccacggcgtgtgcgtgggcggcacctgcagatgcgaggacggctggatgggcgccgcctgcgaccagagagcctgccaccccagatgcgccgagcacggcacctgcagagacggcaagtgcgagtgcagccccggctggaacggcgagcactgcaccatcgcccactacctggacagagtggtgaaggagggctgccccggcctgtgcaacggcaacggcagatgcaccctggacctgaacggctggcactgcgtgtgccagctgggctggagaggcgccggctgcgacaccagcatggagaccgcctgcggcgacagcaaggacaacgacggcgacggcctggtggactgcatggaccccgactgctgcctgcagcccctgtgccacatcaaccccctgtgcctgggcagccccaaccccctggacatcatccaggagacccaggtgcccgtgagccagcagaacctgcacagcttctacgacagaatcaagttcctggtgggcagagacagcacccacatcatccccggcgagaaccccttcgacggcggccacgcctgcgtgatcagaggccaggtgatgaccagcgacggcacccccctggtgggcgtgaacatcagcttcgtgaacaaccccctgttcggctacaccatcagcagacaggacggcagcttcgacctggtgaccaacggcggcatcagcatcatcctgagattcgagagagcccccttcatcacccaggagcacaccctgtggctgccctgggacagattcttcgtgatggagaccatcatcatgagacacgaggagaacgagatccccagctgcgacctgagcaacttcgccagacccaaccccgtggtgagccccagccccctgaccagcttcgccagcagctgcgccgagaagggccccatcgtgcccgagatccaggccctgcaggaggagatcagcatcagcggctgcaagatgagactgagctacctgagcagcagaacccccggctacaagagcgtgctgagaatcagcctgacccaccccaccatccccttcaacctgatgaaggtgcacctgatggtggccgtggagggcagactgttcagaaagtggttcgccgccgcccccgacctgagctactacttcatctgggacaagaccgacgtgtacaaccagaaggtgttcggcctgagcgaggccttcgtgagcgtgggctacgagtacgagagctgccccgacctgatcctgtgggagaagagaaccaccgtgctgcagggctacgagatcgacgccagcaagctgggcggctggagcctggacaagcaccacgccctgaacatccagagcggcatcctgcacaagggcaacggcgagaaccagttcgtgagccagcagccccccgtgatcggcagcatcatgggcaacggcagaagaagaagcatcagctgccccagctgcaacggcctggccgacggcaacaagctgctggcccccgtggccctgacctgcggcagcgacggcagcctgtacgtgggcgacttcaactacatcagaagaatcttccccagcggcaacgtgaccaacatcctggagctgagaaacaaggacttcagacacagccacagccccgcccacaagtactacctggccaccgaccccatgagcggcgccgtgttcctgagcgacagcaacagcagaagagtgttcaagatcaagagcaccgtggtggtgaaggacctggtgaagaacagcgaggtggtggccggcaccggcgaccagtgcctgcccttcgacgacaccagatgcggcgacggcggcaaggccaccgaggccaccctgaccaaccccagaggcatcaccgtggacaagttcggcctgatctacttcgtggacggcaccatgatcagaagaatcgaccagaacggcatcatcagcaccctgctgggcagcaacgacctgaccagcgccagacccctgagctgcgacagcgtgatggacatcagccaggtgcacctggagtggcccaccgacctggccatcaaccccatggacaacagcctgtacgtgctggacaacaacgtggtgctgcagatcagcgagaaccaccaggtgagaatcgtggccggcagacccatgcactgccaggtgcccggcatcgaccacttcctgctgagcaaggtggccatccacgccaccctggagagcgccaccgccctggccgtgagccacaacggcgtgctgtacatcgccgagaccgacgagaagaagatcaacagaatcagacaggtgaccaccagcggcgagatcagcctggtggccggcgcccccagcggctgcgactgcaagaacgacgccaactgcgactgcttcagcggcgacgacggctacgccaaggacgccaagctgaacacccccagcagcctggccgtgtgcgccgacggcgagctgtacgtggccgacctgggcaacatcagaatcagattcatcagaaagaacaagcccttcctgaacacccagaacatgtacgagctgagcagccccatcgaccaggagctgtacctgttcgacaccaccggcaagcacctgtacacccagagcctgcccaccggcgactacctgtacaacttcacctacaccggcgacggcgacatcaccctgatcaccgacaacaacggcaacatggtgaacgtgagaagagacagcaccggcatgcccctgtggctggtggtgcccgacggccaggtgtactgggtgaccatgggcaccaacagcgccctgaagagcgtgaccacccagggccacgagctggccatgatgacctaccacggcaacagcggcctgctggccaccaagagcaacgagaacggctggaccaccttctacgagtacgacagcttcggcagactgaccaacgtgaccttccccaccggccaggtgagcagcttcagaagcgacaccgacagcagcgtgcacgtgcaggtggagaccagcagcaaggacgacgtgaccatcaccaccaacctgagcgccagcggcgccttctacaccctgctgcaggaccaggtgagaaacagctactacatcggcgccgacggcagcctgagactgctgctggccaacggcatggaggtggccctgcagaccgagccccacctgctggccggcaccgtgaaccccaccgtgggcaagagaaacgtgaccctgcccatcgacaacggcctgaacctggtggagtggagacagagaaaggagcaggccagaggccaggtgaccgtgttcggcagaagactgagagtgcacaacagaaacctgctgagcctggacttcgacagagtgaccagaaccgagaagatctacgacgaccacagaaagttcaccctgagaatcctgtacgaccaggccggcagacccagcctgtggagccccagcagcagactgaacggcgtgaacgtgacctacagccccggcggctacatcgccggcatccagagaggcatcatgagcgagagaatggagtacgaccaggccggcagaatcaccagcagaatcttcgccgacggcaagacctggagctacacctacctggagaagagcatggtgctgctgctgcacagccagagacagtacatcttcgagttcgacaagaacgacagactgagcagcgtgaccatgcccaacgtggccagacagaccctggagaccatcagaagcgtgggctactacagaaacatctaccagccccccgagggcaacgccagcgtgatccaggacttcaccgaggacggccacctgctgcacaccttctacctgggcaccggcagaagagtgatctacaagtacggcaagctgagcaagctggccgagaccctgtacgacaccaccaaggtgagcttcacctacgacgagaccgccggcatgctgaagaccatcaacctgcagaacgagggcttcacctgcaccatcagatacagacagatcggccccctgatcgacagacagatcttcagattcaccgaggagggcatggtgaacgccagattcgactacaactacgacaacagcttcagagtgaccagcatgcaggccgtgatcaacgagacccccctgcccatcgacctgtacagatacgacgacgtgagcggcaagaccgagcagttcggcaagttcggcgtgatctactacgacatcaaccagatcatcaccaccgccgtgatgacccacaccaagcacttcgacgcctacggcagaatgaaggaggtgcagtacgagatcttcagaagcctgatgtactggatgaccgtgcagtacgacaacatgggcagagtggtgaagaaggagctgaaggtgggcccctacgccaacaccaccagatacagctacgagtacgacgccgacggccagctgcagaccgtgagcatcaacgacaagcccctgtggagatacagctacgacctgaacggcaacctgcacctgctgagccccggcaacagcgccagactgacccccctgagatacgacatcagagacagaatcaccagactgggcgacgtgcagtacaagatggacgaggacggcttcctgagacagagaggcggcgacatcttcgagtacaacagcgccggcctgctgatcaaggcctacaacagagccggcagctggagcgtgagatacagatacgacggcctgggcagaagagtgagcagcaagagcagccacagccaccacctgcagttcttctacgccgacctgaccaaccccaccaaggtgacccacctgtacaaccacagcagcagcgagatcaccagcctgtactacgacctgcagggccacctgttcgccatggagctgagcagcggcgacgagttctacatcgcctgcgacaacatcggcacccccctggccgtgttcagcggcaccggcctgatgatcaagcagatcctgtacaccgcctacggcgagatctacatggacaccaaccccaacttccagatcatcatcggctaccacggcggcctgtacgaccccctgaccaagctggtgcacatgggcagaagagactacgacgtgctggccggcagatggaccagccccgaccacgagctgtggaagcacctgagcagcagcaacgtgatgcccttcaacctgtacatgttcaagaacaacaaccccatcagcaacagccaggacatcaagtgcttcatgaccgacgtgaacagctggctgctgaccttcggcttccagctgcacaacgtgatccccggctaccccaagcccgacatggacgccatggagcccagctacgagctgatccacacccagatgaagacccaggagtgggacaacagcaagagcatcctgggcgtgcagtgcgaggtgcagaagcagctgaaggccttcgtgaccctggagagattcgaccagctgtacggcagcaccatcaccagctgccagcaggcccccaagaccaagaagttcgccagcagcggcagcgtgttcggcaagggcgtgaagttcgccctgaaggacggcagagtgaccaccgacatcatcagcgtggccaacgaggacggcagaagagtggccgccatcctgaaccacgcccactacctggagaacctgcacttcaccatcgacggcgtggacacccactacttcgtgaagcccggccccagcgagggcgacctggccatcctgggcctgagcggcggcagaagaaccctggagaacggcgtgaacgtgaccgtgagccagatcaacaccgtgctgaacggcagaaccagaagatacaccgacatccagctgcagtacggcgccctgtgcctgaacaccagatacggcaccaccctggacgaggagaaggccagagtgctggagctggccagacagagagccgtgagacaggcctgggccagagagcagcagagactgagagagggcgaggagggcctgagagcctggaccgagggcgagaagcagcaggtgctgagcaccggcagagtgcagggctacgacggcttcttcgtgatcagcgtggagcagtaccccgagctgagcgacagcgccaacaacatccacttcatgagacagagcgagatgggcagaagatag

SEQ ID NO: 91889 - DNA, 6 bp, Artificial Sequence
  Description of Artificial Sequence: Synthetic coding sequence
atgtag

SEQ ID NO: 91890 - DNA, 1404 bp, Artificial Sequence
  Description of Artificial Sequence: Synthetic coding sequence
atgcccggcagatggagatggcagagagacatgcaccccgccagaaagctgctgagcctgctgttcctgatcctgatgggcaccgagctgacccaggtgctgcccaccaaccccgaggagagctggcaggtgtacagcagcgcccaggacagcgagggcagatgcatctgcaccgtggtggccccccagcagaccatgtgcagcagagacgccagaaccaagcagctgagacagctgctggagaaggtgcagaacatgagccagagcatcgaggtgctggacagaagaacccagagagacctgcagtacgtggagaagatggagaaccagatgaagggcctggagagcaagttcaagcaggtggaggagagccacaagcagcacctggccagacagttcaaggccatcaaggccaagatggacgagctgagacccctgatccccgtgctggaggagtacaaggccgacgccaagctggtgctgcagttcaaggaggaggtgcagaacctgaccagcgtgctgaacgagctgcaggaggagatcggcgcctacgactacgacgagctgcagagcagagtgagcaacctggaggagagactgagagcctgcatgcagaagctggcctgcggcaagctgaccggcatcagcgaccccgtgaccgtgaagaccagcggcagcagattcggcagctggatgaccgaccccctggcccccgagggcgacaacagagtgtggtacatggacggctaccacaacaacagattcgtgagagagtacaagagcatggtggacttcatgaacaccgacaacttcaccagccacagactgccccacccctggagcggcaccggccaggtggtgtacaacggcagcatctacttcaacaagttccagagccacatcatcatcagattcgacctgaagaccgagaccatcctgaagaccagaagcctggactacgccggctacaacaacatgtaccactacgcctggggcggccacagcgacatcgacctgatggtggacgagagcggcctgtgggccgtgtacgccaccaaccagaacgccggcaacatcgtggtgagcagactggaccccgtgagcctgcagaccctgcagacctggaacaccagctaccccaagagaagcgccggcgaggccttcatcatctgcggcaccctgtacgtgaccaacggctacagcggcggcaccaaggtgcactacgcctaccagaccaacgccagcacctacgagtacatcgacatccccttccagaacaagtacagccacatcagcatgctggactacaaccccaaggacagagccctgtacgcctggaacaacggccaccagatcctgtacaacgtgaccctgttccacgtgatcagaagcgacgagctgtag

SEQ ID NO: 91891 - DNA, 408 bp, Artificial Sequence
  Description of Artificial Sequence: Synthetic coding sequence
atgcccggcagatggagatggcagagagacatgcaccccgccagaaagctgctgagcctgctgttcctgatcctgatgggcaccgagctgacccaggtgctgcccaccaaccccgaggagagctggcaggtgtacagcagcgcccaggacagcgagggcagatgcatctgcaccgtggtggccccccagcagaccatgtgcagcagagacgccagaaccaagcagctgagacagctgctggagaaggtgcagaacatgagccagagcatcgaggtgctggacagaagaacccagagagacctgcagtacgtggagaagatggagaaccagatgaagggcctggagagcaagttcaagcaggtggaggagagccacaagcagcacctggccagacagttcaagggctag

SEQ ID NO: 91892 - DNA, 1458 bp, Artificial Sequence
  Description of Artificial Sequence: Synthetic coding sequence
atgagcgtgcccctgctgaagatcggcgtggtgctgagcaccatggccatgatcaccaactggatgagccagaccctgcccagcctggtgggcctgaacaccaccaagctgagcgccgccggcggcggcaccctggacagaagcaccggcgtgctgcccaccaaccccgaggagagctggcaggtgtacagcagcgcccaggacagcgagggcagatgcatctgcaccgtggtggccccccagcagaccatgtgcagcagagacgccagaaccaagcagctgagacagctgctggagaaggtgcagaacatgagccagagcatcgaggtgctggacagaagaacccagagagacctgcagtacgtggagaagatggagaaccagatgaagggcctggagagcaagttcaagcaggtggaggagagccacaagcagcacctggccagacagttcaaggccatcaaggccaagatggacgagctgagacccctgatccccgtgctggaggagtacaaggccgacgccaagctggtgctgcagttcaaggaggaggtgcagaacctgaccagcgtgctgaacgagctgcaggaggagatcggcgcctacgactacgacgagctgcagagcagagtgagcaacctggaggagagactgagagcctgcatgcagaagctggcctgcggcaagctgaccggcatcagcgaccccgtgaccgtgaagaccagcggcagcagattcggcagctggatgaccgaccccctggcccccgagggcgacaacagagtgtggtacatggacggctaccacaacaacagattcgtgagagagtacaagagcatggtggacttcatgaacaccgacaacttcaccagccacagactgccccacccctggagcggcaccggccaggtggtgtacaacggcagcatctacttcaacaagttccagagccacatcatcatcagattcgacctgaagaccgagaccatcctgaagaccagaagcctggactacgccggctacaacaacatgtaccactacgcctggggcggccacagcgacatcgacctgatggtggacgagagcggcctgtgggccgtgtacgccaccaaccagaacgccggcaacatcgtggtgagcagactggaccccgtgagcctgcagaccctgcagacctggaacaccagctaccccaagagaagcgccggcgaggccttcatcatctgcggcaccctgtacgtgaccaacggctacagcggcggcaccaaggtgcactacgcctaccagaccaacgccagcacctacgagtacatcgacatccccttccagaacaagtacagccacatcagcatgctggactacaaccccaaggacagagccctgtacgcctggaacaacggccaccagatcctgtacaacgtgaccctgttccacgtgatcagaagcgacgagctgtag

SEQ ID NO: 91893 - DNA, 1377 bp, Artificial Sequence
  Description of Artificial Sequence: Synthetic coding sequence
atgggcgaggcccccggcagagagggcagaggcccctgcccccagctggagagccccagaagaagaagagtgctgcccaccaaccccgaggagagctggcaggtgtacagcagcgcccaggacagcgagggcagatgcatctgcaccgtggtggccccccagcagaccatgtgcagcagagacgccagaaccaagcagctgagacagctgctggagaaggtgcagaacatgagccagagcatcgaggtgctggacagaagaacccagagagacctgcagtacgtggagaagatggagaaccagatgaagggcctggagagcaagttcaagcaggtggaggagagccacaagcagcacctggccagacagttcaaggccatcaaggccaagatggacgagctgagacccctgatccccgtgctggaggagtacaaggccgacgccaagctggtgctgcagttcaaggaggaggtgcagaacctgaccagcgtgctgaacgagctgcaggaggagatcggcgcctacgactacgacgagctgcagagcagagtgagcaacctggaggagagactgagagcctgcatgcagaagctggcctgcggcaagctgaccggcatcagcgaccccgtgaccgtgaagaccagcggcagcagattcggcagctggatgaccgaccccctggcccccgagggcgacaacagagtgtggtacatggacggctaccacaacaacagattcgtgagagagtacaagagcatggtggacttcatgaacaccgacaacttcaccagccacagactgccccacccctggagcggcaccggccaggtggtgtacaacggcagcatctacttcaacaagttccagagccacatcatcatcagattcgacctgaagaccgagaccatcctgaagaccagaagcctggactacgccggctacaacaacatgtaccactacgcctggggcggccacagcgacatcgacctgatggtggacgagagcggcctgtgggccgtgtacgccaccaaccagaacgccggcaacatcgtggtgagcagactggaccccgtgagcctgcagaccctgcagacctggaacaccagctaccccaagagaagcgccggcgaggccttcatcatctgcggcaccctgtacgtgaccaacggctacagcggcggcaccaaggtgcactacgcctaccagaccaacgccagcacctacgagtacatcgacatccccttccagaacaagtacagccacatcagcatgctggactacaaccccaaggacagagccctgtacgcctggaacaacggccaccagatcctgtacaacgtgaccctgttccacgtgatcagaagcgacgagctgtag

SEQ ID NO: 91894 - DNA, 462 bp, Artificial Sequence
  Description of Artificial Sequence: Synthetic coding sequence
atgagcgtgcccctgctgaagatcggcgtggtgctgagcaccatggccatgatcaccaactggatgagccagaccctgcccagcctggtgggcctgaacaccaccaagctgagcgccgccggcggcggcaccctggacagaagcaccggcgtgctgcccaccaaccccgaggagagctggcaggtgtacagcagcgcccaggacagcgagggcagatgcatctgcaccgtggtggccccccagcagaccatgtgcagcagagacgccagaaccaagcagctgagacagctgctggagaaggtgcagaacatgagccagagcatcgaggtgctggacagaagaacccagagagacctgcagtacgtggagaagatggagaaccagatgaagggcctggagagcaagttcaagcaggtggaggagagccacaagcagcacctggccagacagttcaagggctag

SEQ ID NO: 91895 - DNA, 729 bp, Artificial Sequence
  Description of Artificial Sequence: Synthetic coding sequence
atgaacctgcacgtgaagaccctgagcctgatgacctggagaagcagattcctggaggagagcttctggagcctggaggagaccgccgccctggccaagcagctgcccctgaagagccccagcgagaacatcttcctgcacatcgtggacctgagcgaccccaagcagatctggaagttcgtggagaacttcaagcaggagcacaagctgcacgtgctgatcaacaacgccggctgcatggtgaacaagagagagctgaccgaggacggcctggagaagaacttcgccgccaacaccctgggcgtgtacatcctgaccaccggcctgatccccgtgctggagaaggagcacgaccccagagtgatcaccgtgagcagcggcggcatgctggtgcagaagctgaacaccaacgacctgcagagcgagagaacccccttcgacggcaccatggtgtacgcccagaacaagagacagcaggtggtgctgaccgagagatgggcccagggccaccccgccatccacttcagcagcatgcaccccggctgggccgacacccccggcgtgagacaggccatgcccggcttccacgccagattcggcgacagactgagaagcgaggcccagggcgccgacaccatgctgtggctggccctgagcagcgccgccgccgcccagcccagcggcagattcttccagggcgacttcctgcccggctgcgagggcagctag

SEQ ID NO: 91896 - DNA, 492 bp, Artificial Sequence
  Description of Artificial Sequence: Synthetic coding sequence
atggccgaggacagaccccagcagccccagctggacatgcccctggtgctggaccagggcctgaccagacagatgagactgagagtggagagcctgaagcagagaggcgagaagagacaggacggcgagaagctgctgcagcccgccgagagcgtgtacagactgaacttcacccagcagcagagactgcagttcgagagatggaacgtggtgctggacaagcccggcaaggtgaccatcaccggcaccagccagaactggacccccgacctgaccaacctgatgaccagacagctgctggaccccaccgccatcttctggagaaaggaggacagcgacgccatcgactggaacgaggccgacgccctggagttcggcgagagactgagcgacctggccaagatcagaaaggtgatgtacttcctggtgaccttcggcgagggcgtggagcccgccaacctgaaggccagcgtggtgttcaaccagctgtag

SEQ ID NO: 91897 - DNA, 939 bp, Artificial Sequence
  Description of Artificial Sequence: Synthetic coding sequence
atggacggcggcaaccagagcgagggcagcgagttcctgctgctgggcatgagcgagagccccgagcagcagagaatcctgttctggatgttcctgagcatgtacctggtgaccgtggtgggcaacgtgctgatcatcctggccatcagcagcgacagcagactgcacacccccgtgtacttcttcctggccaacctgagcttcaccgacctgttcttcgtgaccaacaccatccccaagatgctggtgaacctgcagagccacaacaaggccatcagctacgccggctgcctgacccagctgtacttcctggtgagcctggtggccctggacaacctgatcctggccgtgatggcctacgacagatacgtggccatctgctgccccctgcactacaccaccgccatgagccccaagctgtgcatcctgctgctgagcctgtgctgggtgctgagcgtgctgtacggcctgatccacaccctgctgatgaccagagtgaccttctgcggcagcagaaagatccactacatcttctgcgagatgtacgtgctgctgagaatggcctgcagcaacatccagatcaaccacaccgtgctgatcgccaccggctgcttcatcttcctgatccccttcggcttcgtgatcatcagctacgtgctgatcatcagagccatcctgagaatccccagcgtgagcaagaagtacaaggccttcagcacctgcgccagccacctgggcgccgtgagcctgttctacggcaccctgtgcatggtgtacctgaagcccctgcacacctacagcgtgaaggacagcgtggccaccgtgatgtacgccgtggtgacccccatgatgaaccccttcatctacagcctgagaaacaaggacatgcacggcgccctgggcagactgctggacaagcacttcaagagactgacctag

SEQ ID NO: 91898 - DNA, 939 bp, Artificial Sequence
  Description of Artificial Sequence: Synthetic coding sequence
atgagcggcaccaaccagagcagcgtgagcgagttcctgctgctgggcctgagcagacagccccagcagcagcacctgctgttcgtgttcttcctgagcatgtacctggccaccgtgctgggcaacctgctgatcatcctgagcgtgagcatcgacagctgcctgcacacccccatgtacttcttcctgagcaacctgagcttcgtggacatctgcttcagcttcaccaccgtgcccaagatgctggccaaccacatcctggagacccagaccatcagcttctgcggctgcctgacccagatgtacttcgtgttcatgttcgtggacatggacaacttcctgctggccgtgatggcctacgaccacttcgtggccgtgtgccaccccctgcactacaccgccaagatgacccaccagctgtgcgccctgctggtggccggcctgtgggtggtggccaacctgaacgtgctgctgcacaccctgctgatggcccccctgagcttctgcgccgacaacgccatcacccacttcttctgcgacgtgacccccctgctgaagctgagctgcagcgacacccacctgaacgaggtgatcatcctgagcgagggcgccctggtgatgatcacccccttcctgtgcatcctggccagctacatgcacatcacctgcaccgtgctgaaggtgcccagcaccaagggcagatggaaggccttcagcacctgcggcagccacctggccgtggtgctgctgttctacagcaccatcatcgccgtgtacttcaaccccctgagcagccacagcgccgagaaggacaccatggccaccgtgctgtacaccgtggtgacccccatgctgaaccccttcatctacagcctgagaaacagatacctgaagggcgccctgaagaaggtggtgggcagagtggtgttcagcgtgtag

SEQ ID NO: 91899 - DNA, 924 bp, Artificial Sequence
  Description of Artificial Sequence: Synthetic coding sequence
atgaaccacagcgtggtgaccgagttcatcatcctgggcctgaccaagaagcccgagctgcagggcatcatcttcctgttcttcctgatcgtgtacctggtggccttcctgggcaacatgctgatcatcatcgccaagatctacaacaacaccctgcacacccccatgtacgtgttcctgctgaccctggccgtggtggacatcatctgcaccaccagcatcatccccaagatgctgggcaccatgctgaccagcgagaacaccatcagctacgccggctgcatgagccagctgttcctgttcacctggagcctgggcgccgagatggtgctgttcaccaccatggcctacgacagatacgtggccatctgcttccccctgcactacagcaccatcatgaaccaccacatgtgcgtggccctgctgagcatggtgatggccatcgccgtgaccaacagctgggtgcacaccgccctgatcatgagactgaccttctgcggccccaacaccatcgaccacttcttctgcgagatcccccccctgctggccctgagctgcagccccgtgagaatcaacgaggtgatggtgtacgtggccgacatcaccctggccatcggcgacttcatcctgacctgcatcagctacggcttcatcatcgtggccatcctgagaatcagaaccgtggagggcaagagaaaggccttcagcacctgcagcagccacctgaccgtggtgaccctgtactacagccccgtgatctacacctacatcagacccgccagcagctacaccttcgagagagacaaggtggtggccgccctgtacaccctggtgacccccaccctgaaccccatggtgtacagcttccagaacagagagatgcaggccggcatcagaaaggtgttcgccttcctgaagcactag

SEQ ID NO: 91900 - DNA, 930 bp, Artificial Sequence
  Description of Artificial Sequence: Synthetic coding sequence
atggagaacagaaacaacatgaccgagttcgtgctgctgggcctgaccgagaaccccaagatgcagaagatcatcttcgtggtgttcttcgtgatctacatcatcaccgtggtgggctacgtgctgatcgtggtgaccatcaccgccagccccagcctgggcagccccatgtacctgagcctggcctacctgagcttcatcgacgcctgctacagcagcgtgaacacccccaacctgatcacccacagcctgtacggcaagaaggccatcctgttcaacggctgcatgacccaggtgttcggcgagcacttcttcggcggcgccgagggcatcctgctgaccgtgatggcctacgaccactacgtggccatctgcaagcccctgcactacatgaccatcatgaaccagtgcgtgtgcgccctgctgatgggcgtggtgtggatgggcggcttcctgcacgccaccatccagatcctgttcatcttccagctgcccttctgcggccccaacgtgatcgaccacttcatgtgcgacctgaaccccctgctgaacctggcctgcaccgacacccacatgctggagctgttcatcgccgccaacagcggcttcatctgcctgctgaacttcgccctgctgctggtgagctacgtggtgatcctgtgcagcctgagaacccacagcctggaggccagacacaaggccctgagcacctgcgtgagccacatcaccgtggtgatcctgttcttcgtgccctgcatcttcgtgtacatgagacccgccgccaccctgcccatcgacaaggccgtggccatcttctacaccatgatcacccccatgctgaaccccctgatctacaccctgaagaacgcccagatgaagaacgccatcagaaagctgtgcagcagaaaggacatcagcggcgacaagtag

SEQ ID NO: 91901 - DNA, 978 bp, Artificial Sequence
  Description of Artificial Sequence: Synthetic coding sequence
atgttcctgtacctgtgcttcatcttccagagaacctgcagcgaggagatggaggaggagaacgccaccctgctgaccgagttcgtgctgaccggcttcctgcaccagcccgactgcaagatccccctgttcctggccttcctggtgatctacctgatcaccatcatgggcaacctgggcctgatcgtgctgatctggaaggacccccacctgcacatccccatgtacctgttcctgggcagcctggccttcgtggacgccagcctgagcagcaccgtgacccccaagatgctgatcaacttcctggccaagagcaagatgatcagcctgagcgagtgcatggtgcagttcttcagcctggtgaccaccgtgaccaccgagtgcttcctgctggccaccatggcctacgacagatacgtggccatctgcaaggccctgctgtaccccgtgatcatgaccaacgagctgtgcatccagctgctggtgctgagcttcatcggcggcctgctgcacgccctgatccacgaggccttcagcttcagactgaccttctgcaacagcaacatcatccagcacttctactgcgacatcatccccctgctgaagatcagctgcaccgacagcagcatcaacttcctgatggtgttcatcttcgccggcagcgtgcaggtgttcaccatcggcaccatcctgatcagctacaccatcatcctgttcaccatcctggagaagaagagcatcaagggcatcagaaaggccgtgagcacctgcggcgcccacctgctgagcgtgagcctgtactacggccccctgaccttcaagtacctgggcagcgccagcccccaggccgacgaccaggacatgatggagagcctgttctacaccgtgatcgtgcccctgctgaaccccatgatctacagcctgagaaacaagcaggtgatcgccagcttcaccaagatgttcaagagcaacgtgtag

SEQ ID NO: 91902 - DNA, 963 bp, Artificial Sequence
  Description of Artificial Sequence: Synthetic coding sequence
atggagaccggcaaccagacccacgcccaggagttcctgctgctgggcttcagcgccaccagcgagatccagttcatcctgttcggcctgttcctgagcatgtacctggtgaccttcaccggcaacctgctgatcatcctggccatctgcagcgacagccacctgcacacccccatgtacttcttcctgagcaacctgagcttcgccgacctgtgcttcaccagcaccaccgtgcccaagatgctgctgaacatcctgacccagaacaagttcatcacctacgccggctgcctgagccagatcttcttcttcaccagcttcggctgcctggacaacctgctgctgaccgtgatggcctacgacagattcgtggccgtgtgccaccccctgcactacaccgtgatcatgaacccccagctgtgcggcctgctggtgctgggcagctggtgcatcagcgtgatgggcagcctgctggagaccctgaccgtgctgagactgagcttctgcaccgagatggagatcccccacttcttctgcgacctgctggaggtgctgaagctggcctgcagcgacaccttcatcaacaacgtggtgatctacttcgccaccggcgtgctgggcgtgatcagcttcaccggcatcttcttcagctactacaagatcgtgttcagcatcctgagaatcagcagcgccggcagaaagcacaaggccttcagcacctgcggcagccacctgagcgtggtgaccctgttctacggcaccggcttcggcgtgtacctgagcagcgccgccacccccagcagcagaaccagcctggtggccagcgtgatgtacaccatggtgacccccatgctgaaccccttcatctacagcctgagaaacaccgacatgaagagagccctgggcagactgctgagcagagccaccttcttcaacggcgacatcaccgccggcctgagctag

SEQ ID NO: 91903 - DNA, 960 bp, Artificial Sequence
  Description of Artificial Sequence: Synthetic coding sequence
atggagagaggcaaccagaccgaggtgggcaacttcctgctgctgggcttcgccgaggacagcgacatgcagctgctgctgcacggcctgttcctgagcatgtacctggtgaccatcatcggcaacctgctgatcatcctgaccatcagcagcgacagccacctgcacacccccatgtacttcttcctgagcaacctgagcttcgccgacatctgcttcaccagcaccaccgtgcccaagatgctggtgaacatccagacccagagcaagatgatcaccttcgccggctgcctgacccagatcttcttcttcatcgccttcggctgcctggacaacctgctgctgaccatgaccgcctacgacagattcgtggccatctgctaccccctgcactacaccgtgatcatgaaccccagactgtgcggcctgctggtgctgggcagctggtgcatcagcgtgatgggcagcctgctggagaccctgaccatcctgagactgagcttctgcaccaacatggagatcccccacttcttctgcgaccccagcgaggtgctgaagctggcctgcagcgacaccttcatcaacaacatcgtgatgtacttcgtgaccatcgtgctgggcgtgttccccctgtgcggcatcctgttcagctacagccagatcttcagcagcgtgctgagagtgagcgccagaggccagcacaaggccttcagcacctgcggcagccacctgagcgtggtgagcctgttctacggcaccggcctgggcgtgtacctgagcagcgccgtgaccccccccagcagaaccagcctggccgccagcgtgatgtacaccatggtgacccccatgctgaaccccttcatctacagcctgagaaacaaggacatgaagggcagcctgggcagactgctgctgagagccaccagcctgaaggagggcaccatcgccaagctgagctag

SEQ ID NO: 91904 - DNA, 939 bp, Artificial Sequence
  Description of Artificial Sequence: Synthetic coding sequence
atggaggccgagaacctgaccgagctgagcaagttcctgctgctgggcctgagcgacgaccccgagctgcagcccgtgctgttcggcctgttcctgagcatgtacctggtgaccgtgctgggcaacctgctgatcatcctggccgtgagcagcgacagccacctgcacacccccatgtacttcttcctgagcaacctgagcttcgtggacatctgcttcatcagcaccaccgtgcccaagatgctggtgagcatccaggccagaagcaaggacatcagctacatgggctgcctgacccaggtgtacttcctgatgatgttcgccggcatggacaccttcctgctggccgtgatggcctacgacagattcgtggccatctgccaccccctgcactacaccgtgatcatgaacccctgcctgtgcggcctgctggtgctggccagctggttcatcatcttctggttcagcctggtgcacatcctgctgatgaagagactgaccttcagcaccggcaccgagatcccccacttcttctgcgagcccgcccaggtgctgaaggtggcctgcagcaacaccctgctgaacaacatcgtgctgtacgtggccaccgccctgctgggcgtgttccccgtggccggcatcctgttcagctacagccagatcgtgagcagcctgatgggcatgagcagcaccaagggcaagtacaaggccttcagcacctgcggcagccacctgtgcgtggtgagcctgttctacggcaccggcctgggcgtgtacctgagcagcgccgtgacccacagcagccagagcagcagcaccgccagcgtgatgtacgccatggtgacccccatgctgaaccccttcatctacagcctgagaaacaaggacgtgaagggcgccctggagagactgctgagcagagccgacagctgcccctag

SEQ ID NO: 91905 - DNA, 972 bp, Artificial Sequence
  Description of Artificial Sequence: Synthetic coding sequence
atggacagcgacgccagcctggtgagcagcagacccagcagccccgagcccgacgacctgttcctgcccgccagaagcaagggcagcagcggcagcgccttcaccggcggcaccgtgagcagcagcacccccagcgactgcccccccgagctgagcgccgagctgagaggcgccatgggcagcgccggcgcccaccccggcgacaagctgggcggcagcggcttcaagagcagcagcagcagcaccagcagcagcaccagcagcgccgccgccagcagcaccaagaaggacaagaagcagatgaccgagcccgagctgcagcagctgagactgaagatcaacagcagagagagaaagagaatgcacgacctgaacatcgccatggacggcctgagagaggtgatgccctacgcccacggccccagcgtgagaaagctgagcaagatcgccaccctgctgctggccagaaactacatcctgatgctgaccaacagcctggaggagatgaagagactggtgagcgagatctacggcggccaccacgccggcttccaccccagcgcctgcggcggcctggcccacagcgcccccctgcccgccgccaccgcccaccccgccgccgccgcccacgccgcccaccaccccgccgtgcaccaccccatcctgccccccgccgccgccgccgccgccgccgccgccgccgccgccgccgtgagcagcgccagcctgcccggcagcggcctgcccagcgtgggcagcatcagacccccccacggcctgctgaagagccccagcgccgccgccgccgcccccctgggcggcggcggcggcggcagcggcgccagcggcggcttccagcactggggcggcatgccctgcccctgcagcatgtgccaggtgccccccccccaccaccacgtgagcgccatgggcgccggcagcctgcccagactgaccagcgacgccaagtag

SEQ ID NO: 91906 - DNA, 972 bp, Artificial Sequence; identical to SEQ ID NO: 91905
  Description of Artificial Sequence: Synthetic coding sequence

SEQ ID NO: 91907 - DNA, 189 bp, Artificial Sequence
  Description of Artificial Sequence: Synthetic coding sequence
atggacagcgacgccagcctggtgagcagcagacccagcagccccgagcccgacgacctgttcctgcccgccagaagcaagggcagcagcggcagcgccttcaccggcggcaccgtgagcagcagcacccccagcgactgcccccccgagctgagcgccgagctgagaggcgccatgggcagcgcctag

SEQ ID NO: 91908 - DNA, 1323 bp, Artificial Sequence
  Description of Artificial Sequence: Synthetic coding sequence
atggagtaccagatcctgaagatgagcctgtgcctgttcatcctgctgttcctgacccccggcatcctgtgcatctgccccctgcagtgcatctgcaccgagagacacagacacgtggactgcagcggcagaaacctgagcaccctgcccagcggcctgcaggagaacatcatccacctgaacctgagctacaaccacttcaccgacctgcacaaccagctgacccagtacaccaacctgagaaccctggacatcagcaacaacagactggagagcctgcccgcccacctgcccagaagcctgtggaacatgagcgccgccaacaacaacatcaagctgctggacaagagcgacaccgcctaccagtggaacctgaagtacctggacgtgagcaagaacatgctggagaaggtggtgctgatcaagaacaccctgagaagcctggaggtgctgaacctgagcagcaacaagctgtggaccgtgcccaccaacatgcccagcaagctgcacatcgtggacctgagcaacaacagcctgacccagatcctgcccggcaccctgatcaacctgaccaacctgacccacctgtacctgcacaacaacaagttcaccttcatccccgaccagagcttcgaccagctgttccagctgcaggagatcaccctgtacaacaacagatggagctgcgaccacaagcagaacatcacctacctgctgaagtggatgatggagaccaaggcccacgtgatcggcaccccctgcagcacccagatcagcagcctgaaggagcacaacatgtaccccacccccagcggcttcaccagcagcctgttcaccgtgagcggcatgcagaccgtggacaccatcaacagcctgagcgtggtgacccagcccaaggtgaccaagatccccaagcagtacagaaccaaggagaccaccttcggcgccaccctgagcaaggacaccaccttcaccagcaccgacaaggccttcgtgccctaccccgaggacaccagcaccgagaccatcaacagccacgaggccgccgccgccaccctgaccatccacctgcaggacggcatggtgaccaacaccagcctgaccagcagcaccaagagcagccccacccccatgaccctgagcatcaccagcggcatgcccaacaacttcagcgagatgccccagcagagcaccaccctgaacctgtggagagaggagaccaccaccaacgtgaagacccccctgcccagcgtggccaacgcctggaaggtgaacgccagcttcctgctgctgctgaacgtggtggtgatgctggccgtgtag

SEQ ID NO: 91909 - DNA, 819 bp, Artificial Sequence
  Description of Artificial Sequence: Synthetic coding sequence
atgaacagcgacagcagcagcgtgagcagcagagccagcagccccgacatggacgagatgtacctgagagaccaccaccacagacaccaccaccaccaggagagcagactgaacagcgtgagcagcacccagggcgacatgatgcagaagatgcccggcgagagcctgagcagagccggcgccaaggccgccggcgagagcagcaagtacaagatcaagaagcagctgagcgagcaggacctgcagcagctgagactgaagatcaacggcagagagagaaagagaatgcacgacctgaacctggccatggacggcctgagagaggtgatgccctacgcccacggccccagcgtgagaaagctgagcaagatcgccaccctgctgctggccagaaactacatcctgatgctgaccagcagcctggaggagatgaagagactggtgggcgagatctacggcggccaccacagcgccttccactgcggcaccgtgggccacagcgccggccaccccgcccacgccgccaacagcgtgcaccccgtgcaccccatcctgggcggcgccctgagcagcggcaacgccagcagccccctgagcgccgccagcctgcccgccatcggcaccatcagacccccccacagcctgctgaaggcccccagcaccccccccgccctgcagctgggcagcggcttccagcactgggccggcctgccctgcccctgcaccatctgccagatgcccccccccccccacctgagcgccctgagcaccgccaacatggccagactgagcgccgagagcaaggacctgctgaagtag

SEQ ID NO: 91910 - DNA, 375 bp, Artificial Sequence
  Description of Artificial Sequence: Synthetic coding sequence
atgtggaagggctgcctgaccctgtacaccggcagaggcggcgagctgcagaagatcggcgagttctgcatggtgtacagcgaggtgcccaacttcagcgagcccaaccccgactacagaggccagcagaacaagggcgcccagagcgagcagaagaacaacagcatgaacagcaacatgggcaccggcaccttcggccccgtgggcaacggcgtgcacaccggccccgagagcagagagcaccagttcagccacgccggcagaagcaacggcagaggcctgatcaacccccagctgcagggcaccgccagcaaccagaccgtgatgaccaccatcagcaacggcagagaccccagaagagccttcaagagatag

SEQ ID NO: 91911 - DNA, 375 bp, Artificial Sequence; identical to SEQ ID NO: 91910
  Description of Artificial Sequence: Synthetic coding sequence

SEQ ID NO: 91912 - DNA, 615 bp, Artificial Sequence
  Description of Artificial Sequence: Synthetic coding sequence
atgaacagagtgaacgaccccctgatcttcatcagagacatcaagcccggcctgaagaacctgaacgtggtgttcatcgtgctggagatcggcagagtgaccaagaccaaggacggccacgaggtgagaagctgcaaggtggccgacaagaccggcagcatcaccatcagcgtgtgggacgagatcggcggcctgatccagcccggcgacatcatcagactgaccagaggctacgccagcatgtggaagggctgcctgaccctgtacaccggcagaggcggcgagctgcagaagatcggcgagttctgcatggtgtacagcgaggtgcccaacttcagcgagcccaaccccgactacagaggccagcagaacaagggcgcccagagcgagcagaagaacaacagcatgaacagcaacatgggcaccggcaccttcggccccgtgggcaacggcgtgcacaccggccccgagagcagagagcaccagttcagccacgccggcagaagcaacggcagaggcctgatcaacccccagctgcagggcaccgccagcaaccagaccgtgatgaccaccatcagcaacggcagagaccccagaagagccttcaagagatag

SEQ ID NO: 91913 - DNA, 636 bp, Artificial Sequence
  Description of Artificial Sequence: Synthetic coding sequence
atgaccaccgagaccttcgtgaaggacatcaagcccggcctgaagaacctgaacctgatcttcatcgtgctggagaccggcagagtgaccaagaccaaggacggccacgaggtgagaacctgcaaggtggccgacaagaccggcagcatcaacatcagcgtgtgggacgacgtgggcaacctgatccagcccggcgacatcatcagactgaccaagggctacgccagcgtgttcaagggctgcctgaccctgtacaccggcagaggcggcgacctgcagaagatcggcgagttctgcatggtgtacagcgaggtgcccaacttcagcgagcccaaccccgagtacagcacccagcaggcccccaacaaggccgtgcagaacgacagcaaccccagcgccagccagcccaccaccggccccagcgccgccagccccgccagcgagaaccagaacggcaacggcctgagcgccccccccggccccggcggcggcccccaccccccccacacccccagccacccccccagcaccagaatcaccagaagccagcccaaccacacccccgccggcccccccggccccagcagcaaccccgtgagcaacggcaaggagaccagaagaagcagcaagagatag

SEQ ID NO: 91914 - DNA, 636 bp, Artificial Sequence; identical to SEQ ID NO: 91913
  Description of Artificial Sequence: Synthetic coding sequence

SEQ ID NO: 91915 - DNA, 636 bp, Artificial Sequence; identical to SEQ ID NO: 91913
  Description of Artificial Sequence: Synthetic coding sequence

SEQ ID NO: 91916 - DNA, 459 bp, Artificial Sequence
  Description of Artificial Sequence: Synthetic coding sequence
atgaccaccgagaccttcgtgaaggacatcaagcccggcctgaagaacctgaacctgatcttcatcgtgctggagaccggcagagtgaccaagaccaaggacggccacgaggtgagaacctgcaaggtggccgacaagaccggcagcatcaacatcagcgtgtgggacgacgtgggcaacctgatccagcccggcgacatcatcagactgaccaagggctacgccagcgtgttcaagggctgcctgaccctgtacaccggcagaggcggcgacctgcagaagatcggcgagttctgcatggtgtacagcgaggtgcccaacttcagcgagcccaaccccgagtacagcacccagcaggcccccaacaaggccgtgcagaacgacagcaaccccagcgccagccagcccaccaccggccccagcgccgccagccccgccagcgagaaccagaacggctag

SEQ ID NO: 91917 - DNA, 435 bp, Artificial Sequence
  Description of Artificial Sequence: Synthetic coding sequence
atgaccaccgagaccttcgtgaaggacatcaagcccggcctgaagaacctgaacctgatcttcatcgtgctggagaccggcagagtgaccaagaccaaggacggccacgaggtgagaacctgcaaggtggccgacaagaccggcagcatcaacatcagcgtgtgggacgacgtgggcaacctgatccagcccggcgacatcatcagactgaccaagggctacgccagcgtgttcaagggctgcctgaccctgtacaccggcagaggcggcgacctgcagaagatcggcgagttctgcatggtgtacagcgaggtgcccaacttcagcgagcccaaccccgagtacagcacccagcaggcccccaacaaggccgtgcagaacgacagcaaccccagcgccagccagcccaccaccggccccagcgccgccagctag

SEQ ID NO: 91918 - DNA, 2409 bp, Artificial Sequence
  Description of Artificial Sequence: Synthetic coding sequence
atgggccacccccccctggagttcagcgactgctacctggacagccccgacttcagagagagactgaagtgctacgagcaggagctggagagaaccaacaagttcatcaaggacgtgatcaaggacggcaacgccctgatcagcgccatgagaaactacagcagcgccgtgcagaagttcagccagaccctgcagagcttccagttcgacttcatcggcgacaccctgaccgacgacgagatcaacatcgccgagagcttcaaggagttcgccgagctgctgaacgaggtggagaacgagagaatgatgatggtgcacaacgccagcgacctgctgatcaagcccctggagaacttcagaaaggagcagatcggcttcaccaaggagagaaagaagaagttcgagaaggacggcgagagattctacagcctgctggacagacacctgcacctgagcagcaagaagaaggagagccagctgcaggaggccgacctgcaggtggacaaggagagacacaacttcttcgagagcagcctggactacgtgtaccagatccaggaggtgcaggagagcaagaagttcaacatcgtggagcccgtgctggccttcctgcacagcctgttcatcagcaacagcctgaccgtggagctgacccaggacttcctgccctacaagcagcagctgcagctgagcctgcagaacaccagaaaccacttcagcagcaccagagaggagatggaggagctgaagaagagaatgaaggaggccccccagacctgcaagctgcccggccagcccaccatcgagggctacctgtacacccaggagaagtgggccctgggcatcagctgggtgaagtactactgccagtacgagaaggagaccaagaccctgaccatgacccccatggagcagaagcccggcgccaagcagggccccctggacctgaccctgaagtactgcgtgagaagaaagaccgagagcatcgacaagagattctgcttcgacatcgagaccaacgagagacccggcaccatcaccctgcaggccctgagcgaggccaacagaagactgtggatggaggccatggacggcaaggagcccatctaccacagccccatcaccaagcagcaggagatggagctgaacgaggtgggcttcaagttcgtgagaaagtgcatcaacatcatcgagaccaagggcatcaagaccgagggcctgtacagaaccgtgggcagcaacatccaggtgcagaagctgctgaacgccttcttcgaccccaagtgccccggcgacgtggacttccacaacagcgactgggacatcaagaccatcaccagcagcctgaagttctacctgagaaacctgagcgagcccgtgatgacctacagactgcacaaggagctggtgagcgccgccaagagcgacaacctggactacagactgggcgccatccacagcctggtgtacaagctgcccgagaagaacagagagatgctggagctgctgatcagacacctggtgaacgtgtgcgagcacagcaaggagaacctgatgacccccagcaacatgggcgtgatcttcggccccaccctgatgagagcccaggaggacaccgtggccgccatgatgaacatcaagttccagaacatcgtggtggagatcctgatcgagcacttcggcaagatctacctgggcccccccgaggagagcgccgccccccccgtgcccccccccagagtgaccgccagaagacacaagcccatcaccatcagcaagagactgctgagagagagaaccgtgttctacaccagcagcctggacgagagcgaggacgagatccagcaccagacccccaacggcaccatcaccagcagcatcgagccccccaagcccccccagcaccccaagctgcccatccagagaagcggcgagaccgaccccggcagaaagagccccagcagacccatcctggacggcaagctggagccctgccccgaggtggacgtgggcaagctggtgagcagactgcaggacggcggcaccaagatcacccccaaggccaccaacggccccatgcccggcagcggccccaccaagacccccagcttccacatcaagagacccgcccccagacccctggcccaccacaaggagggcgacgccgacagcttcagcaaggtgagaccccccggcgagaagcccaccatcatcagaccccccgtgagaccccccgaccccccctgcagagccgccaccccccagaagcccgagcccaagcccgacatcgtggccggcaacgccggcgagatcaccagcagcgtggtggccagcagaaccagattcttcgagaccgccagcagaaagaccggcagcagccagggcagactgcccggcgacgagagctag

SEQ ID NO: 91919 - DNA, 2085 bp, Artificial Sequence
  Description of Artificial Sequence: Synthetic coding sequence
atgggccacccccccctggagttcagcgactgctacctggacagccccgacttcagagagagactgaagtgctacgagcaggagctggagagaaccaacaagttcatcaaggacgtgatcaaggacggcaacgccctgatcagcgccatgagaaactacagcagcgccgtgcagaagttcagccagaccctgcagagcttccagttcgacttcatcggcgacaccctgaccgacgacgagatcaacatcgccgagagcttcaaggagttcgccgagctgctgaacgaggtggagaacgagagaatgatgatggtgcacaacgccagcgacctgctgatcaagcccctggagaacttcagaaaggagcagatcggcttcaccaaggagagaaagaagaagttcgagaaggacggcgagagattctacagcctgctggacagacacctgcacctgagcagcaagaagaaggagagccagctgcaggaggccgacctgcaggtggacaaggagagacacaacttcttcgagagcagcctggactacgtgtaccagatccaggaggtgcaggagagcaagaagttcaacatcgtggagcccgtgctggccttcctgcacagcctgttcatcagcaacagcctgaccgtggagctgacccaggacttcctgccctacaagcagcagctgcagctgagcctgcagaacaccagaaaccacttcagcagcaccagagaggagatggaggagctgaagaagagaatgaaggaggccccccagacctgcaagctgcccggccagcccaccatcgagggctacctgtacacccaggagaagtgggccctgggcatcagctgggtgaagtactactgccagtacgagaaggagaccaagaccctgaccatgacccccatggagcagaagcccggcgccaagcagggccccctggacctgaccctgaagtactgcgtgagaagaaagaccgagagcatcgacaagagattctgcttcgacatcgagaccaacgagagacccggcaccatcaccctgcaggccctgagcgaggccaacagaagactgtggatggaggccatggacggcaaggagcccatctaccacagccccatcaccaagcagcaggagatggagctgaacgaggtgggcttcaagttcgtgagaaagtgcatcaacatcatcgagaccaagggcatcaagaccgagggcctgtacagaaccgtgggcagcaacatccaggtgcagaagctgctgaacgccttcttcgaccccaagtgccccggcgacgtggacttccacaacagcgactgggacatcaagaccatcaccagcagcctgaagttctacctgagaaacctgagcgagcccgtgatgacctacagactgcacaaggagctggtgagcgccgccaagagcgacaacctggactacagactgggcgccatccacagcctggtgtacaagctgcccgagaagaacagagagatgctggagctgctgatcagacacctggtgaacgtgtgcgagcacagcaaggagaacctgatgacccccagcaacatgggcgtgatcttcggccccaccctgatgagagcccaggaggacaccgtggccgccatgatgaacatcaagttccagaacatcgtggtggagatcctgatcgagcacttcggcaagatctacctgggcccccccgaggagagcgccgccccccccgtgcccccccccagagtgaccgccagaagacacaagcccatcaccatcagcaagagactgctgagagagagaaccgtgttctacaccagcagcctggacgagagcgagggcgacgccgacagcttcagcaaggtgagaccccccggcgagaagcccaccatcatcagaccccccgtgagaccccccgaccccccctgcagagccgccaccccccagaagcccgagcccaagcccgacatcgtggccggcaacgccggcgagatcaccagcagcgtggtggccagcagaaccagattcttcgagaccgccagcagaaagaccggcagcagccagggcagactgcccggcgacgagagctag

SEQ ID NO: 91920 - DNA, 225 bp, Artificial Sequence
  Description of Artificial Sequence: Synthetic coding sequence
atgctggagctgctgatcagacacctggtgaacgtgtgcgagcacagcaaggagaacctgatgacccccagcaacatgggcgtgatcttcggccccaccctgatgagagcccaggaggacaccgtggccgccatgatgaacatcaagttccagaacatcgtggtggagatcctgatcgagcacttcggcaagatcagcagcttcttcctgcacagaagcatctag

SEQ ID NO: 91921 - DNA, 3111 bp, Artificial Sequence
  Description of Artificial Sequence: Synthetic coding sequence
atggccagcagcgtgggcaacgtggccgacagcaccggcctggccgagctggcccacagagagtaccaggccggcgacttcgaggccgccgagagacactgcatgcagctgtggagacaggagcccgacaacaccggcgtgctgctgctgctgagcagcatccacttccagtgcagaagactggacagaagcgcccacttcagcaccctggccatcaagcagaaccccctgctggccgaggcctacagcaacctgggcaacgtgtacaaggagagaggccagctgcaggaggccatcgagcactacagacacgccctgagactgaagcccgacttcatcgacggctacatcaacctggccgccgccctggtggccgccggcgacatggagggcgccgtgcaggcctacgtgagcgccctgcagtacaaccccgacctgtactgcgtgagaagcgacctgggcaacctgctgaaggccctgggcagactggaggaggccaaggcctgctacctgaaggccatcgagacccagcccaacttcgccgtggcctggagcaacctgggctgcgtgttcaacgcccagggcgagatctggctggccatccaccacttcgagaaggccgtgaccctggaccccaacttcctggacgcctacatcaacctgggcaacgtgctgaaggaggccagaatcttcgacagagccgtggccgcctacctgagagccctgagcctgagccccaaccacgccgtggtgcacggcaacctggcctgcgtgtactacgagcagggcctgatcgacctggccatcgacacctacagaagagccatcgagctgcagccccacttccccgacgcctactgcaacctggccaacgccctgaaggagaagggcagcgtggccgaggccgaggactgctacaacaccgccctgagactgtgccccacccacgccgacagcctgaacaacctggccaacatcaagagagagcagggcaacatcgaggaggccgtgagactgtacagaaaggccctggaggtgttccccgagttcgccgccgcccacagcaacctggccagcgtgctgcagcagcagggcaagctgcaggaggccctgatgcactacaaggaggccatcagaatcagccccaccttcgccgacgcctacagcaacatgggcaacaccctgaaggagatgcaggacgtgcagggcgccctgcagtgctacaccagagccatccagatcaaccccgccttcgccgacgcccacagcaacctggccagcatccacaaggacagcggcaacatccccgaggccatcgccagctacagaaccgccctgaagctgaagcccgacttccccgacgcctactgcaacctggcccactgcctgcagatcgtgtgcgactggaccgactacgacgagagaatgaagaagctggtgagcatcgtggccgaccagctggagaagaacagactgcccagcgtgcacccccaccacagcatgctgtaccccctgagccacggcttcagaaaggccatcgccgagagacacggcaacctgtgcctggacaagatcaacgtgctgcacaagcccccctacgagcaccccaaggacctgaagctgagcgacggcagactgagagtgggctacgtgagcagcgacttcggcaaccaccccaccagccacctgatgcagagcatccccggcatgcacaaccccgacaagttcgaggtgttctgctacgccctgagccccgacgacggcaccaacttcagagtgaaggtgatggccgaggccaaccacttcatcgacctgagccagatcccctgcaacggcaaggccgccgacagaatccaccaggacggcatccacatcctggtgaacatgaacggctacaccaagggcgccagaaacgagctgttcgccctgagacccgcccccatccaggccatgtggctgggctaccccggcaccagcggcgccctgttcatggactacatcatcaccgaccaggagaccagccccgccgaggtggccgagcagtacagcgagaagctggcctacatgccccacaccttcttcatcggcgaccacgccaacatgttcccccacctgaagaagaaggccgtgatcgacttcaagagcaacggccacatctacgacaacagaatcgtgctgaacggcatcgacctgaaggccttcctggacagcctgcccgacgtgaagatcgtgaagatgaagtgccccgacggcggcgacaacgccgacagcagcaacaccgccctgaacatgcccgtgatccccatgaacaccatcgccgaggccgtgatcgagatgatcaacagaggccagatccagatcaccatcaacggcttcagcatcagcaacggcctggccaccacccagatcaacaacaaggccgccaccggcgaggaggtgcccagaaccatcatcgtgaccaccagaagccagtacggcctgcccgaggacgccatcgtgtactgcaacttcaaccagctgtacaagatcgaccccagcaccctgcagatgtgggccaacatcctgaagagagtgcccaacagcgtgctgtggctgctgagattccccgccgtgggcgagcccaacatccagcagtacgcccagaacatgggcctgccccagaacagaatcatcttcagccccgtggcccccaaggaggagcacgtgagaagaggccagctggccgacgtgtgcctggacacccccctgtgcaacggccacaccaccggcatggacgtgctgtgggccggcacccccatggtgaccatgcccggcgagaccctggccagcagagtggccgccagccagctgacctgcctgggctgcctggagctgatcgccaagaacagacaggagtacgaggacatcgccgtgaagctgggcaccgacctggagtacctgaagaaggtgagaggcaaggtgtggaagcagagaatcagcagccccctgttcaacaccaagcagtacaccatggagctggagagactgtacctgcagatgtgggagcactacgccgccggcaacaagcccgaccacatgatcaagcccgtggaggtgaccgagagcgcctag

SEQ ID NO: 91922 - DNA, 3141 bp, Artificial Sequence
  Description of Artificial Sequence: Synthetic coding sequence
atggccagcagcgtgggcaacgtggccgacagcaccgagcccaccaagagaatgctgagcttccagggcctggccgagctggcccacagagagtaccaggccggcgacttcgaggccgccgagagacactgcatgcagctgtggagacaggagcccgacaacaccggcgtgctgctgctgctgagcagcatccacttccagtgcagaagactggacagaagcgcccacttcagcaccctggccatcaagcagaaccccctgctggccgaggcctacagcaacctgggcaacgtgtacaaggagagaggccagctgcaggaggccatcgagcactacagacacgccctgagactgaagcccgacttcatcgacggctacatcaacctggccgccgccctggtggccgccggcgacatggagggcgccgtgcaggcctacgtgagcgccctgcagtacaaccccgacctgtactgcgtgagaagcgacctgggcaacctgctgaaggccctgggcagactggaggaggccaaggcctgctacctgaaggccatcgagacccagcccaacttcgccgtggcctggagcaacctgggctgcgtgttcaacgcccagggcgagatctggctggccatccaccacttcgagaaggccgtgaccctggaccccaacttcctggacgcctacatcaacctgggcaacgtgctgaaggaggccagaatcttcgacagagccgtggccgcctacctgagagccctgagcctgagccccaaccacgccgtggtgcacggcaacctggcctgcgtgtactacgagcagggcctgatcgacctggccatcgacacctacagaagagccatcgagctgcagccccacttccccgacgcctactgcaacctggccaacgccctgaaggagaagggcagcgtggccgaggccgaggactgctacaacaccgccctgagactgtgccccacccacgccgacagcctgaacaacctggccaacatcaagagagagcagggcaacatcgaggaggccgtgagactgtacagaaaggccctggaggtgttccccgagttcgccgccgcccacagcaacctggccagcgtgctgcagcagcagggcaagctgcaggaggccctgatgcactacaaggaggccatcagaatcagccccaccttcgccgacgcctacagcaacatgggcaacaccctgaaggagatgcaggacgtgcagggcgccctgcagtgctacaccagagccatccagatcaaccccgccttcgccgacgcccacagcaacctggccagcatccacaaggacagcggcaacatccccgaggccatcgccagctacagaaccgccctgaagctgaagcccgacttccccgacgcctactgcaacctggcccactgcctgcagatcgtgtgcgactggaccgactacgacgagagaatgaagaagctggtgagcatcgtggccgaccagctggagaagaacagactgcccagcgtgcacccccaccacagcatgctgtaccccctgagccacggcttcagaaaggccatcgccgagagacacggcaacctgtgcctggacaagatcaacgtgctgcacaagcccccctacgagcaccccaaggacctgaagctgagcgacggcagactgagagtgggctacgtgagcagcgacttcggcaaccaccccaccagccacctgatgcagagcatccccggcatgcacaaccccgacaagttcgaggtgttctgctacgccctgagccccgacgacggcaccaacttcagagtgaaggtgatggccgaggccaaccacttcatcgacctgagccagatcccctgcaacggcaaggccgccgacagaatccaccaggacggcatccacatcctggtgaacatgaacggctacaccaagggcgccagaaacgagctgttcgccctgagacccgcccccatccaggccatgtggctgggctaccccggcaccagcggcgccctgttcatggactacatcatcaccgaccaggagaccagccccgccgaggtggccgagcagtacagcgagaagctggcctacatgccccacaccttcttcatcggcgaccacgccaacatgttcccccacctgaagaagaaggccgtgatcgacttcaagagcaacggccacatctacgacaacagaatcgtgctgaacggcatcgacctgaaggccttcctggacagcctgcccgacgtgaagatcgtgaagatgaagtgccccgacggcggcgacaacgccgacagcagcaacaccgccctgaacatgcccgtgatccccatgaacaccatcgccgaggccgtgatcgagatgatcaacagaggccagatccagatcaccatcaacggcttcagcatcagcaacggcctggccaccacccagatcaacaacaaggccgccaccggcgaggaggtgcccagaaccatcatcgtgaccaccagaagccagtacggcctgcccgaggacgccatcgtgtactgcaacttcaaccagctgtacaagatcgaccccagcaccctgcagatgtgggccaacatcctgaagagagtgcccaacagcgtgctgtggctgctgagattccccgccgtgggcgagcccaacatccagcagtacgcccagaacatgggcctgccccagaacagaatcatcttcagccccgtggcccccaaggaggagcacgtgagaagaggccagctggccgacgtgtgcctggacacccccctgtgcaacggccacaccaccggcatggacgtgctgtgggccggcacccccatggtgaccatgcccggcgagaccctggccagcagagtggccgccagccagctgacctgcctgggctgcctggagctgatcgccaagaacagacaggagtacgaggacatcgccgtgaagctgggcaccgacctggagtacctgaagaaggtgagaggcaaggtgtggaagcagagaatcagcagccccctgttcaacaccaagcagtacaccatggagctggagagactgtacctgcagatgtgggagcactacgccgccggcaacaagcccgaccacatgatcaagcccgtggaggtgaccgagagcgcctag

SEQ ID NO: 91923 - DNA, 330 bp, Artificial Sequence
  Description of Artificial Sequence: Synthetic coding sequence
atgagcatcaccgacgtgctgagcgccgacgacatcgccgccgccctgcaggagtgcagagaccccgacaccttcgagccccagaagttcttccagaccagcggcctgagcaagatgagcgccaaccaggtgaaggacgtgttcagattcatcgacaacgaccagagcggctacctggacgaggaggagctgaagttcttcctgcagaagttcgagagcggcgccagagagctgaccgagagcgagaccaagagcctgatggccgccgccgacaacgacggcgacggcaagatcggcgccgaggagttccaggagatggtgcacagctag

SEQ ID NO: 91924 - DNA, 330 bp, Artificial Sequence; identical to SEQ ID NO: 91923
  Description of Artificial Sequence: Synthetic coding sequence

SEQ ID NO: 91925 - DNA, 1638 bp, Artificial Sequence
  Description of Artificial Sequence: Synthetic coding sequence
atgccccccttcctgctgctgacctgcctgttcatcaccggcaccagcgtgagccccgtggccctggacccctgcagcgcctacatcagcctgaacgagccctggagaaacaccgaccaccagctggacgagagccagggcccccccctgtgcgacaaccacgtgaacggcgagtggtaccacttcaccggcatggccggcgacgccatgcccaccttctgcatccccgagaaccactgcggcacccacgcccccgtgtggctgaacggcagccaccccctggagggcgacggcatcgtgcagagacaggcctgcgccagcttcaacggcaactgctgcctgtggaacaccaccgtggaggtgaaggcctgccccggcggctactacgtgtacagactgaccaagcccagcgtgtgcttccacgtgtactgcggccacttctacgacatctgcgacgaggactgccacggcagctgcagcgacaccagcgagtgcacctgcgcccccggcaccgtgctgggccccgacagacagacctgcttcgacgagaacgagtgcgagcagaacaacggcggctgcagcgagatctgcgtgaacctgaagaacagctacagatgcgagtgcggcgtgggcagagtgctgagaagcgacggcaagacctgcgaggacgtggagggctgccacaacaacaacggcggctgcagccacagctgcctgggcagcgagaagggctaccagtgcgagtgccccagaggcctggtgctgagcgaggacaaccacacctgccaggtgcccgtgctgtgcaagagcaacgccatcgaggtgaacatccccagagagctggtgggcggcctggagctgttcctgaccaacaccagctgcagaggcgtgagcaacggcacccacgtgaacatcctgttcagcctgaagacctgcggcaccgtggtggacgtggtgaacgacaagatcgtggccagcaacctggtgaccggcctgcccaagcagacccccggcagcagcggcgacttcatcatcagaaccagcaagctgctgatccccgtgacctgcgagttccccagactgtacaccatcagcgagggctacgtgcccaacctgagaaacagccccctggagatcatgagcagaaaccacggcatcttccccttcaccctggagatcttcaaggacaacgagttcgaggagccctacagagaggccctgcccaccctgaagctgagagacagcctgtacttcggcatcgagcccgtggtgcacgtgagcggcctggagagcctggtggagagctgcttcgccacccccaccagcaagatcgacgaggtgctgaagtactacctgatcagagacggctgcgtgagcgacgacagcgtgaagcagtacaccagcagagaccacctggccaagcacttccaggtgcccgtgttcaagttcgtgggcaaggaccacaaggaggtgttcctgcactgcagagtgctggtgtgcggcgtgctggacgagagaagcagatgcgcccagggctgccacagaagaatgagaagaggcgccggcggcgaggacagcgccggcctgcagggccagaccctgaccggcggccccatcagaatcgactgggaggactag

SEQ ID NO: 91926 - DNA, 966 bp, Artificial Sequence
  Description of Artificial Sequence: Synthetic coding sequence
atgccccccttcctgctgctgacctgcctgttcatcaccggcaccagcgtgagccccgtggccctggacccctgcagcgcctacatcagcctgaacgagccctggagaaacaccgaccaccagctggacgagagccagggcccccccctgtgcgacaaccacgtgaacggcgagtggtaccacttcaccggcatggccggcgacgccatgcccaccttctgcatccccgagaaccactgcggcacccacgcccccgtgtggctgaacggcagccaccccctggagggcgacggcatcgtgcagagacaggcctgcgccagcttcaacggcaactgctgcctgtggaacaccaccgtggaggtgaaggcctgccccggcggctactacgtgtacagactgaccaagcccagcgtgtgcttccacgtgtactgcggccacttctacgacatctgcgacgaggactgccacggcagctgcagcgacaccagcgagtgcacctgcgcccccggcaccgtgctgggccccgacagacagacctgcttcgacgagaacgagtgcgagcagaacaacggcggctgcagcgagatctgcgtgaacctgaagaacagctacagatgcgagtgcggcgtgggcagagtgctgagaagcgacggcaagacctgcgaggacgtggagggctgccacaacaacaacggcggctgcagccacagctgcctgggcagcgagaagggctaccagtgcgagtgccccagaggcctggtgctgagcgaggacaaccacacctgccaggtgcccgtgctgtgcaagagcaacgccatcgaggtgaacatccccagagagctggtgggcggcctggagctgttcctgaccaacaccagctgcagaggcgtgagcaacggcacccacgtgaacatcctgttcagcctgaagacctgcggcaccgtggtggacagctgcttccagtag

SEQ ID NO: 91927 - DNA, 735 bp, Artificial Sequence
  Description of Artificial Sequence: Synthetic coding sequence
atgggcctggagctgttcctggacctggtgagccagcccagcagagccgtgtacatcttcgccaagaagaacggcatccccctggagctgagaaccgtggacctggtgaagggccagcacaagagcaaggagttcctgcagatcaacagcctgggcaagctgcccaccctgaaggacggcgacttcatcctgaccgagagcagcgccatcctgatctacctgagctgcaagtaccagacccccgaccactggtaccccagcgacctgcaggccagagccagagtgcacgagtacctgggctggcacgccgactgcatcagaggcaccttcggcatccccctgtgggtgcaggtgctgggccccctgatcggcgtgcaggtgcccaaggagaaggtggagagaaacagaaccgccatggaccaggccctgcagtggctggaggacaagttcctgggcgacagacccttcctggccggccagcaggtgaccctggccgacctgatggccctggaggagctgatgcagcccgtggccctgggctacgagctgttcgagggcagacccagactggccgcctggagaggcagagtggaggccttcctgggcgccgagctgtgccaggaggcccacagcatcatcctgagcatcctggagcaggccgccaagaagaccctgcccacccccagccccgaggcctaccaggccatgctgctgagaatcgccagaatcccctag

SEQ ID NO: 91928 - DNA, 696 bp, Artificial Sequence
  Description of Artificial Sequence: Synthetic coding sequence
atggccagcatggccgccatcggcagctgcagcaaggagtacagagtgctgctgggccagctgcagaagcagaccgacctgatgcaggacaccagcagactgctggacccctacatcagaatccagggcctggacgtgcccaagctgagagagcactgcagagagagacccggcgccttccccagcgaggagaccctgagaggcctgggcagaagaggcttcctgcagaccctgaacgccaccctgggctgcgtgctgcacagactggccgacctggagcagagactgcccaaggcccaggacctggagagaagcggcctgaacatcgaggacctggagaagctgcagatggccagacccaacatcctgggcctgagaaacaacatctactgcatggcccagctgctggacaacagcgacaccgccgagcccaccaaggccggcagaggcgccagccagccccccacccccacccccgccagcgacgccttccagagaaagctggagggctgcagattcctgcacggctaccacagattcatgcacagcgtgggcagagtgttcagcaagtggggcgagagccccaacagaagcagaagacacagcccccaccaggccctgagaaagggcgtgagaagaaccagacccagcagaaagggcaagagactgatgaccagaggccagctgcccagatag

SEQ ID NO: 91929 - DNA, 2940 bp, Artificial Sequence
  Description of Artificial Sequence: Synthetic coding sequence
atggccctgttcgccgtgttccagaccaccttcttcctgaccctgctgagcctgagaacctaccagagcgaggtgctggccgagagactgcccctgacccccgtgagcctgaaggtgagcaccaacagcaccagacagagcctgcacctgcagtggaccgtgcacaacctgccctaccaccaggagctgaagatggtgttccagatccagatcagcagaatcgagaccagcaacgtgatctgggtgggcaactacagcaccaccgtgaagtggaaccaggtgctgcactggagctgggagagcgagctgcccctggagtgcgccacccacttcgtgagaatcaagagcctggtggacgacgccaagttccccgagcccaacttctggagcaactggagcagctgggaggaggtgagcgtgcaggacagcaccggccaggacatcctgttcgtgttccccaaggacaagctggtggaggagggcaccaacgtgaccatctgctacgtgagcagaaacatccagaacaacgtgagctgctacctggagggcaagcagatccacggcgagcagctggacccccacgtgaccgccttcaacctgaacagcgtgcccttcatcagaaacaagggcaccaacatctactgcgaggccagccagggcaacgtgagcgagggcatgaagggcatcgtgctgttcgtgagcaaggtgctggaggagcccaaggacttcagctgcgagaccgaggacttcaagaccctgcactgcacctgggaccccggcaccgacaccgccctgggctggagcaagcagcccagccagagctacaccctgttcgagagcttcagcggcgagaagaagctgtgcacccacaagaactggtgcaactggcagatcacccaggacagccaggagacctacaacttcaccctgatcgccgagaactacctgagaaagagaagcgtgaacatcctgttcaacctgacccacagagtgtacctgatgaaccccttcagcgtgaacttcgagaacgtgaacgccaccaacgccatcatgacctggaaggtgcacagcatcagaaacaacttcacctacctgtgccagatcgagctgcacggcgagggcaagatgatgcagtacaacgtgagcatcaaggtgaacggcgagtacttcctgagcgagctggagcccgccaccgagtacatggccagagtgagatgcgccgacgccagccacttctggaagtggagcgagtggagcggccagaacttcaccaccctggaggccgcccccagcgaggcccccgacgtgtggagaatcgtgagcctggagcccggcaaccacaccgtgaccctgttctggaagcccctgagcaagctgcacgccaacggcaagatcctgttctacaacgtggtggtggagaacctggacaagcccagcagcagcgagctgcacagcatccccgcccccgccaacagcaccaagctgatcctggacagatgcagctaccagatctgcgtgatcgccaacaacagcgtgggcgccagccccgccagcgtgatcgtgatcagcgccgaccccgagaacaaggaggtggaggaggagagaatcgccggcaccgagggcggcttcagcctgagctggaagccccagcccggcgacgtgatcggctacgtggtggactggtgcgaccacacccaggacgtgctgggcgacttccagtggaagaacgtgggccccaacaccaccagcaccgtgatcagcaccgacgccttcagacccggcgtgagatacgacttcagaatctacggcctgagcaccaagagaatcgcctgcctgctggagaagaagaccggctacagccaggagctggcccccagcgacaacccccacgtgctggtggacaccctgaccagccacagcttcaccctgagctggaaggactacagcaccgagagccagcccggcttcatccagggctaccacgtgtacctgaagagcaaggccagacagtgccaccccagattcgagaaggccgtgctgagcgacggcagcgagtgctgcaagtacaagatcgacaaccccgaggagaaggccctgatcgtggacaacctgaagcccgagagcttctacgagttcttcatcacccccttcaccagcgccggcgagggccccagcgccaccttcaccaaggtgaccacccccgacgagcacagcagcatgctgatccacatcctgctgcccatggtgttctgcgtgctgctgatcatggtgatgtgctacctgaagagccagtggatcaaggagacctgctaccccgacatccccgacccctacaagagcagcatcctgagcctgatcaagttcaaggagaacccccacctgatcatcatgaacgtgagcgactgcatccccgacgccatcgaggtggtgagcaagcccgagggcaccaagatccagttcctgggcaccagaaagagcctgaccgagaccgagctgaccaagcccaactacctgtacctgctgcccaccgagaagaaccacagcggccccggcccctgcatctgcttcgagaacctgacctacaaccaggccgccagcgacagcggcagctgcggccacgtgcccgtgagccccaaggcccccagcatgctgggcctgatgaccagccccgagaacgtgctgaaggccctggagaagaactacatgaacagcctgggcgagatccccgccggcgagaccagcctgaactacgtgagccagctggccagccccatgttcggcgacaaggacagcctgcccaccaaccccgtggaggccccccactgcagcgagtacaagatgcagatggccgtgagcctgagactggccctgcccccccccaccgagaacagcagcctgagcagcatcaccctgctggaccccggcgagcactactgctag

SEQ ID NO: 91930 - DNA, 1029 bp, Artificial Sequence
  Description of Artificial Sequence: Synthetic coding sequence
atggccctgttcgccgtgttccagaccaccttcttcctgaccctgctgagcctgagaacctaccagagcgaggtgctggccgagagactgcccctgacccccgtgagcctgaaggtgagcaccaacagcaccagacagagcctgcacctgcagtggaccgtgcacaacctgccctaccaccaggagctgaagatggtgttccagatccagatcagcagaatcgagaccagcaacgtgatctgggtgggcaactacagcaccaccgtgaagtggaaccaggtgctgcactggagctgggagagcgagctgcccctggagtgcgccacccacttcgtgagaatcaagagcctggtggacgacgccaagttccccgagcccaacttctggagcaactggagcagctgggaggaggtgagcgtgcaggacagcaccggccaggacatcctgttcgtgttccccaaggacaagctggtggaggagggcaccaacgtgaccatctgctacgtgagcagaaacatccagaacaacgtgagctgctacctggagggcaagcagatccacggcgagcagctggacccccacgtgaccgccttcaacctgaacagcgtgcccttcatcagaaacaagggcaccaacatctactgcgaggccagccagggcaacgtgagcgagggcatgaagggcatcgtgctgttcgtgagcaaggtgctggaggagcccaaggacttcagctgcgagaccgaggacttcaagaccctgcactgcacctgggaccccggcaccgacaccgccctgggctggagcaagcagcccagccagagctacaccctgttcgagagcttcagcggcgagaagaagctgtgcacccacaagaactggtgcaactggcagatcacccaggacagccaggagacctacaacttcaccctgatcgccgagaactacctgagaaagagaagcgtgaacatcctgttcaacctgacccacagaggcgagaccagagtggtgaccgcccacagaggccactag

SEQ ID NO: 91931 - DNA, 1398 bp, Artificial Sequence
  Description of Artificial Sequence: Synthetic coding sequence
atgaacgcccagctgaccatggaggccatcggcgagctgcacggcgtgagccacgagcccgtgcccgcccccgccgacctgctgggcggcagcccccacgccagaagcagcgtggcccacagaggcagccacctgccccccgcccaccccagaagcatgggcatggccagcctgctggacggcggcagcggcggcggcgactaccaccaccaccacagagcccccgagcacagcctggccggccccctgcaccccaccatgaccatggcctgcgagaccccccccggcatgagcatgcccaccacctacaccaccctgacccccctgcagcccctgccccccatcagcaccgtgagcgacaagttcccccaccaccaccaccaccaccaccaccaccaccacccccaccaccaccagagactggccggcaacgtgagcggcagcttcaccctgatgagagacgagagaggcctggccagcatgaacaacctgtacaccccctaccacaaggacgtggccggcatgggccagagcctgagccccctgagcagcagcggcctgggcagcatccacaacagccagcagggcctgccccactacgcccaccccggcgccgccatgcccaccgacaagatgctgacccccaacggcttcgaggcccaccaccccgccatgctgggcagacacggcgagcagcacctgacccccaccagcgccggcatggtgcccatcaacggcctgcccccccaccacccccacgcccacctgaacgcccagggccacggccagctgctgggcaccgccagagagcccaaccccagcgtgaccggcgcccaggtgagcaacggcagcaacagcggccagatggaggagatcaacaccaaggaggtggcccagagaatcaccaccgagctgaagagatacagcatcccccaggccatcttcgcccagagagtgctgtgcagaagccagggcaccctgagcgacctgctgagaaaccccaagccctggagcaagctgaagagcggcagagagaccttcagaagaatgtggaagtggctgcaggagcccgagttccagagaatgagcgccctgagactggccgcctgcaagagaaaggagcaggagcacggcaaggacagaggcaacacccccaagaagcccagactggtgttcaccgacgtgcagagaagaaccctgcacgccatcttcaaggagaacaagagacccagcaaggagctgcagatcaccatcagccagcagctgggcctggagctgagcaccgtgagcaacttcttcatgaacgccagaagaagaagcctggacaagtggcaggacgagggcagcagcaacagcggcaacagcagcagcagcagcagcacctgcaccaaggcctag

SEQ ID NO: 91932 - DNA, 1515 bp, Artificial Sequence
  Description of Artificial Sequence: Synthetic coding sequence
atgaaggccgcctacaccgcctacagatgcctgaccaaggacctggagggctgcgccatgaaccccgagctgaccatggagagcctgggcaccctgcacggccccgccggcggcggcagcggcggcggcggcggcggcggcggcggcggcggcggcggcggccccggccacgagcaggagctgctggccagccccagcccccaccacgccggcagaggcgccgccggcagcctgagaggccccccccccccccccaccgcccaccaggagctgggcaccgccgccgccgccgccgccgccgccagcagaagcgccatggtgaccagcatggccagcatcctggacggcggcgactacagacccgagctgagcatccccctgcaccacgccatgagcatgagctgcgacagcagcccccccggcatgggcatgagcaacacctacaccaccctgacccccctgcagcccctgccccccatcagcaccgtgagcgacaagttccaccacccccacccccaccaccacccccaccaccaccaccaccaccaccaccagagactgagcggcaacgtgagcggcagcttcaccctgatgagagacgagagaggcctgcccgccatgaacaacctgtacagcccctacaaggagatgcccggcatgagccagagcctgagccccctggccgccacccccctgggcaacggcctgggcggcctgcacaacgcccagcagagcctgcccaactacggcccccccggccacgacaagatgctgagccccaacttcgacgcccaccacaccgccatgctgaccagaggcgagcagcacctgagcagaggcctgggcaccccccccgccgccatgatgagccacctgaacggcctgcaccaccccggccacacccagagccacggccccgtgctggcccccagcagagagagaccccccagcagcagcagcggcagccaggtggccaccagcggccagctggaggagatcaacaccaaggaggtggcccagagaatcaccgccgagctgaagagatacagcatcccccaggccatcttcgcccagagagtgctgtgcagaagccagggcaccctgagcgacctgctgagaaaccccaagccctggagcaagctgaagagcggcagagagaccttcagaagaatgtggaagtggctgcaggagcccgagttccagagaatgagcgccctgagactggccgcctgcaagagaaaggagcaggagcccaacaaggacagaaacaacagccagaagaagagcagactggtgttcaccgacctgcagagaagaaccctgttcgccatcttcaaggagaacaagagacccagcaaggagatgcagatcaccatcagccagcagctgggcctggagctgaccaccgtgagcaacttcttcatgaacgccagaagaagaagcctggagaagtggcaggacgacctgagcaccggcggcagcagcagcaccagcagcacctgcaccaaggcctag

SEQ ID NO: 91933 - DNA, 1458 bp, Artificial Sequence
  Description of Artificial Sequence: Synthetic coding sequence
atgaaccccgagctgaccatggagagcctgggcaccctgcacggccccgccggcggcggcagcggcggcggcggcggcggcggcggcggcggcggcggcggcggccccggccacgagcaggagctgctggccagccccagcccccaccacgccggcagaggcgccgccggcagcctgagaggccccccccccccccccaccgcccaccaggagctgggcaccgccgccgccgccgccgccgccgccagcagaagcgccatggtgaccagcatggccagcatcctggacggcggcgactacagacccgagctgagcatccccctgcaccacgccatgagcatgagctgcgacagcagcccccccggcatgggcatgagcaacacctacaccaccctgacccccctgcagcccctgccccccatcagcaccgtgagcgacaagttccaccacccccacccccaccaccacccccaccaccaccaccaccaccaccaccagagactgagcggcaacgtgagcggcagcttcaccctgatgagagacgagagaggcctgcccgccatgaacaacctgtacagcccctacaaggagatgcccggcatgagccagagcctgagccccctggccgccacccccctgggcaacggcctgggcggcctgcacaacgcccagcagagcctgcccaactacggcccccccggccacgacaagatgctgagccccaacttcgacgcccaccacaccgccatgctgaccagaggcgagcagcacctgagcagaggcctgggcaccccccccgccgccatgatgagccacctgaacggcctgcaccaccccggccacacccagagccacggccccgtgctggcccccagcagagagagaccccccagcagcagcagcggcagccaggtggccaccagcggccagctggaggagatcaacaccaaggaggtggcccagagaatcaccgccgagctgaagagatacagcatcccccaggccatcttcgcccagagagtgctgtgcagaagccagggcaccctgagcgacctgctgagaaaccccaagccctggagcaagctgaagagcggcagagagaccttcagaagaatgtggaagtggctgcaggagcccgagttccagagaatgagcgccctgagactggccgcctgcaagagaaaggagcaggagcccaacaaggacagaaacaacagccagaagaagagcagactggtgttcaccgacctgcagagaagaaccctgttcgccatcttcaaggagaacaagagacccagcaaggagatgcagatcaccatcagccagcagctgggcctggagctgaccaccgtgagcaacttcttcatgaacgccagaagaagaagcctggagaagtggcaggacgacctgagcaccggcggcagcagcagcaccagcagcacctgcaccaaggcctag

SEQ ID NO: 91934 - DNA, 450 bp, Artificial Sequence
  Description of Artificial Sequence: Synthetic coding sequence
atggtggacgacgccggcgccgccgagagccagagaggcaagcagacccccgcccacagcctggagcagctgagaagactgcccctgccccccccccagatcagaatcagaccctggtggttccccgtgcaggagctgagagaccccctggtgttctacctggaggcctggctggccgacgagctgttcggccccgacagagccatcatccccgagatggagtggaccagccaggccctgctgaccgtggacatcgtggacagcggcaacctggtggagatcaccgtgttcggcagacccagagtgcagaacagagtgaagagcatgctgctgtgcctggcctggttccacagagagcacagagccagagccgagaagatgaagcacctggagaagaacctgaaggcccacgccagcgacccccacagcccccaggaccccgtggcctag

SEQ ID NO: 91935 - DNA, 387 bp, Artificial Sequence
  Description of Artificial Sequence: Synthetic coding sequence
atggcccccgtgaagaagctggtggtgaagggcggcaagaagaagaagcaggtgctgaagttcaccctggactgcacccaccccgtggaggacggcatcatggacgccgccaacttcgagcagttcctgcaggagagaatcaaggtgaacggcaaggccggcaacctgggcggcggcgtggtgaccatcgagagaagcaagagcaagatcaccgtgaccagcgaggtgcccttcagcaagagatacctgaagtacctgaccaagaagtacctgaagaagaacaacctgagagactggctgagagtggtggccaacagcaaggagagctacgagctgagatacttccagatcaaccaggacgaggaggaggaggaggacgaggactag

SEQ ID NO: 91936 - DNA, 975 bp, Artificial Sequence
  Description of Artificial Sequence: Synthetic coding sequence
atggagcccgcccccagcgccggcgccgagctgcagccccccctgttcgccaacgccagcgacgcctaccccagcgcctgccccagcgccggcgccaacgccagcggcccccccggcgccagaagcgccagcagcctggccctggccatcgccatcaccgccctgtacagcgccgtgtgcgccgtgggcctgctgggcaacgtgctggtgatgttcggcatcgtgagatacaccaagatgaagaccgccaccaacatctacatcttcaacctggccctggccgacgccctggccaccagcaccctgcccttccagagcgccaagtacctgatggagacctggcccttcggcgagctgctgtgcaaggccgtgctgagcatcgactactacaacatgttcaccagcatcttcaccctgaccatgatgagcgtggacagatacatcgccgtgtgccaccccgtgaaggccctggacttcagaacccccgccaaggccaagctgatcaacatctgcatctgggtgctggccagcggcgtgggcgtgcccatcatggtgatggccgtgaccagacccagagacggcgccgtggtgtgcatgctgcagttccccagccccagctggtactgggacaccgtgaccaagatctgcgtgttcctgttcgccttcgtggtgtgctgggcccccatccacatcttcgtgatcgtgtggaccctggtggacatcgacagaagagaccccctggtggtggccgccctgcacctgtgcatcgccctgggctacgccaacagcagcctgaaccccgtgctgtacgccttcctggacgagaacttcaagagatgcttcagacagctgtgcagaaagccctgcggcagacccgaccccagcagcttcagcagagccagagaggccaccgccagagagagagtgaccgcctgcacccccagcgacggccccggcggcggcgccgccgcctag

SEQ ID NO: 91937 - DNA, 1143 bp, Artificial Sequence
  Description of Artificial Sequence: Synthetic coding sequence
atggacagccccatccagatcttcagaggcgagcccggccccacctgcgcccccagcgcctgcctgccccccaacagcagcgcctggttccccggctgggccgagcccgacagcaacggcagcgccggcagcgaggacgcccagctggagcccgcccacatcagccccgccatccccgtgatcatcaccgccgtgtacagcgtggtgttcgtggtgggcctggtgggcaacagcctggtgatgttcgtgatcatcagatacaccaagatgaagaccgccaccaacatctacatcttcaacctggccctggccgacgccctggtgaccaccaccatgcccttccagagcaccgtgtacctgatgaacagctggcccttcggcgacgtgctgtgcaagatcgtgatcagcatcgactactacaacatgttcaccagcatcttcaccctgaccatgatgagcgtggacagatacatcgccgtgtgccaccccgtgaaggccctggacttcagaacccccctgaaggccaagatcatcaacatctgcatctggctgctgagcagcagcgtgggcatcagcgccatcgtgctgggcggcaccaaggtgagagaggacgtggacgtgatcgagtgcagcctgcagttccccgacgacgactacagctggtgggacctgttcatgaagatctgcgtgttcatcttcgccttcgtgatccccgtgctgatcatcatcgtgtgctacaccctgatgatcctgagactgaagagcgtgagactgctgagcggcagcagagagaaggacagaaacctgagaagaatcaccagactggtgctggtggtggtggccgtgttcgtggtgtgctggacccccatccacatcttcatcctggtggaggccctgggcagcaccagccacagcaccgccgccctgagcagctactacttctgcatcgccctgggctacaccaacagcagcctgaaccccatcctgtacgccttcctggacgagaacttcaagagatgcttcagagacttctgcttccccctgaagatgagaatggagagacagagcaccagcagagtgagaaacaccgtgcaggaccccgcctacctgagagacatcgacggcatgaacaagcccgtgtag

SEQ ID NO: 91938 - DNA, 1101 bp, Artificial Sequence
  Description of Artificial Sequence: Synthetic coding sequence
atggacagccccatccagatcttcagaggcgagcccggccccacctgcgcccccagcgcctgcctgccccccaacagcagcgccggcagcgaggacgcccagctggagcccgcccacatcagccccgccatccccgtgatcatcaccgccgtgtacagcgtggtgttcgtggtgggcctggtgggcaacagcctggtgatgttcgtgatcatcagatacaccaagatgaagaccgccaccaacatctacatcttcaacctggccctggccgacgccctggtgaccaccaccatgcccttccagagcaccgtgtacctgatgaacagctggcccttcggcgacgtgctgtgcaagatcgtgatcagcatcgactactacaacatgttcaccagcatcttcaccctgaccatgatgagcgtggacagatacatcgccgtgtgccaccccgtgaaggccctggacttcagaacccccctgaaggccaagatcatcaacatctgcatctggctgctgagcagcagcgtgggcatcagcgccatcgtgctgggcggcaccaaggtgagagaggacgtggacgtgatcgagtgcagcctgcagttccccgacgacgactacagctggtgggacctgttcatgaagatctgcgtgttcatcttcgccttcgtgatccccgtgctgatcatcatcgtgtgctacaccctgatgatcctgagactgaagagcgtgagactgctgagcggcagcagagagaaggacagaaacctgagaagaatcaccagactggtgctggtggtggtggccgtgttcgtggtgtgctggacccccatccacatcttcatcctggtggaggccctgggcagcaccagccacagcaccgccgccctgagcagctactacttctgcatcgccctgggctacaccaacagcagcctgaaccccatcctgtacgccttcctggacgagaacttcaagagatgcttcagagacttctgcttccccctgaagatgagaatggagagacagagcaccagcagagtgagaaacaccgtgcaggaccccgcctacctgagagacatcgacggcatgaacaagcccgtgtag

SEQ ID NO: 91939 - DNA, 1143 bp, Artificial Sequence; identical to SEQ ID NO: 91937
  Description of Artificial Sequence: Synthetic coding sequence

SEQ ID NO: 91940 - DNA, 1344 bp, Artificial Sequence
  Description of Artificial Sequence: Synthetic coding sequence
atgagcagaagaccctgcagctgcgccctgagaccccccagatgcagctgcagcgccagccccagcgccgtgaccgccgccggcagacccagacccagcgacagctgcaaggaggagagcagcaccctgagcgtgaagatgaagtgcgacttcaactgcaaccacgtgcacagcggcctgaagctggtgaagcccgacgacatcggcagactggtgagctacacccccgcctacctggagggcagctgcaaggactgcatcaaggactacgagagactgagctgcatcggcagccccatcgtgagccccagaatcgtgcagctggagaccgagagcaagagactgcacaacaaggagaaccagcacgtgcagcagaccctgaacagcaccaacgagatcgaggccctggagaccagcagactgtacgaggacagcggctacagcagcttcagcctgcagagcggcctgagcgagcacgaggagggcagcctgctggaggagaacttcggcgacagcctgcagagctgcctgctgcagatccagagccccgaccagtaccccaacaagaacctgctgcccgtgctgcacttcgagaaggtggtgtgcagcaccctgaagaagaacgccaagagaaaccccaaggtggacagagagatgctgaaggagatcatcgccagaggcaacttcagactgcagaacatcatcggcagaaagatgggcctggagtgcgtggacatcctgagcgagctgttcagaagaggcctgagacacgtgctggccaccatcctggcccagctgagcgacatggacctgatcaacgtgagcaaggtgagcaccacctggaagaagatcctggaggacgacaagggcgccttccagctgtacagcaaggccatccagagagtgaccgagaacaacaacaagttcagcccccacgccagcaccagagagtacgtgatgttcagaacccccctggccagcgtgcagaagagcgccgcccagaccagcctgaagaaggacgcccagaccaagctgagcaaccagggcgaccagaagggcagcacctacagcagacacaacgagttcagcgaggtggccaagaccctgaagaagaacgagagcctgaaggcctgcatcagatgcaacagccccgccaagtacgactgctacctgcagagagccacctgcaagagagagggctgcggcttcgactactgcaccaagtgcctgtgcaactaccacaccaccaaggactgcagcgacggcaagctgctgaaggccagctgcaagatcggccccctgcccggcaccaagaagagcaagaagaacctgagaagactgtag

SEQ ID NO: 91941 - DNA, 1203 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagctggagaacctggaggccgagaccgcccccctgccctag

SEQ ID NO: 91942 - DNA, 1257 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagccccccctggccgtgagcatggcccagatcttcaccagataccccccccccacccacagagagaagacctgcaacgactacatgaagagatag

SEQ ID NO: 91943 - DNA, 1209 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagatcagagaccccatcagcaacctgcccagagtgagcgtgttctag

SEQ ID NO: 91944 - DNA, 1212 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagggcccccccgccaagttcgtggccgaccagctggccggcagcagctag

SEQ ID NO: 91945 - DNA, 1263 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccaggtggagctgaacctggactgccactgcgagaacgccaagccctggcccctgagctacaacgccggccagagccccttccccttccccggcagagtgtag

SEQ ID NO: 91946 - DNA, 1179 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccaggtgagaagcctgtag

SEQ ID NO: 91947 - DNA, 1482 bp, Artificial Sequence
  Description of Artificial Sequence: Synthetic coding sequence
atgtgcctgcacagaagagtgcccagcgaggagacctacagcctggacagattcgcccagaacccccccctgttccccccccccagcctgcccgccagcgagagcagaatggcccacgcccccctgctgcagagatgcggcgccgccagaaccggcttctgcaagaagcagcaggagctgtggcagagaagaaaggaggccgccgaggccctgggcaccagaaaggtgagcgtgctgctggccaccagccacagcggcgccagacccgccgtgagcaccatggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagctggagaacctggaggccgagaccgcccccctgccctag

SEQ ID NO: 91948 - DNA, 1194 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagagagagagaagacagaagagcgactggtag

SEQ ID NO: 91949 - DNA, 1221 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagaagatcgacctgttccagaagagcagcctgctgaactgcgagcacaccaagggctag

SEQ ID NO: 91950 - DNA, 960 bp, Artificial Sequence
  Description of Artificial Sequence: Synthetic coding sequence
atgatgagagccaagagcatcagcaccaaggccggcaagcccagcagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagctggagaacctggaggccgagaccgcccccctgccctag

SEQ ID NO: 91951 - DNA, 1209 bp, Artificial Sequence; identical to SEQ ID NO: 91943
  Description of Artificial Sequence: Synthetic coding sequence

SEQ ID NO: 91952 - DNA, 492 bp, Artificial Sequence
  Description of Artificial Sequence: Synthetic coding sequence
atggtgcaggccagaaccggcttctgcaagaagcagcaggagctgtggcagagaagaaaggaggccgccgaggccctgggcaccagaaaggtgagcgtgctgctggccaccagccacagcggcgccagacccgccgtgagcaccatggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggcctag

SEQ ID NO: 91953 - DNA, 903 bp, Artificial Sequence
  Description of Artificial Sequence: Synthetic coding sequence
atgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagctggagaacctggaggccgagaccgcccccctgccctag

SEQ ID NO: 91954 - DNA, 903 bp, Artificial Sequence; identical to SEQ ID NO: 91953
  Description of Artificial Sequence: Synthetic coding sequence

SEQ ID NO: 91955 - DNA, 903 bp, Artificial Sequence; identical to SEQ ID NO: 91953
  Description of Artificial Sequence: Synthetic coding sequence

SEQ ID NO: 91956 - DNA, 1209 bp, Artificial Sequence; identical to SEQ ID NO: 91943
  Description of Artificial Sequence: Synthetic coding sequence

SEQ ID NO: 91957 - DNA, 561 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagattccacagactgtacaccaacatcctgagcagcaacctggtgctgggcaagcccgccgaggacctgtgcttccacctgagactgcactacgccagcgcccaccactacagagtgctgtggaccgacgacctggccccccaggagtgcccccacgccctgtggctgcagagaaagggccaggagagcagcaaggaccaccaggacggcgccggcggcggcggctgcgtgcacagactgctggacagccacagccacctgagacaccactag

SEQ ID NO: 91958 - DNA, 1170 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagagctag

SEQ ID NO: 91959 - DNA, 1095 bp, Artificial Sequence
  Description of Artificial Sequence: Synthetic coding sequence
atggcccagcagtggagcctgcagagactggccggcagacacccccaggacagctacgaggacagcacccagagcagcatcttcacctacaccaacagcaacagcaccagaggccccttcgagggccccaactaccacatcgcccccagatgggtgtaccacctgaccagcgtgtggatgatcttcgtggtgaccgccagcgtgttcaccaacggcctggtgctggccgccaccatgaagttcaagaagctgagacaccccctgaactggatcctggtgaacctggccgtggccgacctggccgagaccgtgatcgccagcaccatcagcatcgtgaaccaggtgagcggctacttcgtgctgggccaccccatgtgcgtgctggagggctacaccgtgagcctgtgcggcatcaccggcctgtggagcctggccatcatcagctgggagagatggctggtggtgtgcaagcccttcggcaacgtgagattcgacgccaagctggccatcgtgggcatcgccttcagctggatctggagcgccgtgtggaccgccccccccatcttcggctggagcagatactggccccacggcctgaagaccagctgcggccccgacgtgttcagcggcagcagctaccccggcgtgcagagctacatgatcgtgctgatggtgacctgctgcatcatccccctggccatcatcatgctgtgctacctgcaggtgtggctggccatcagagccgtggccaagcagcagaaggagagcgagagcacccagaaggccgagaaggaggtgaccagaatggtggtggtgatgatcttcgcctactgcgtgtgctggggcccctacaccttcttcgcctgcttcgccgccgccaaccccggctacgccttccaccccctgatggccgccctgcccgcctacttcgccaagagcgccaccatctacaaccccgtgatctacgtgttcatgaacagacagttcagaaactgcatcctgcagctgttcggcaagaaggtggacgacggcagcgagctgagcagcgccagcaagaccgaggtgagcagcgtgagcagcgtgagccccgcctag

SEQ ID NO: 91960 - DNA, 1095 bp, Artificial Sequence
  Description of Artificial Sequence: Synthetic coding sequence
atggcccagcagtggagcctgcagagactggccggcagacacccccaggacagctacgaggacagcacccagagcagcatcttcacctacaccaacagcaacagcaccagaggccccttcgagggccccaactaccacatcgcccccagatgggtgtaccacctgaccagcgtgtggatgatcttcgtggtgatcgccagcgtgttcaccaacggcctggtgctggccgccaccatgaagttcaagaagctgagacaccccctgaactggatcctggtgaacctggccgtggccgacctggccgagaccgtgatcgccagcaccatcagcgtggtgaaccaggtgtacggctacttcgtgctgggccaccccatgtgcgtgctggagggctacaccgtgagcctgtgcggcatcaccggcctgtggagcctggccatcatcagctgggagagatggatggtggtgtgcaagcccttcggcaacgtgagattcgacgccaagctggccatcgtgggcatcgccttcagctggatctgggccgccgtgtggaccgccccccccatcttcggctggagcagatactggccccacggcctgaagaccagctgcggccccgacgtgttcagcggcagcagctaccccggcgtgcagagctacatgatcgtgctgatggtgacctgctgcatcacccccctgagcatcatcgtgctgtgctacctgcaggtgtggctggccatcagagccgtggccaagcagcagaaggagagcgagagcacccagaaggccgagaaggaggtgaccagaatggtggtggtgatggtgctggccttctgcttctgctggggcccctacgccttcttcgcctgcttcgccgccgccaaccccggctaccccttccaccccctgatggccgccctgcccgccttcttcgccaagagcgccaccatctacaaccccgtgatctacgtgttcatgaacagacagttcagaaactgcatcctgcagctgttcggcaagaaggtggacgacggcagcgagctgagcagcgccagcaagaccgaggtgagcagcgtgagcagcgtgagccccgcctag

SEQ ID NO: 91961 - DNA, 1047 bp, Artificial Sequence
  Description of Artificial Sequence: Synthetic coding sequence
atgagaaagatgagcgaggaggagttctacctgttcaagaacatcagcagcgtgggcccctgggacggcccccagtaccacatcgcccccgtgtgggccttctacctgcaggccgccttcatgggcaccgtgttcctgatcggcttccccctgaacgccatggtgctggtggccaccctgagatacaagaagctgagacagcccctgaactacatcctggtgaacgtgagcttcggcggcttcctgctgtgcatcttcagcgtgttccccgtgttcgtggccagctgcaacggctacttcgtgttcggcagacacgtgtgcgccctggagggcttcctgggcaccgtggccggcctggtgaccggctggagcctggccttcctggccttcgagagatacatcgtgatctgcaagcccttcggcaacttcagattcagcagcaagcacgccctgaccgtggtgctggccacctggaccatcggcatcggcgtgagcatcccccccttcttcggctggagcagattcatccccgagggcctgcagtgcagctgcggccccgactggtacaccgtgggcaccaagtacagaagcgagagctacacctggttcctgttcatcttctgcttcatcgtgcccctgagcctgatctgcttcagctacacccagctgctgagagccctgaaggccgtggccgcccagcagcaggagagcgccaccacccagaaggccgagagagaggtgagcagaatggtggtggtgatggtgggcagcttctgcgtgtgctacgtgccctacgccgccttcgccatgtacatggtgaacaacagaaaccacggcctggacctgagactggtgaccatccccagcttcttcagcaagagcgcctgcatctacaaccccatcatctactgcttcatgaacaagcagttccaggcctgcatcatgaagatggtgtgcggcaaggccatgaccgacgagagcgacacctgcagcagccagaagaccgaggtgagcaccgtgagcagcacccaggtgggccccaactag

SEQ ID NO: 91962 - DNA, 972 bp, Artificial Sequence
  Description of Artificial Sequence: Synthetic coding sequence
atgtacagcggcaacagaagcggcggccacggctactgggacggcggcggcgccgccggcgccgagggccccgcccccgccggcaccctgagccccgcccccctgttcagccccggcacctacgagagactggccctgctgctgggcagcatcggcctgctgggcgtgggcaacaacctgctggtgctggtgctgtactacaagttccagagactgagaacccccacccacctgctgctggtgaacatcagcctgagcgacctgctggtgagcctgttcggcgtgaccttcaccttcgtgagctgcctgagaaacggctgggtgtgggacaccgtgggctgcgtgtgggacggcttcagcggcagcctgttcggctggatcagccagctgcaggccgccaccagagaggccagagccagcatgggccccgtgcagcagggcaccatctgcatgcagctgagatgcgtggaggacctgcagaccatccaggtgatcaagatcctgaagtacgagaagaagctggccaagatgtgcttcctgatgatcttcaccttcctggtgtgctggatgccctacatcgtgatctgcttcctggtggtgaacggccacggccacctggtgacccccaccatcagcatcgtgagctacctgttcgccaagagcaacaccgtgtacaaccccgtgatctacgtgttcatgatcagaaagttcagaagaagcctgctgcagctgctgtgcctgagactgctgagatgccagagacccgccaaggacctgcccgccgccggcagcgagatgcagatcagacccatcgtgatgagccagaaggacggcgacagacccaagaagaaggtgaccttcaacagcagcagcatcatcttcatcatcaccagcgacgagagcctgagcgtggacgacagcgacaagaccaacggcagcaaggtggacgtgatccaggtgagacccctgtag

SEQ ID NO: 91963 - DNA, 1209 bp, Artificial Sequence
  Description of Artificial Sequence: Synthetic coding sequence
atgtacagcggcaacagaagcggcggccacggctactgggacggcggcggcgccgccggcgccgagggccccgcccccgccggcaccctgagccccgcccccctgttcagccccggcacctacgagagactggccctgctgctgggcagcatcggcctgctgggcgtgggcaacaacctgctggtgctggtgctgtactacaagttccagagactgagaacccccacccacctgctgctggtgaacatcagcctgagcgacctgctggtgagcctgttcggcgtgaccttcaccttcgtgagctgcctgagaaacggctgggtgtgggacaccgtgggctgcgtgtgggacggcttcagcggcagcctgttcggcatcgtgagcatcgccaccctgaccgtgctggcctacgagagatacatcagagtggtgcacgccagagtgatcaacttcagctgggcctggagagccatcacctacatctggctgtacagcctggcctgggccggcgcccccctgctgggctggaacagatacatcctggacgtgcacggcctgggctgcaccgtggactggaagagcaaggacgccaacgacagcagcttcgtgctgttcctgttcctgggctgcctggtggtgcccctgggcgtgatcgcccactgctacggccacatcctgtacagcatcagaatgctgagatgcgtggaggacctgcagaccatccaggtgatcaagatcctgaagtacgagaagaagctggccaagatgtgcttcctgatgatcttcaccttcctggtgtgctggatgccctacatcgtgatctgcttcctggtggtgaacggccacggccacctggtgacccccaccatcagcatcgtgagctacctgttcgccaagagcaacaccgtgtacaaccccgtgatctacgtgttcatgatcagaaagttcagaagaagcctgctgcagctgctgtgcctgagactgctgagatgccagagacccgccaaggacctgcccgccgccggcagcgagatgcagatcagacccatcgtgatgagccagaaggacggcgacagacccaagaagaaggtgaccttcaacagcagcagcatcatcttcatcatcaccagcgacgagagcctgagcgtggacgacagcgacaagaccaacggcagcaaggtggacgtgatccaggtgagacccctgtag

SEQ ID NO: 91964 - DNA, 2886 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcggcagccccgaggagaccgccttcagagccaccgacagaggcagcgagagcgacaagcacttcagaaagggcctgctgggcgagctgatcctgctgcagcagcagatccaggagcacgaggaggaggccagaagagccgccggccagtacagcaccagctacgcccagcagaagagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91965 - DNA, 3048 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcgagaagatcagaaaggccctgcccagcagcgaggacctggtgaagctggcccccgacttcgacaagatcgtggagagcctgagcctgctgaaggacttcttcaccagcggccacaagctggtgagcgaggtgatcggcgccagcgacctgctgctgctgctgggcagccccgaggagaccgccttcagagccaccgacagaggcagcgagagcgacaagcacttcagaaagggcctgctgggcgagctgatcctgctgcagcagcagatccaggagcacgaggaggaggccagaagagccgccggccagtacagcaccagctacgcccagcagaagagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91966 - DNA, 2940 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcggccacaagctggtgagcgaggtgatcggcgccagcgacctgctgctgctgctgggcagccccgaggagaccgccttcagagccaccgacagaggcagcgagagcgacaagcacttcagaaagggcctgctgggcgagctgatcctgctgcagcagcagatccaggagcacgaggaggaggccagaagagccgccggccagtacagcaccagctacgcccagcagaagagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91967 - DNA, 2937 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcgagaagatcagaaaggccctgcccagcagcgaggacctggtgaagctggcccccgacttcgacaagatcgtggagagcctgagcctgctgaaggacttcttcaccagcggccacaagctggtgagcgaggtgatcggcgccagcgacctgctgctgctgctgggcagccccgaggagaccgccttcagagccaccgacagaggcagcgagagcgacaagcacttcagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91968 - DNA, 2994 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcgagaagatcagaaaggccctgcccagcagcgaggacctggtgaagctggcccccgacttcgacaagatcgtggagagcctgagcctgctgaaggacttcttcaccagcggcagccccgaggagaccgccttcagagccaccgacagaggcagcgagagcgacaagcacttcagaaagggcctgctgggcgagctgatcctgctgcagcagcagatccaggagcacgaggaggaggccagaagagccgccggccagtacagcaccagctacgcccagcagaagagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91969 - DNA, 501 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcggcagccccgaggagaccgccttcagagccaccgacagaggcagcgagagctag

SEQ ID NO: 91970 - DNA, 2883 bp, Artificial Sequence
  Description of Artificial Sequence: Synthetic coding sequence
atgtggagactgagaagagccgccgtggcctgcgaggtgtgccagagcctggtgaagcacagcagcggcatcaagggcagcctgcccctgcagaagctgcacctggtgagcagaagcatctaccacagccaccaccccaccctgaagctgcagagaccccagctgagaaccagcttccagcagttcagcagcctgaccaacctgcccctgagaaagctgaagttcagccccatcaagtacggctaccagcccagaagaaacttctggcccgccagactggccaccagactgctgaagctgagatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcgagaagatcagaaaggccctgcccagcagcgaggacctggtgaagctggcccccgacttcgacaagatcgtggagagcctgagcctgctgaaggacttcttcaccagcggcagccccgaggagaccgccttcagagccaccgacagaggcagcgagagcgacaagcacttcagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtacagcgaggtgctggacgtgctgagcgactacgacgccagctacaacacccaggaccacctgcccagagtggtggtggtgggcgaccagagcgccggcaagaccagcgtgctggagatgatcgcccaggccagaatcttccccagaggcagcggcgagatgatgaccagaagccccgtgaaggtgaccctgagcgagggcccccaccacgtggccctgttcaaggacagcagcagagagttcgacctgaccaaggaggaggacctggccgccctgagacacgagatcgagctgagaatgagaaagaacgtgaaggagggctgcaccgtgagccccgagaccatcagcctgaacgtgaagggccccggcctgcagagaatggtgctggtggacctgcccggcgtgatcaacaccgtgaccagcggcatggcccccgacaccaaggagaccatcttcagcatcagcaaggcctacatgcagaaccccaacgccatcatcctgtgcatccaggacggcagcgtggacgccgagagaagcatcgtgaccgacctggtgagccagatggacccccacggcagaagaaccatcttcgtgctgaccaaggtggacctggccgagaagaacgtggccagccccagcagaatccagcagatcatcgagggcaagctgttccccatgaaggccctgggctacttcgccgtggtgaccggcaagggcaacagcagcgagagcatcgaggccatcagagagtacgaggaggagttcttccagaacagcaagctgctgaagaccagcatgctgaaggcccaccaggtgaccaccagaaacctgagcctggccgtgagcgactgcttctggaagatggtgagagagagcgtggagcagcaggccgacagcttcaaggccaccagattcaacctggagaccgagtggaagaacaactaccccagactgagagagctggacagaaacgagctgttcgagaaggccaagaacgagatcctggacgaggtgatcagcctgagccaggtgacccccaagcactgggaggagatcctgcagcagagcctgtgggagagagtgagcacccacgtgatcgagaacatctacctgcccgccgcccagaccatgaacagcggcaccttcaacaccaccgtggacatcaagctgaagcagtggaccgacaagcagctgcccaacaaggccgtggaggtggcctgggagaccctgcaggaggagttcagcagattcatgaccgagcccaagggcaaggagcacgacgacatcttcgacaagctgaaggaggccgtgaaggaggagagcatcaagagacacaagtggaacgacttcgccgaggacagcctgagagtgatccagcacaacgccctggaggacagaagcatcagcgacaagcagcagtgggacgccgccatctacttcatggaggaggccctgcaggccagactgaaggacaccgagaacgccatcgagaacatggtgggccccgactggaagaagagatggctgtactggaagaacagaacccaggagcagtgcgtgcacaacgagaccaagaacgagctggagaagatgctgaagtgcaacgaggagcaccccgcctacctggccagcgacgagatcaccaccgtgagaaagaacctggagagcagaggcgtggaggtggaccccagcctgatcaaggacacctggcaccaggtgtacagaagacacttcctgaagaccgccctgaaccactgcaacctgtgcagaagaggcttctactactaccagagacacttcgtggacagcgagctggagtgcaacgacgtggtgctgttctggagaatccagagaatgctggccatcaccgccaacaccctgagacagcagctgaccaacaccgaggtgagaagactggagaagaacgtgaaggaggtgctggaggacttcgccgaggacggcgagaagaagatcaagctgctgaccggcaagagagtgcagctggccgaggacctgaagaaggtgagagagatccaggagaagctggacgccttcatcgaggccctgcaccaggagaagtag

SEQ ID NO: 91971 - DNA, 558 bp, Artificial Sequence
  Description of Artificial Sequence: Synthetic coding sequence
tgatacctgatcctgggcagcgccgtgggcggcggctacaccgccaagaagaccttcgaccagtggaaggacatgatccccgacctgagcgagtacaagtggatcgtgcccgacatcgtgtgggagatcgacgagtacatcgacttcgagaagatcagaaaggccctgcccagcagcgaggacctggtgaagctggcccccgacttcgacaagatcgtggagagcctgagcctgctgaaggacttcttcaccagcggccacaagctggtgagcgaggtgatcggcgccagcgacctgctgctgctgctgggcagccccgaggagaccgccttcagagccaccgacagaggcagcgagagcgacaagcacttcagaaaggtgagcgacaaggagaagatcgaccagctgcaggaggagctgctgcacacccagctgaagtaccagagaatcctggagagactggagaaggagaacaaggagctgagaaagctggtgctgcagaaggacgacaagggcatccaccacagaaagctgaagaagagcctgatcgacatgtag

SEQ ID NO: 91972 - DNA, 540 bp, Artificial Sequence
  Description of Artificial Sequence: Synthetic coding sequence
atggtggtgggcgccttccccatggccaagctgctgtacctgggcatcagacaggtgagcaagcccctggccaacagaatcaaggaggccgccagaagaagcgagttcttcaagacctacatctgcctgccccccgcccagctgtaccactgggtggagatgagaaccaagatgagaatcatgggcttcagaggcaccgtgatcaagcccctgaacgaggaggccgccgccgagctgggcgccgagctgctgggcgaggccaccatcttcatcgtgggcggcggctgcctggtgctggagtactggagacaccaggcccagcagagacacaaggaggaggagcagagagccgcctggaacgccctgagagacgaggtgggccacctggccctggccctggaggccctgcaggcccaggtgcaggccgcccccccccagggcgccctggaggagctgagaaccgagctgcaggaggtgagagcccagctgtgcaaccccggcagaagcgccagccacgccgtgcccgccagcaagaagtag

SEQ ID NO: 91973 - DNA, 543 bp, Artificial Sequence
  Description of Artificial Sequence: Synthetic coding sequence
atggtggtgggcgccttccccatggccaagctgctgtacctgggcatcagacaggtgagcaagcccctggccaacagaatcaaggaggccgccagaagaagcgagttcttcaagacctacatctgcctgccccccgcccagctgtaccactggctggagatgagaaccaagatgagaatcatgggcttcaacgccgccgccatcaagcccctgaacgagggcgccgccgccgagctgggcgccgagctgctgggcgagggcatcatcttcatcaccgcctgcagctgcctgatgctggagtactggagacaccagctgcagcagagaagaaaggagaaggagagaagagtggccagagaggccctgagaggcgaggtgggccacctgggcctggccctggaggagctgcaggcccaggtgcaggccaccagcacccagctggccctggaggagctgagagcccagctgcaggaggtgagagcccacctgtgcctgagagaccccccccccgccccccccgtggcccccgccagcgagaagtag

SEQ ID NO: 91974 - DNA, 381 bp, Artificial Sequence
  Description of Artificial Sequence: Synthetic coding sequence
atgagaaccaagatgagaatcatgggcttcagaggcaccgtgatcaagcccctgaacgaggaggccgccgccgagctgggcgccgagctgctgggcgaggccaccatcttcatcgtgggcggcggctgcctggtgctggagtactggagacaccaggcccagcagagacacaaggaggaggagcagagagccgcctggaacgccctgagagacgaggtgggccacctggccctggccctggaggccctgcaggcccaggtgcaggccgcccccccccagggcgccctggaggagctgagaaccgagctgcaggaggtgagagcccagctgtgcaaccccggcagaagcgccagccacgccgtgcccgccagcaagaagtag

SEQ ID NO: 91975 - DNA, 1734 bp, Artificial Sequence
  Description of Artificial Sequence: Synthetic coding sequence
atgagccaccagcccctgagctgcctgaccgagaaggaggacagccccagcgagagcaccggcaacggccccccccacctggcccaccccaacctggacaccttcacccccgaggagctgctgcagcagatgaaggagctgctgaccgagaaccaccagctgaaggaggccatgaagctgaacaaccaggccatgaagggcagattcgaggagctgagcgcctggaccgagaagcagaaggaggagagacagttcttcgagatccagagcaaggaggccaaggagagactgatggccctgagccacgagaacgagaagctgaaggaggagctgggcaagctgaagggcaagagcgagagaagcagcgaggaccccaccgacgacagcagactgcccagagccgaggccgagcaggagaaggaccagctgagaacccaggtggtgagactgcaggccgagaaggccgacctgctgggcatcgtgagcgagctgcagctgaagctgaacagcagcggcagcagcgaggacagcttcgtggagatcagaatggccgagggcgaggccgagggcagcgtgaaggagatcaagcacagccccggccccaccagaaccgtgagcaccggcaccgccctgagcaagtacagaagcagaagcgccgacggcgccaagaactacttcgagcacgaggagctgaccgtgagccagctgctgctgtgcctgagagagggcaaccagaaggtggagagactggaggtggccctgaaggaggccaaggagagagtgagcgacttcgagaagaagaccagcaacagaagcgagatcgagacccagaccgagggcagcaccgagaaggagaacgacgaggagaagggccccgagaccgtgggcagcgaggtggaggccctgaacctgcaggtgaccagcctgttcaaggagctgcaggaggcccacaccaagctgagcaaggccgagctgatgaagaagagactgcaggagaagtgccaggccctggagagaaagaacagcgccatccccagcgagctgaacgagaagcaggagctggtgtacaccaacaagaagctggagctgcaggtggagagcatgctgagcgagatcaagatggagcaggccaagaccgaggacgagaagagcaagctgaccgtgctgcagatgacccacaacaagctgctgcaggagcacaacaacgccctgaagaccatcgaggagctgaccagaaaggagagcgagaaggtggacagagccgtgctgaaggagctgagcgagaagctggagctggccgagaaggccctggccagcaagcagctgcagatggacgagatgaagcagaccatcgccaagcaggaggaggacctggagaccatgaccatcctgagagcccagatggaggtgtactgcagcgacttccacgccgagagagccgccagagagaagatccacgaggagaaggagcagctggccctgcagctggccgtgctgctgaaggagaacgacgccttcgaggacggcggcagacagagcctgatggagatgcagagcagacacggcgccagaaccagcgacagcgaccagcaggcctacctggtgcagagaggcgccgaggacagagactggagacagcagagaaacatccccatccacagctgccccaagtgcggcgaggtgctgcccgacatcgacaccctgcagatccacgtgatggactgcatcatctag

SEQ ID NO: 91976 - DNA, 1734 bp, Artificial Sequence; identical to SEQ ID NO: 91975
  Description of Artificial Sequence: Synthetic coding sequence

SEQ ID NO: 91977 - DNA, 1734 bp, Artificial Sequence; identical to SEQ ID NO: 91975
  Description of Artificial Sequence: Synthetic coding sequence

SEQ ID NO: 91978 - DNA, 1716 bp, Artificial Sequence
  Description of Artificial Sequence: Synthetic coding sequence
atgagccaccagcccctgagctgcctgaccgagaaggaggacagccccagcgagagcaccggcaacggccccccccacctggcccaccccaacctggacaccttcacccccgaggagctgctgcagcagatgaaggagctgctgaccgagaaccaccagctgaaggaggccatgaagctgaacaaccaggccatgaagggcagattcgaggagctgagcgcctggaccgagaagcagaaggaggagagacagttcttcgagatccagagcaaggaggccaaggagagactgatggccctgagccacgagaacgagaagctgaaggaggagctgggcaagctgaagggcaagagcgagagaagcagcgaggaccccaccgacgacagcagactgcccagagccgaggccgagcaggagaaggaccagctgagaacccaggtggtgagactgcaggccgagaaggccgacctgctgggcatcgtgagcgagctgcagctgaagctgaacagcagcggcagcagcgaggacagcttcgtggagatcagaatggccgagggcgaggccgagggcagcgtgaaggagatcaagcacagccccggccccaccagaaccgtgagcaccggcaccagcagaagcgccgacggcgccaagaactacttcgagcacgaggagctgaccgtgagccagctgctgctgtgcctgagagagggcaaccagaaggtggagagactggaggtggccctgaaggaggccaaggagagagtgagcgacttcgagaagaagaccagcaacagaagcgagatcgagacccagaccgagggcagcaccgagaaggagaacgacgaggagaagggccccgagaccgtgggcagcgaggtggaggccctgaacctgcaggtgaccagcctgttcaaggagctgcaggaggcccacaccaagctgagcaaggccgagctgatgaagaagagactgcaggagaagtgccaggccctggagagaaagaacagcgccatccccagcgagctgaacgagaagcaggagctggtgtacaccaacaagaagctggagctgcaggtggagagcatgctgagcgagatcaagatggagcaggccaagaccgaggacgagaagagcaagctgaccgtgctgcagatgacccacaacaagctgctgcaggagcacaacaacgccctgaagaccatcgaggagctgaccagaaaggagagcgagaaggtggacagagccgtgctgaaggagctgagcgagaagctggagctggccgagaaggccctggccagcaagcagctgcagatggacgagatgaagcagaccatcgccaagcaggaggaggacctggagaccatgaccatcctgagagcccagatggaggtgtactgcagcgacttccacgccgagagagccgccagagagaagatccacgaggagaaggagcagctggccctgcagctggccgtgctgctgaaggagaacgacgccttcgaggacggcggcagacagagcctgatggagatgcagagcagacacggcgccagaaccagcgacagcgaccagcaggcctacctggtgcagagaggcgccgaggacagagactggagacagcagagaaacatccccatccacagctgccccaagtgcggcgaggtgctgcccgacatcgacaccctgcagatccacgtgatggactgcatcatctag

SEQ ID NO: 91979 - DNA, 1734 bp, Artificial Sequence; identical to SEQ ID NO: 91975
  Description of Artificial Sequence: Synthetic coding sequence

SEQ ID NO: 91980 - DNA, 1716 bp, Artificial Sequence; identical to SEQ ID NO: 91978
  Description of Artificial Sequence: Synthetic coding sequence

SEQ ID NO: 91981 - DNA, 381 bp, Artificial Sequence
  Description of Artificial Sequence: Synthetic coding sequence
tgaggcgaggccgagggcagcgtgaaggagatcaagcacagccccggccccaccagaaccgtgagcaccggcaccgccctgagcaagtacagaagcagaagcgccgacggcgccaagaactacttcgagcacgaggagctgaccgtgagccagctgctgctgtgcctgagagagggcaaccagaaggtggagagactggaggtggccctgaaggaggccaaggagagagtgagcgacttcgagaagaagaccagcaacagaagcgagatcgagacccagaccgagggcagcaccgagaaggagaacgacgaggagaagggccccgagaccaccggcttccaccacgtgggccaggacggcctggacctgctgaccagctag

SEQ ID NO: 91982 - DNA, 444 bp, Artificial Sequence
  Description of Artificial Sequence: Synthetic coding sequence
atgaagctgaacaaccaggccatgaagggcagattcgaggagctgagcgcctggaccgagaagcagaaggaggagagacagttcttcgagatccagagcaaggaggccaaggagagactgatggccctgagccacgagaacgagaagctgaaggaggagctgggcaagctgaagggcaagagcgagagaagcagcgaggaccccaccgacgacagcagactgcccagagccgaggccgagcaggagaaggaccagctgagaacccaggtggtgagactgcaggccgagaaggccgacctgctgggcatcgtgagcgagctgcagctgaagctgaacagcagcggcagcagcgaggacagcttcgtggagatcagaatggccgagggcgaggccgagggcagcgtgaaggagatcaagcacagccccggccccaccagaacctag

SEQ ID NO: 91983 - DNA, 912 bp, Artificial Sequence
  Description of Artificial Sequence: Synthetic coding sequence
atgcaccccgagcccgcccccccccccagcagaagcagccccgagctgccccccagcggcggcagcaccaccagcggcagcagaagaagcagaagaagaagcggcgacggcgagccccccggcgcccccccccccccccccccccccagcgccgtgacctaccccgactggatcggccagagctacagcgaggtgatgagcctgaacgagcacagcatgcaggccctgagctggagaaagctgtacctgagcagagccaagctgaaggccagcagcagaaccagcgccctgctgagcggcttcgccatggtggccatggtggaggtgcagctggacgccgaccacgactacccccccggcctgctgatcgccttcagcgcctgcaccaccgtgctggtggccgtgcacctgttcgccctgatgatcagcacctgcatcctgcccaacatcgaggccgtgagcaacgtgcacaacctgaacagcgtgaaggagagcccccacgagagaatgcacagacacatcgagctggcctgggccttcagcaccgtgatcggcaccctgctgttcctggccgaggtggtgctgctgtgctgggtgaagttcctgcccctgaagaagcagcccggccagcccagacccaccagcaagccccccgccagcggcgccgccgccaacgtgagcaccagcggcatcacccccggccaggccgccgccatcgccagcaccaccatcatggtgcccttcggcctgatcttcatcgtgttcgccgtgcacttctacagaagcctggtgagccacaagaccgacagacagttccaggagctgaacgagctggccgagttcgccagactgcaggaccagctggaccacagaggcgaccaccccctgacccccggcagccactacgcctag

SEQ ID NO: 91984 - DNA, 765 bp, Artificial Sequence
  Description of Artificial Sequence: Synthetic coding sequence
atgagcgccgagctgaacgtgcccatcgaccccagcgcccccgcctgccccgagcccggccacaagggcatggactacagagactgggtgagaagaagctacctggagctggtgaccagcaaccaccacagcgtgcaggccctgagctggagaaagctgtacctgagcagagccaagctgaaggccagcagcagaaccagcgccctgctgagcggcttcgccatggtggccatggtggaggtgcagctggagacccagtaccagtaccccagacccctgctgatcgccttcagcgcctgcaccaccgtgctggtggccgtgcacctgttcgccctgctgatcagcacctgcatcctgcccaacgtggaggccgtgagcaacatccacaacctgaacagcatcagcgagagcccccacgagagaatgcacccctacatcgagctggcctggggcttcagcaccgtgctgggcatcctgctgttcctggccgaggtggtgctgctgtgctggatcaagttcctgcccgtggacgccagaagacagcccggccccccccccggccccggcagccacaccggctggcaggccgccctggtgagcaccatcatcatggtgcccgtgggcctgatcttcgtggtgttcaccatccacttctacagaagcctggtgagacacaagaccgagagacacaacagagagatcgaggagctgcacaagctgaaggtgcagctggacggccacgagagaagcctgcaggtgctgtag

SEQ ID NO: 91985 - DNA, 765 bp, Artificial Sequence; identical to SEQ ID NO: 91984
  Description of Artificial Sequence: Synthetic coding sequence

SEQ ID NO: 91986 - DNA, 639 bp, Artificial Sequence
  Description of Artificial Sequence: Synthetic coding sequence
atgagcgccgagctgaacgtgcccatcgaccccagcgcccccgcctgccccgagcccggccacaagggcatggactacagagactgggtgagaagaagctacctggagctggtgaccagcaaccaccacagcgtgcaggccctgagctggagaaagctgtacctgagcagagccaagctgaaggccagcagcagaaccagcgccctgctgagcggcttcgccatggtggccatggtggaggtgcagctggagacccagtaccagtaccccagacccctgctgatcgccttcagcgcctgcaccaccgtgctggtggccgtgcacctgttcgccctgctgatcagcacctgcatcctgcccaacgtggaggccgtgagcaacatccacaacctgaacagcatcagcgagagcccccacgagagaatgcacccctacatcgagctggcctggggcttcagcaccgtgctgggcatcctgctgttcctggccgaggtggtgctgctgtgctggatcaagttcctgcccgtggacgccagaagacagcccggccccccccccggccccggcagccacaccggctggcaggccgccctggtgagcaccatcatcatggtgcccgtgggcctgatcttcgtgtag

SEQ ID NO: 91987 - DNA, 765 bp, Artificial Sequence; identical to SEQ ID NO: 91984
  Description of Artificial Sequence: Synthetic coding sequence

SEQ ID NO: 91988 - DNA, 765 bp, Artificial Sequence; identical to SEQ ID NO: 91984
  Description of Artificial Sequence: Synthetic coding sequence

SEQ ID NO: 91989 - DNA, 93 bp, Artificial Sequence
  Description of Artificial Sequence: Synthetic coding sequence
atgagcgccgagctgaacgtgcccatcgaccccagcgcccccgcctgccccgagcccggccacaagggcatggactacagagactgggtgtag

SEQ ID NO: 91990 - DNA, 690 bp, Artificial Sequence
  Description of Artificial Sequence: Synthetic coding sequence
atgagcgccgagctgaacgtgcccatcgaccccagcgcccccgcctgccccgagcccggccacaagggcatggactacagagactgggtgagaagaagctacctggagctggtgaccagcaaccaccacagcgtgcaggccctgagctggagaaagctgtacctgagcagagccaagctgaaggccagcagcagaaccagcgccctgctgagcggcttcgccatggtggccatggtggaggtgcagctggagacccagtaccagtaccccagacccctgctgatcgccttcagcgcctgcaccaccgtgctggtggccgtgcacctgttcgccctgctgatcagcacctgcatcctgcccaacgtggaggccgtgagcaacatccacaacctgaacagcatcagcgagagcccccacgagagaatgcacccctacatcgagctggcctggggcttcagcaccgtgctgggcatcctgctgttcctggccgaggtggtgctgctgtgctggatcaagttcctgcccgtggacgccagaagacagcccggccccccccccggccccggcagccacaccggctggcaggccgccctggtgagcaccatcatcatggtgcccgtgggcctgatcttcgtggtgttcaccatccacttctacagaagcctggtgagacacaagaccgagagatag

SEQ ID NO: 91991 - DNA, 294 bp, Artificial Sequence
  Description of Artificial Sequence: Synthetic coding sequence
atgagcgccgagctgaacgtgcccatcgaccccagcgcccccgcctgccccgagcccggccacaagggcatggactacagagactgggtgagaagaagctacctggagctggtgaccagcaaccaccacagcgtgcaggccctgagctggagaaagctgtacctgagcagagccaagctgaaggccagcagcagaaccagcgccctgctgagcggcttcgccatggtggccatggtggaggtgcagctggagacccagtaccagtaccccagacccctgctgatcgccttctag

SEQ ID NO: 91992 - DNA, 888 bp, Artificial Sequence
  Description of Artificial Sequence: Synthetic coding sequence
atgaagggcggcgagggcgacgccggcgagcaggcccccctgaaccccgagggcgagagccccgccggcagcgccacctacagagagttcgtgcacagaggctacctggacctgatgggcgccagccagcacagcctgagagccctgagctggagaagactgtacctgagcagagccaagctgaaggccagcagcagaaccagcgccctgctgagcggcttcgccatggtggccatggtggaggtgcagctggagagcgaccacgagtacccccccggcctgctggtggccttcagcgcctgcaccaccgtgctggtggccgtgcacctgttcgccctgatggtgagcacctgcctgctgccccacatcgaggccgtgagcaacatccacaacctgaacagcgtgcaccagagcccccaccagagactgcacagatacgtggagctggcctggggcttcagcaccgccctgggcaccttcctgttcctggccgaggtggtgctggtgggctgggtgaagttcgtgcccatcggcgcccccctggacacccccacccccatggtgcccaccagcagagtgcccggcaccctggcccccgtggccaccagcctgagccccgccagcaacctgcccagaagcagcgccagcgccgcccccagccaggccgagcccgcctgcccccccagacaggcctgcggcggcggcggcgcccacggccccggctggcaggccgccatggccagcaccgccatcatggtgcccgtgggcctggtgttcgtggccttcgccctgcacttctacagaagcctggtggcccacaagaccgacagatacaagcaggagctggaggagctgaacagactgcagggcgagctgcaggccgtgtag

SEQ ID NO: 91993 - DNA, 822 bp, Artificial Sequence
  Description of Artificial Sequence: Synthetic coding sequence
atgaagggcggcgagggcgacgccggcgagcaggcccccctgaaccccgagggcgagagccccgccggcagcgccacctacagagagttcgtgcacagaggctacctggacctgatgggcgccagccagcacagcctgagagccctgagctggagaagactgtacctgagcagagccaagctgaaggccagcagcagaaccagcgccctgctgagcggcttcgccatggtggccatggtggaggtgcagctggagagcgaccacgagtacccccccggcctgctggtggccttcagcgcctgcaccaccgtgctggtggccgtgcacctgttcgccctgatggtgagcacctgcctgctgccccacatcgaggccgtgagcaacatccacaacctgaacagcgtgcaccagagcccccaccagagactgcacagatacgtggagctggcctggggcttcagcaccgccctgggcaccttcctgttcctggccgaggtggtgctggtgggctgggtgaagttcgtgcccatcggcgcccccctggacacccccacccccatggtgcccaccagcagagtgcccggcaccctggcccccgtggccaccagcctgagccccgccagcaacctgcccagaagcagcgccagcgccgcccccagccaggccgagcccgcctgcccccccagacaggcctgcggcggcggcggcgcccacggccccggctggcaggccgccatggccagcaccttccccggcatcttccccatcagcctgagcctgggcttctgcaagctgctgtgcacctgggccggcctgagctag

SEQ ID NO: 91994 - DNA, 414 bp, Artificial Sequence
  Description of Artificial Sequence: Synthetic coding sequence
atggccggcagccaggacatcttcgacgccatcgtgatggccgacgagagattccacggcgagggctacagagagggctacgaggagggcagcagcctgggcgtgatggagggcagacagcacggcaccctgcacggcgccaagatcggcagcgagatcggctgctaccagggcttcgccttcgcctggaagtgcctgctgcacagctgcaccaccgagaaggacagcagaaagatgaaggtgctggagagcctgatcggcatgatccagaagttcccctacgacgaccccacctacgacaagctgcacgaggacctggacaagatcagaggcaagttcaagcagttctgcagcctgctgaacgtgcagcccgacttcaagatcagcgccgagggcagcggcctgagcttctag

SEQ ID NO: 91995 - DNA, 666 bp, Artificial Sequence
  Description of Artificial Sequence: Synthetic coding sequence
atggccggcagccaggacatcttcgacgccatcgtgatggccgacgagagattccacggcgagggctacagagagggctacgaggagggcagcagcctgggcgtgatggagggcagacagcacggcaccctgcacggcgccaagatcggcagcgagatcggctgctaccagggcttcgccttcgcctggaagtgcctgctgcacagctgcaccaccgagaaggacagcagaaagatgaaggtgctggagagcctgatcggcatgatccagaagttcccctacgacgaccccacctacgacaagctgcacgaggacctggacaagatcagaggcaagttcaagcagaccggcctgagccccagcgccgtgatggtgagaccccccagctacgtggagctgcccgtgacctgctggtgctgggaggcccccagatgcaaccagaagtgcaccgaccccgccgccagaagacccgacccccagacctgcgccagccaggacagactgagatgcgccccctgcacctgccaccagcccctggccagcagatacacccagcaccccggcctggtgcccctgccccaccacgacagacagagcgtgccccagggccccagagtggtgcagaccgacgccgccgccagaatggtggagcagcagaccatgtag

SEQ ID NO: 91996 - DNA, 414 bp, Artificial Sequence; identical to SEQ ID NO: 91994
  Description of Artificial Sequence: Synthetic coding sequence

SEQ ID NO: 91997 - DNA, 237 bp, Artificial Sequence
  Description of Artificial Sequence: Synthetic coding sequence
atggccggcagccaggacatcttcgacgccatcgtgatggccgacgagagcagaaagatgaaggtgctggagagcctgatcggcatgatccagaagttcccctacgacgaccccacctacgacaagctgcacgaggacctggacaagatcagaggcaagttcaagcagttctgcagcctgctgaacgtgcagcccgacttcaagatcagcgccgagggcagcggcctgagcttctag

SEQ ID NO: 91998 - DNA, 3039 bp, Artificial Sequence
  Description of Artificial Sequence: Synthetic coding sequence
atgatggcccagagcaacatgttcaccgtggccgacgtgctgagccaggacgagctgagaaagaagctgtaccagaccttcaaggacagaggcatcctggacaccctgaagacccagctgagaaaccagctgatccacgagctgatgcaccccgtgctgagcggcgagctgcagcccagaagcatcagcgtggagggcagcagcctgctgatcggcgccagcaacagcctggtggccgaccacctgcagagatgcggctacgagtacagcctgagcgtgttcttccccgagagcggcctggccaaggagaaggtgttcaccatgcaggacctgctgcagctgatcaagatcaaccccaccagcagcctgtacaagagcctggtgagcggcagcgacaaggagaaccagaagggcttcctgatgcacttcctgaaggagctggccgagtaccaccaggccaaggagagctgcaacatggagacccagaccagcagcaccttcaacagagacagcctggccgagaagctgcagctgatcgacgaccagttcgccgacgcctacccccagagaatcaagttcgagagcctggagatcaagctgaacgagtacaagagagagatcgaggagcagctgagagccgagatgtgccagaagctgaagttcttcaaggacaccgagatcgccaagatcaagatggaggccaagaagaagtacgagaaggagctgaccatgttccagaacgacttcgagaaggcctgccaggccaagagcgaggccctggtgctgagagagaagagcaccctggagagaatccacaagcaccaggagatcgagaccaaggagatctacgcccagagacagctgctgctgaaggacatggacctgctgagaggcagagaggccgagctgaagcagagagtggaggccttcgagctgaaccagaagctgcaggaggagaagcacaagagcatcaccgaggccctgagaagacaggagcagaacatcaagagcttcgaggagacctacgacagaaagctgaagaacgagctgctgaagtaccagctggagctgaaggacgactacatcatcagaaccaacagactgatcgaggacgagagaaagaacaaggagaaggccgtgcacctgcaggaggagctgatcgccatcaacagcaagaaggaggagctgaaccagagcgtgaacagagtgaaggagctggagctggagctggagagcgtgaaggcccagagcctggccatcaccaagcagaaccacatgctgaacgagaaggtgaaggagatgagcgactacagcctgctgaaggaggagaagctggagctgctggcccagaacaagctgctgaagcagcagctggaggagagcagaaacgagaacctgagactgctgaacagactggcccagcccgcccccgagctggccgtgttccagaaggagctgagaaaggccgagaaggccatcgtggtggagcacgaggagttcgagagctgcagacaggccctgcacaagcagctgcaggacgagatcgagcacagcgcccagctgaaggcccagatcctgggctacaaggccagcgtgaagagcctgaccacccaggtggccgacctgaagctgcagctgaagcagacccagaccgccctggagaacgaggtgtactgcaaccccaagcagagcgtgatcgacagaagcgtgaacggcctgatcaacggcaacgtggtgccctgcaacggcgagatcagcggcgacttcctgaacaaccccttcaagcaggagaacgtgctggccagaatggtggccagcagaatcaccaactaccccaccgcctgggtggagggcagcagccccgacagcgacctggagttcgtggccaacaccaaggccagagtgaaggagctgcagcaggaggccgagagactggagaaggccttcagaagctaccacagaagagtgatcaagaacagcgccaagagccccctggccgccaagagcccccccagcctgcacctgctggaggccttcaagaacatcaccagcagcagccccgagagacacatcttcggcgaggacagagtggtgagcgagcagccccaggtgggcaccctggaggagagaaacgacgtggtggaggccctgaccggcagcgccgccagcagactgagaggcggcaccagcagcagaagactgagcagcacccccctgcccaaggccaagagaagcctggagagcgagatgtacctggagggcctgggcagaagccacatcgccagccccagcccctgccccgacagaatgcccctgcccagccccaccgagagcagacacagcctgagcatcccccccgtgagcagcccccccgagcagaaggtgggcctgtacagaagacagaccgagctgcaggacaagagcgagttcagcgacgtggacaagctggccttcaaggacaacgaggagttcgagagcagcttcgagagcgccggcaacatgcccagacagctggagatgggcggcctgagccccgccggcgacatgagccacgtggacgccgccgccgccgccgtgcccctgagctaccagcaccccagcgtggaccagaagcagatcgaggagcagaaggaggaggagaagatcagagagcagcaggtgaaggagagaagacagagagaggagagaagacagagcaacctgcaggaggtgctggagagagagagaagagagctggagaagctgtaccaggagagaaagatgatcgaggagagcctgaagatcaagatcaagaaggagctggagatggagaacgagctggagatgagcaaccaggagatcaaggacaagagcgcccacagcgagaaccccctggagaagtacatgaagatcatccagcaggagcaggaccaggagagcgccgacaagagcagcaagaagatggtgcaggagggcagcctggtggacaccctgcagagcagcgacaaggtggagagcctgaccggcttcagccacgaggagctggacgacagctggtag

SEQ ID NO: 91999 - DNA, 2919 bp, Artificial Sequence
  Description of Artificial Sequence: Synthetic coding sequence
atgatggcccagagcaacatgttcaccgtggccgacgtgctgagccaggacgagctgagaaagaagctgtaccagaccttcaaggacagaggcatcctggacaccctgaagacccagctgagaaaccagctgatccacgagctgatgcaccccgtgctgagcggcgagctgcagcccagaagcatcagcgtggagggcagcagcctgctgatcggcgccagcaacagcctggtggccgaccacctgcagagatgcggctacgagtacagcctgagcgtgttcttccccgagagcggcctggccaaggagaaggtgttcaccatgcaggacctgctgcagctgatcaagatcaaccccaccagcagcctgtacaagagcctggtgagcggcagcgacaaggagaaccagaagggcttcctgatgcacttcctgaaggagctggccgagtaccaccaggccaaggagagctgcaacatggagacccagaccagcagcaccttcaacagagacagcctggccgagaagctgcagctgatcgacgaccagttcgccgacgcctacccccagagaatcaagttcgagagcctggagatcaagctgaacgagtacaagagagagatcgaggagcagctgagagccgagatgtgccagaagctgaagttcttcaaggacaccgagatcgccaagatcaagatggaggccaagaagaagtacgagaaggagctgaccatgttccagaacgacttcgagaaggcctgccaggccaagagcgaggccctggtgctgagagagaagagcaccctggagagaatccacaagcaccaggagatcgagaccaaggagatctacgcccagagacagctgctgctgaaggacatggacctgctgagaggcagagaggccgagctgaagcagagagtggaggccttcgagctgtaccagctggagctgaaggacgactacatcatcagaaccaacagactgatcgaggacgagagaaagaacaaggagaaggccgtgcacctgcaggaggagctgatcgccatcaacagcaagaaggaggagctgaaccagagcgtgaacagagtgaaggagctggagctggagctggagagcgtgaaggcccagagcctggccatcaccaagcagaaccacatgctgaacgagaaggtgaaggagatgagcgactacagcctgctgaaggaggagaagctggagctgctggcccagaacaagctgctgaagcagcagctggaggagagcagaaacgagaacctgagactgctgaacagactggcccagcccgcccccgagctggccgtgttccagaaggagctgagaaaggccgagaaggccatcgtggtggagcacgaggagttcgagagctgcagacaggccctgcacaagcagctgcaggacgagatcgagcacagcgcccagctgaaggcccagatcctgggctacaaggccagcgtgaagagcctgaccacccaggtggccgacctgaagctgcagctgaagcagacccagaccgccctggagaacgaggtgtactgcaaccccaagcagagcgtgatcgacagaagcgtgaacggcctgatcaacggcaacgtggtgccctgcaacggcgagatcagcggcgacttcctgaacaaccccttcaagcaggagaacgtgctggccagaatggtggccagcagaatcaccaactaccccaccgcctgggtggagggcagcagccccgacagcgacctggagttcgtggccaacaccaaggccagagtgaaggagctgcagcaggaggccgagagactggagaaggccttcagaagctaccacagaagagtgatcaagaacagcgccaagagccccctggccgccaagagcccccccagcctgcacctgctggaggccttcaagaacatcaccagcagcagccccgagagacacatcttcggcgaggacagagtggtgagcgagcagccccaggtgggcaccctggaggagagaaacgacgtggtggaggccctgaccggcagcgccgccagcagactgagaggcggcaccagcagcagaagactgagcagcacccccctgcccaaggccaagagaagcctggagagcgagatgtacctggagggcctgggcagaagccacatcgccagccccagcccctgccccgacagaatgcccctgcccagccccaccgagagcagacacagcctgagcatcccccccgtgagcagcccccccgagcagaaggtgggcctgtacagaagacagaccgagctgcaggacaagagcgagttcagcgacgtggacaagctggccttcaaggacaacgaggagttcgagagcagcttcgagagcgccggcaacatgcccagacagctggagatgggcggcctgagccccgccggcgacatgagccacgtggacgccgccgccgccgccgtgcccctgagctaccagcaccccagcgtggaccagaagcagatcgaggagcagaaggaggaggagaagatcagagagcagcaggtgaaggagagaagacagagagaggagagaagacagagcaacctgcaggaggtgctggagagagagagaagagagctggagaagctgtaccaggagagaaagatgatcgaggagagcctgaagatcaagatcaagaaggagctggagatggagaacgagctggagatgagcaaccaggagatcaaggacaagagcgcccacagcgagaaccccctggagaagtacatgaagatcatccagcaggagcaggaccaggagagcgccgacaagagcagcaagaagatggtgcaggagggcagcctggtggacaccctgcagagcagcgacaaggtggagagcctgaccggcttcagccacgaggagctggacgacagctggtag

SEQ ID NO: 92000 - DNA, 2619 bp, Artificial Sequence
  Description of Artificial Sequence: Synthetic coding sequence
atgcacttcctgaaggagctggccgagtaccaccaggccaaggagagctgcaacatggagacccagaccagcagcaccttcaacagagacagcctggccgagaagctgcagctgatcgacgaccagttcgccgacgcctacccccagagaatcaagttcgagagcctggagatcaagctgaacgagtacaagagagagatcgaggagcagctgagagccgagatgtgccagaagctgaagttcttcaaggacaccgagatcgccaagatcaagatggaggccaagaagaagtacgagaaggagctgaccatgttccagaacgacttcgagaaggcctgccaggccaagagcgaggccctggtgctgagagagaagagcaccctggagagaatccacaagcaccaggagatcgagaccaaggagatctacgcccagagacagctgctgctgaaggacatggacctgctgagaggcagagaggccgagctgaagcagagagtggaggccttcgagctgaaccagaagctgcaggaggagaagcacaagagcatcaccgaggccctgagaagacaggagcagaacatcaagagcttcgaggagacctacgacagaaagctgaagaacgagctgctgaagtaccagctggagctgaaggacgactacatcatcagaaccaacagactgatcgaggacgagagaaagaacaaggagaaggccgtgcacctgcaggaggagctgatcgccatcaacagcaagaaggaggagctgaaccagagcgtgaacagagtgaaggagctggagctggagctggagagcgtgaaggcccagagcctggccatcaccaagcagaaccacatgctgaacgagaaggtgaaggagatgagcgactacagcctgctgaaggaggagaagctggagctgctggcccagaacaagctgctgaagcagcagctggaggagagcagaaacgagaacctgagactgctgaacagactggcccagcccgcccccgagctggccgtgttccagaaggagctgagaaaggccgagaaggccatcgtggtggagcacgaggagttcgagagctgcagacaggccctgcacaagcagctgcaggacgagatcgagcacagcgcccagctgaaggcccagatcctgggctacaaggccagcgtgaagagcctgaccacccaggtggccgacctgaagctgcagctgaagcagacccagaccgccctggagaacgaggtgtactgcaaccccaagcagagcgtgatcgacagaagcgtgaacggcctgatcaacggcaacgtggtgccctgcaacggcgagatcagcggcgacttcctgaacaaccccttcaagcaggagaacgtgctggccagaatggtggccagcagaatcaccaactaccccaccgcctgggtggagggcagcagccccgacagcgacctggagttcgtggccaacaccaaggccagagtgaaggagctgcagcaggaggccgagagactggagaaggccttcagaagctaccacagaagagtgatcaagaacagcgccaagagccccctggccgccaagagcccccccagcctgcacctgctggaggccttcaagaacatcaccagcagcagccccgagagacacatcttcggcgaggacagagtggtgagcgagcagccccaggtgggcaccctggaggagagaaacgacgtggtggaggccctgaccggcagcgccgccagcagactgagaggcggcaccagcagcagaagactgagcagcacccccctgcccaaggccaagagaagcctggagagcgagatgtacctggagggcctgggcagaagccacatcgccagccccagcccctgccccgacagaatgcccctgcccagccccaccgagagcagacacagcctgagcatcccccccgtgagcagcccccccgagcagaaggtgggcctgtacagaagacagaccgagctgcaggacaagagcgagttcagcgacgtggacaagctggccttcaaggacaacgaggagttcgagagcagcttcgagagcgccggcaacatgcccagacagctggagatgggcggcctgagccccgccggcgacatgagccacgtggacgccgccgccgccgccgtgcccctgagctaccagcaccccagcgtggaccagaagcagatcgaggagcagaaggaggaggagaagatcagagagcagcaggtgaaggagagaagacagagagaggagagaagacagagcaacctgcaggaggtgctggagagagagagaagagagctggagaagctgtaccaggagagaaagatgatcgaggagagcctgaagatcaagatcaagaaggagctggagatggagaacgagctggagatgagcaaccaggagatcaaggacaagagcgcccacagcgagaaccccctggagaagtacatgaagatcatccagcaggagcaggaccaggagagcgccgacaagagcagcaagaagatggtgcaggagggcagcctggtggacaccctgcagagcagcgacaaggtggagagcctgaccggcttcagccacgaggagctggacgacagctggtag

SEQ ID NO: 92001 - DNA, 1104 bp, Artificial Sequence
  Description of Artificial Sequence: Synthetic coding sequence
atgatggcccagagcaacatgttcaccgtggccgacgtgctgagccaggacgagctgagaaagaagctgtaccagaccttcaaggacagaggcatcctggacaccctgaagacccagctgagaaaccagctgatccacgagctgatgcaccccgtgctgagcggcgagctgcagcccagaagcatcagcgtggagggcagcagcctgctgatcggcgccagcaacagcctggtggccgaccacctgcagagatgcggctacgagtacagcctgagcgtgttcttccccgagagcggcctggccaaggagaaggtgttcaccatgcaggacctgctgcagctgatcaagatcaaccccaccagcagcctgtacaagagcctggtgagcggcagcgacaaggagaaccagaagggcttcctgatgcacttcctgaaggagctggccgagtaccaccaggccaaggagagctgcaacatggagacccagaccagcagcaccttcaacagagacagcctggccgagaagctgcagctgatcgacgaccagttcgccgacgcctacccccagagaatcaagttcgagagcctggagatcaagctgaacgagtacaagagagagatcgaggagcagctgagagccgagatgtgccagaagctgaagttcttcaaggacaccgagatcgccaagatcaagatggaggccaagaagaagtacgagaaggagctgaccatgttccagaacgacttcgagaaggcctgccaggccaagagcgaggccctggtgctgagagagaagagcaccctggagagaatccacaagcaccaggagatcgagaccaaggagatctacgcccagagacagctgctgctgaaggacatggacctgctgagaggcagagaggccgagctgaagcagagagtggaggccttcgagctgaaccagaagctgcaggaggagaagcacaagagcatcaccgaggccctgagaagacaggagcagaacatcaagagcttcgaggagacctacgacagaaagctgaagaacgagctgctgaacttccacagactgcacggcgtgtgcctggccctgggcatcctgatctag

SEQ ID NO: 92002 - DNA, 1017 bp, Artificial Sequence
  Description of Artificial Sequence: Synthetic coding sequence
atggtgttcctgtgcatcttcaaggagctggccgagtaccaccaggccaaggagagctgcaacatggagacccagaccagcagcaccttcaacagagacagcctggccgagaagctgcagctgatcgacgaccagttcgccgacgcctacccccagagaatcaagttcgagagcctggagatcaagctgaacgagtacaagagagagatcgaggagcagctgagagccgagatgtgccagaagctgaagttcttcaaggacaccgagatcgccaagatcaagatggaggccaagaagaagtacgagaaggagctgaccatgttccagaacgacttcgagaaggcctgccaggccaagagcgaggccctggtgctgagagagaagagcaccctggagagaatccacaagcaccaggagatcgagaccaaggagatctacgcccagagacagctgctgctgaaggacatggacctgctgagaggcagagaggccgagctgaagcagagagtggaggccttcgagctgtaccagctggagctgaaggacgactacatcatcagaaccaacagactgatcgaggacgagagaaagaacaaggagaaggccgtgcacctgcaggaggagctgatcgccatcaacagcaagaaggaggagctgaaccagagcgtgaacagagtgaaggagctggagctggagctggagagcgtgaaggcccagagcctggccatcaccaagcagaaccacatgctgaacgagaaggtgaaggagatgagcgactacagcctgctgaaggaggagaagctggagctgctggcccagaacaagctgctgaagcagcagctggaggagagcagaaacgagaacctgagactgctgaacagactggcccagcccgcccccgagctggccgtgttccagaaggagctgagaaaggccgagaaggccatcgtggtggagcacgaggagttcgagagctgcagacaggccctgcacaagcagctgcaggacgagccctag

SEQ ID NO: 92003 - DNA, 2586 bp, Artificial Sequence
  Description of Artificial Sequence: Synthetic coding sequence
atggcccactaccccaccagactgaagaccagaaagacctacagctgggtgggcagacccctgctggacagaaagctgcactaccagacctacagagagatgtgcgtgaagaccgagggctgcagcaccgagatccacatccagatcggccagttcgtgctgatcgagggcgacgacgacgagaacccctacgtggccaagctgctggagctgttcgaggacgacagcgaccccccccccaagaagagagccagagtgcagtggttcgtgagattctgcgaggtgcccgcctgcaagagacacctgctgggcagaaagcccggcgcccaggagatcttctggtacgactaccccgcctgcgacagcaacatcaacgccgagaccatcatcggcctggtgagagtgatccccctggcccccaaggacgtggtgcccaccaacctgaagaacgagaagaccctgttcgtgaagctgagctggaacgagaagaagttcagacccctgagcagcgagctgttcgccgagctgaacaagccccaggagagcgccgccaagtgccagaagcccgtgagagccaagagcaagagcgccgagagccccagctggacccccgccgagcacgtggccaagagaatcgagagcagacacagcgccagcaagagcagacagacccccacccaccccctgacccccagagccagaaagagactggagctgggcaacctgggcaacccccagatgagccagcagaccagctgcgccagcctggacagccccggcagaatcaagagaaaggtggccttcagcgagatcaccagccccagcaagagaagccagcccgacaagctgcagaccctgagccccgccctgaaggcccccgagaagaccagagagaccggcctgagctacaccgaggacgacaagaaggccagccccgagcacagaatcatcctgagaaccagaatcgccgccagcaagaccatcgacatcagagaggagagaaccctgacccccatcagcggcggccagagaagcagcgtggtgcccagcgtgatcctgaagcccgagaacatcaagaagagagacgccaaggaggccaaggcccagaacgaggccaccagcaccccccacagaatcagaagaaagagcagcgtgctgaccatgaacagaatcagacagcagctgagattcctgggcaacagcaagagcgaccaggaggagaaggagatcctgcccgccgccgagatcagcgacagcagcagcgacgaggaggaggccagcaccccccccctgcccagaagagcccccagaaccgtgagcagaaacctgagaagcagcctgaagagcagcctgcacaccctgaccaaggtgcccaagaagagcctgaagcccagaacccccagatgcgccgccccccagatcagaagcagaagcctggccgcccaggagcccgccagcgtgctggaggaggccagactgagactgcacgtgagcgccgtgcccgagagcctgccctgcagagagcaggagttccaggacatctacaacttcgtggagagcaagctgctggaccacaccggcggctgcatgtacatcagcggcgtgcccggcaccggcaagaccgccaccgtgcacgaggtgatcagatgcctgcagcaggccgcccaggccaacgacgtgccccccttccagtacatcgaggtgaacggcatgaagctgaccgagccccaccaggtgtacgtgcagatcctgcagaagctgaccggccagaaggccaccgccaaccacgccgccgagctgctggccaagcagttctgcaccagaggcagcccccaggagaccaccgtgctgctggtggacgagctggacctgctgtggacccacaagcaggacatcatgtacaacctgttcgactggcccacccacaaggaggccagactggtggtgctggccatcgccaacaccatggacctgcccgagagaatcatgatgaacagagtgagcagcagactgggcctgaccagaatgtgcttccagccctacacctacagccagctgcagcagatcctgagaagcagactgaagcacctgaaggccttcgaggacgacgccatccagctggtggccagaaaggtggccgccctgagcggcgacgccagaagatgcctggacatctgcagaagagccaccgagatctgcgagttcagccagcagaagcccgacagccccggcctggtgaccatcgcccacagcatggaggccgtggacgagatgttcagcagcagctacatcaccgccatcaagaacagcagcgtgctggagcagagcttcctgagagccatcctggccgagttcagaagaagcggcctggaggaggccaccttccagcagatctacagccagcacgtggccctgtgcagaatggagggcctgccctaccccaccatgagcgagaccatggccgtgtgcagccacctgggcagctgcagactgctgctggtggagcccagcagaaacgacctgctgctgagagtgagactgaacgtgagccaggacgacgtgctgtacgccctgaaggacgagtag

SEQ ID NO: 92004 - DNA, 2586 bp, Artificial Sequence; identical to SEQ ID NO: 92003
  Description of Artificial Sequence: Synthetic coding sequence

SEQ ID NO: 92005 - DNA, 1599 bp, Artificial Sequence
  Description of Artificial Sequence: Synthetic coding sequence
atggagaagagcaacgagaccaacggctacctggacagcgcccaggccggccccgccgccggccccggcgcccccggcaccgccgccggcagagccagaagatgcgccggcttcctgagaagacaggccctggtgctgctgaccgtgagcggcgtgctggccggcgccggcctgggcgccgccctgagaggcctgagcctgagcagaacccaggtgacctacctggccttccccggcgagatgctgctgagaatgctgagaatgatcatcctgcccctggtggtgtgcagcctggtgagcggcgccgccagcctggacgccagctgcctgggcagactgggcggcatcgccgtggcctacttcggcctgaccaccctgagcgccagcgccctggccgtggccctggccttcatcatcaagcccggcagcggcgcccagaccctgcagagcagcgacctgggcctggaggacagcggccccccccccgtgcccaaggagaccgtggacagcttcctggacctggccagaaacctgttccccagcaacctggtggtggccgccttcagaacctacgccaccgactacaaggtggtgacccagaacagcagcagcggcaacgtgacccacgagaagatccccatcggcaccgagatcgagggcatgaacatcctgggcctggtgctgttcgccctggtgctgggcgtggccctgaagaagctgggcagcgagggcgaggacctgatcagattcttcaacagcctgaacgaggccaccatggtgctggtgagctggatcatgtggtacgtgcccgtgggcatcatgttcctggtgggcagcaagatcgtggagatgaaggacatcatcgtgctggtgaccagcctgggcaagtacatcttcgccagcatcctgggccacgtgatccacggcggcatcgtgctgcccctgatctacttcgtgttcaccagaaagaaccccttcagattcctgctgggcctgctggcccccttcgccaccgccttcgccacctgcagcagcagcgccaccctgcccagcatgatgaagtgcatcgaggagaacaacggcgtggacaagagaatcagcagattcatcctgcccatcggcgccaccgtgaacatggacggcgccgccatcttccagtgcgtggccgccgtgttcatcgcccagctgaacaacgtggagctgaacgccggccagatcttcaccatcctggtgaccgccaccgccagcagcgtgggcgccgccggcgtgcccgccggcggcgtgctgaccatcgccatcatcctggaggccatcggcctgcccacccacgacctgcccctgatcctggccgtggactggatcgtggacagaaccaccaccgtggtgaacgtggagggcgacgccctgggcgccggcatcctgcaccacctgaaccagaaggccaccaagaagggcgagcaggagctggccgaggtgaaggtggaggccatccccaactgcaagagcgaggaggagaccagccccctggtgacccaccagaaccccgccggccccgtggccagcgcccccgagctggagagcaaggagagcgtgctgtag

SEQ ID NO: 92006 - DNA, 330 bp, Artificial Sequence
  Description of Artificial Sequence: Synthetic coding sequence
atgagcaagcccgagctgaaggaggacaagatgctggaggtgcacttcgtgggcgacgacgacgtgctgaaccacatcctggacagagagggcggcgccaagctgaagaaggagagagcccagctgctggtgaaccccaagaagatcatcaagaagcccgagtacgacctggaggaggacgaccaggaggtgctgaaggaccagaactacgtggagatcatgggcagagacgtgcaggagagcctgaagaacggcagcgccaccggcggcggcaacaaggtgtacagcttccagaacagaaagcacagcgagaagatggccaagctgtag

SEQ ID NO: 92007 - DNA, 219 bp, Artificial Sequence
  Description of Artificial Sequence: Synthetic coding sequence
atgagcaagcccgagctgaaggaggacaagatgctggaggtgcacttcgtgggcgacgacgacgtgctgaaccacatcctggacagagagggcggcgccaagctgaagaaggagagagcccagctgctggtgaaccccaagaagatcatcaagaagcccgagtacgacctggaggaggacgaccaggaggtgctgaaggaccagaactacgtggagtag

SEQ ID NO: 92008 - DNA, 2139 bp, Artificial Sequence
  Description of Artificial Sequence: Synthetic coding sequence
atggccaccagcagcatgagcaagggctgcttcgtgttcaagcccaacagcaagaagagaaagatcagcctgcccatcgaggactacttcaacaagggcaagaacgagcccgaggacagcaagctgagattcgagacctaccagctgatctggcagcagatgaagagcgagaacgagagactgcaggaggagctgaacaagaacctgttcgacaacctgatcgagttcctgcagaagagccacagcggcttccagaagaacagcagagacctgggcggccagatcaagctgagagagatccccaccgccgccctggtgctgggcgtgaacgtgaccgaccacgacctgaccttcggcagcctgaccgaggccctgcagaacaacgtgaccccctacgtggtgagcctgcaggccaaggactgccccgacatgaagcacttcctgcagaagctgatcagccagctgatggactgctgcgtggacatcaagagcaaggaggaggagagcgtgcacgtgacccagagaaagacccactacagcatggacagcctgagcagctggtacatgaccgtgacccagaagaccgaccccaagatgctgagcaagaagagaaccaccagcagccagtggcagagcccccccgtggtggtgatcctgaaggacatggagagcttcgccaccaaggtgctgcaggacttcatcatcatcagcagccagcacctgcacgagttccccctgatcctgatcttcggcatcgccaccagccccatcatcatccacagactgctgccccacgccgtgagcagcctgctgtgcatcgagctgttccagagcctgagctgcaaggagcacctgaccaccgtgctggacaagctgctgctgaccacccagttccccttcaagatcaacgagaaggtgctgcaggtgctgaccaacatcttcctgtaccacgacttcagcgtgcagaacttcatcaagggcctgcagctgagcctgctggagcacttctacagccagcccctgagcgtgctgtgctgcaacctgcccgaggccaagagaagaatcaacttcctgagcaacaaccagtgcgagaacatcagaagactgcccagcttcagaagatacgtggagaagcaggccagcgagaagcaggtggccctgctgaccaacgagagatacctgaaggaggagacccagctgctgctggagaacctgcacgtgtaccacatgaactacttcctggtgctgagatgcctgcacaagttcaccagcagcctgcccaagtaccccctgggcagacagatcagagagctgtactgcacctgcctggagaagaacatctgggacagcgaggagtacgccagcgtgctgcagctgctgagaatgctggccaaggacgagctgatgaccatcctggagaagtgcttcaaggtgttcaagagctactgcgagaaccacctgggcagcaccgccaagagaatcgaggagttcctggcccagttccagagcctggacgccgagaccaaggaggaggaggacgccagcggcagccagcccaagggcctgcagaagaccgacctgtaccacctgcagaagagcctgctggagatgaaggagctgagaagaagcaagaagcagaccaagttcgaggtgctgagagagaacgtggtgaacttcatcgactgcctggtgagagagtacctgctgccccccgagacccagcccctgcacgaggtggtgtacttcagcgccgcccacgccctgagagagcacctgaacgccgcccccagaatcgccctgcacaccgccctgaacaacccctactactacctgaagaacgaggccctgaagagcgaggagggctgcatccccaacatcgcccccgacatctgcatcgcctacaagctgcacctggagtgcagcagactgatcaacctggtggactggagcgaggccttcgccaccgtggtgaccgccgccgagaagatggacgccaacagcgccaccagcgaggagatgaacgagatcatccacgccagattcatcagagccgtgagcgagctggagctgctgggcttcatcaagcccaccaagcagaagaccgaccacgtggccagactgacctggggcggctgctag

SEQ ID NO: 92009 - DNA, 2136 bp, Artificial Sequence
  Description of Artificial Sequence: Synthetic coding sequence
atggccaccagcagcatgagcaagggctgcttcgtgttcaagcccaacagcaagaagagaaagatcagcctgcccatcgaggactacttcaacaagggcaagaacgagcccgaggacagcaagctgagattcgagacctaccagctgatctggcagcagatgaagagcgagaacgagagactgcaggaggagctgaacaagaacctgttcgacaacctgatcgagttcctgcagaagagccacagcggcttccagaagaacagcagagacctgggcggccagatcaagctgagagagatccccaccgccgccctggtgctgggcgtgaacgtgaccgaccacgacctgaccttcggcagcctgaccgaggccctgcagaacaacgtgaccccctacgtggtgagcctgcaggccaaggactgccccgacatgaagcacttcctgcagaagctgatcagccagctgatggactgctgcgtggacatcaagagcaaggaggaggagagcgtgcacgtgacccagagaaagacccactacagcatggacagcctgagcagctggtacatgaccgtgacccagaagaccgaccccaagatgctgagcaagaagagaaccaccagcagccagtggcagagcccccccgtggtggtgatcctgaaggacatggagagcttcgccaccaaggtgctgcaggacttcatcatcatcagcagccagcacctgcacgagttccccctgatcctgatcttcggcatcgccaccagccccatcatcatccacagactgctgccccacgccgtgagcagcctgctgtgcatcgagctgttccagagcctgagctgcaaggagcacctgaccaccgtgctggacaagctgctgctgaccacccagttccccttcaagatcaacgagaaggtgctgcaggtgctgaccaacatcttcctgtaccacgacttcagcgtgcagaacttcatcaagggcctgcagctgagcctgctggagcacttctacagccagcccctgagcgtgctgtgctgcaacctgcccgaggccaagagaagaatcaacttcctgagcaacaaccagtgcgagaacatcagaagactgcccagcttcagaagatacgtggagaagcaggccagcgagaagcaggtggccctgctgaccaacgagagatacctgaaggaggagacccagctgctgctggagaacctgcacgtgtaccacatgaactacttcctggtgctgagatgcctgcacaagttcaccagcagcctgcccaagtaccccctgggcagacagatcagagagctgtactgcacctgcctggagaagaacatctgggacagcgaggagtacgccagcgtgctgcagctgctgagaatgctggccaaggacgagctgatgaccatcctggagaagtgcttcaaggtgttcaagagctactgcgagaaccacctgggcagcaccgccaagagaatcgaggagttcctggcccagttccagagcctggacgagaccaaggaggaggaggacgccagcggcagccagcccaagggcctgcagaagaccgacctgtaccacctgcagaagagcctgctggagatgaaggagctgagaagaagcaagaagcagaccaagttcgaggtgctgagagagaacgtggtgaacttcatcgactgcctggtgagagagtacctgctgccccccgagacccagcccctgcacgaggtggtgtacttcagcgccgcccacgccctgagagagcacctgaacgccgcccccagaatcgccctgcacaccgccctgaacaacccctactactacctgaagaacgaggccctgaagagcgaggagggctgcatccccaacatcgcccccgacatctgcatcgcctacaagctgcacctggagtgcagcagactgatcaacctggtggactggagcgaggccttcgccaccgtggtgaccgccgccgagaagatggacgccaacagcgccaccagcgaggagatgaacgagatcatccacgccagattcatcagagccgtgagcgagctggagctgctgggcttcatcaagcccaccaagcagaagaccgaccacgtggccagactgacctggggcggctgctag

SEQ ID NO: 92010 - DNA, 1335 bp, Artificial Sequence
  Description of Artificial Sequence: Synthetic coding sequence
atgaagagcgagaacgagagactgcaggaggagctgaacaagaacctgttcgacaacctgatcgagttcctgcagaagagccacagcggcttccagaagaacagcagagacctgggcggccagatcaagctgagagagatccccaccgccgccctggtgctgggcgtgaacgtgaccgaccacgacctgaccttcggcagcctgaccgaggccctgcagaacaacgtgaccccctacgtggtgagcctgcaggccaaggactgccccgacatgaagcacttcctgcagaagctgatcagccagctgatggactgctgcgtggacatcaagagcaaggaggaggagagcgtgcacgtgacccagagaaagacccactacagcatggacagcctgagcagctggtacatgaccgtgacccagaagaccgaccccaagatgctgagcaagaagagaaccaccagcagccagtggcagagcccccccgtggtggtgatcctgaaggacatggagagcttcgccaccaaggtgctgcaggacttcatcatcatcagcagccagcacctgcacgagttccccctgatcctgatcttcggcatcgccaccagccccatcatcatccacagactgctgccccacgccgtgagcagcctgctgtgcatcgagctgttccagagcctgagctgcaaggagcacctgaccaccgtgctggacaagctgctgctgaccacccagttccccttcaagatcaacgagaaggtgctgcaggtgctgaccaacatcttcctgtaccacgacttcagcgtgcagaacttcatcaagggcctgcagctgagcctgctggagcacttctacagccagcccctgagcgtgctgtgctgcaacctgcccgaggccaagagaagaatcaacttcctgagcaacaaccagtgcgagaacatcagaagactgcccagcttcagaagatacgtggagaagcaggccagcgagaagcaggtggccctgctgaccaacgagagatacctgaaggaggagacccagctgctgctggagaacctgcacgtgtaccacatgaactacttcctggtgctgagatgcctgcacaagttcaccagcagcctgcccaagtaccccctgggcagacagatcagagagctgtactgcacctgcctggagaagaacatctgggacagcgaggagtacgccagcgtgctgcagctgctgagactgggcctggccttcctggacatccagctgttcggcgcccagagcggccaggagctgctgctgcccctgagctgggaggccaaccccagccacgccgccaacctgggctag

SEQ ID NO: 92011 - DNA, 1707 bp, Artificial Sequence
  Description of Artificial Sequence: Synthetic coding sequence
atgaagcacttcctgcagaagctgatcagccagctgatggactgctgcgtggacatcaagagcaaggaggaggagagcgtgcacgtgacccagagaaagacccactacagcatggacagcctgagcagctggtacatgaccgtgacccagaagaccgaccccaagatgctgagcaagaagagaaccaccagcagccagtggcagagcccccccgtggtggtgatcctgaaggacatggagagcttcgccaccaaggtgctgcaggacttcatcatcatcagcagccagcacctgcacgagttccccctgatcctgatcttcggcatcgccaccagccccatcatcatccacagactgctgccccacgccgtgagcagcctgctgtgcatcgagctgttccagagcctgagctgcaaggagcacctgaccaccgtgctggacaagctgctgctgaccacccagttccccttcaagatcaacgagaaggtgctgcaggtgctgaccaacatcttcctgtaccacgacttcagcgtgcagaacttcatcaagggcctgcagctgagcctgctggagcacttctacagccagcccctgagcgtgctgtgctgcaacctgcccgaggccaagagaagaatcaacttcctgagcaacaaccagtgcgagaacatcagaagactgcccagcttcagaagatacgtggagaagcaggccagcgagaagcaggtggccctgctgaccaacgagagatacctgaaggaggagacccagctgctgctggagaacctgcacgtgtaccacatgaactacttcctggtgctgagatgcctgcacaagttcaccagcagcctgcccaagtaccccctgggcagacagatcagagagctgtactgcacctgcctggagaagaacatctgggacagcgaggagtacgccagcgtgctgcagctgctgagaatgctggccaaggacgagctgatgaccatcctggagaagtgcttcaaggtgttcaagagctactgcgagaaccacctgggcagcaccgccaagagaatcgaggagttcctggcccagttccagagcctggacgagaccaaggaggaggaggacgccagcggcagccagcccaagggcctgcagaagaccgacctgtaccacctgcagaagagcctgctggagatgaaggagctgagaagaagcaagaagcagaccaagttcgaggtgctgagagagaacgtggtgaacttcatcgactgcctggtgagagagtacctgctgccccccgagacccagcccctgcacgaggtggtgtacttcagcgccgcccacgccctgagagagcacctgaacgccgcccccagaatcgccctgcacaccgccctgaacaacccctactactacctgaagaacgaggccctgaagagcgaggagggctgcatccccaacatcgcccccgacatctgcatcgcctacaagctgcacctggagtgcagcagactgatcaacctggtggactggagcgaggccttcgccaccgtggtgaccgccgccgagaagatggacgccaacagcgccaccagcgaggagatgaacgagatcatccacgccagattcatcagagccgtgagcgagctggagctgctgggcttcatcaagcccaccaagcagaagaccgaccacgtggccagactgacctggggcggctgctag

SEQ ID NO: 92012 - DNA, 1311 bp, Artificial Sequence
  Description of Artificial Sequence: Synthetic coding sequence
atgagcagcagaaagagcaagagcaacagcctgatccacaccgagtgcctgagccaggtgcagagaatcctgagagagagattctgcagacagagcccccacagcaacctgttcggcgtgcaggtgcagtacaagcacctgagcgagctgctgaagagaaccgccctgcacggcgagagcaacagcgtgctgatcatcggccccagaggcagcggcaagaccatgctgatcaaccacgccctgaaggagctgatggagatcgaggaggtgagcgagaacgtgctgcaggtgcacctgaacggcctgctgcagatcaacgacaagatcgccctgaaggagatcaccagacagctgaacctggagaacgtggtgggcgacaaggtgttcggcagcttcgccgagaacctgagcttcctgctggaggccctgaagaagggcgacagaaccagcagctgccccgtgatcttcatcctggacgagttcgacctgttcgcccaccacaagaaccagaccctgctgtacaacctgttcgacatcagccagagcgcccagacccccatcgccgtgatcggcctgacctgcagactggacatcctggagctgctggagaagagagtgaagagcagattcagccacagacagatccacctgatgaacagcttcggcttcccccagtacgtgaagatcttcaaggagcagctgagcctgcccgccgagttccccgacaaggtgttcgccgagaagtggaacgagaacgtgcagtacctgagcgaggacagaagcgtgcaggaggtgctgcagaagcacttcaacatcagcaagaacctgagaagcctgcacatgctgctgatgctggccctgaacagagtgaccgccagccaccccttcatgaccgccgtggacctgatggaggccagccagctgtgcagcatggacagcaaggccaacatcgtgcacggcctgagcgtgctggagatctgcctgatcatcgccatgaagcacctgaacgacatctacgaggaggagcccttcaacttccagatggtgtacaacgagttccagaagttcgtgcagagaaaggcccacagcgtgtacaacttcgagaagcccgtggtgatgaaggccttcgagcacctgcagcagctggagctgatcaagcccatggagagaaccagcggcaacagccagagagagtaccagctgatgaagctgctgctggacaacacccagatcatgaacgccctgcagaagtaccccaactgccccaccgacgtgagacagtgggccaccagcagcctgagctggctgtag

SEQ ID NO: 92013 - DNA, 1311 bp, Artificial Sequence; identical to SEQ ID NO: 92012
  Description of Artificial Sequence: Synthetic coding sequence

SEQ ID NO: 92014 - DNA, 1311 bp, Artificial Sequence; identical to SEQ ID NO: 92012
  Description of Artificial Sequence: Synthetic coding sequence

SEQ ID NO: 92015 - DNA, 438 bp, Artificial Sequence
  Description of Artificial Sequence: Synthetic coding sequence
atgagcagcagaaagagcaagagcaacagcctgatccacaccgagtgcctgagccaggtgcagagaatcctgagagagagattctgcagacagagcccccacagcaacctgttcggcgtgcaggtgcagtacaagcacctgagcgagctgctgaagagaaccgccctgcacggcgagagcaacagcgtgctgatcatcggccccagaggcagcggcaagaccatgctgatcaaccacgccctgaaggagctgatggagatcgaggaggtgagcgagaacgtgctgcaggtgcacctgaacggcctgctgcagatcaacgacaagatcgccctgaaggagatcaccagacagctgaacctggagaacgtggtgggcgacaaggtgttcggcagcttcgccgagaacctgagcttcctgctggaggccctgaagaagtag

SEQ ID NO: 92016 - DNA, 384 bp, Artificial Sequence
  Description of Artificial Sequence: Synthetic coding sequence
atgagcagcagaaagagcaagagcaacagcctgatccacaccgagtgcctgagccaggtgcagagaatcctgagagagagattctgcagacagagcccccacagcaacctgttcggcgtgcaggtgcagtacaagcacctgagcgagctgctgaagagaaccgccctgcacggcgagagcaacagcgtgctgatcatcggccccagaggcagcggcaagaccatgctgatcaaccacgccctgaaggagctgatggagatcgaggaggtgagcgagaacgtgctgcaggtgcacctgaacggcctgctgcagatcaacgacaagatcgccctgaaggagatcaccagacagctgaacctggagaacgtggtgggcgacaagtag

SEQ ID NO: 92017 - DNA, 387 bp, Artificial Sequence
  Description of Artificial Sequence: Synthetic coding sequence
atgagcagcagaaagagcaagagcaacagcctgatccacaccgagtgcctgagccaggtgcagagaatcctgagagagagattctgcagacagagcccccacagcaacctgttcggcgtgcaggtgcagtacaagcacctgagcgagctgctgaagagaaccgccctgcacggcgagagcaacagcgtgctgatcatcggccccagaggcagcggcaagaccatgctgatcaaccacgccctgaaggagctgatggagatcgaggaggtgagcgagaacgtgctgcaggtgcacctgaacggcctgctgcagatcaacgacaagatcgccctgaaggagatcaccagacagctgaacctggagaacgtggtgggcgacaaggtgtag

SEQ ID NO: 92018 - DNA, 1311 bp, Artificial Sequence; identical to SEQ ID NO: 92012
  Description of Artificial Sequence: Synthetic coding sequence

SEQ ID NO: 92019 - DNA, 1059 bp, Artificial Sequence
  Description of Artificial Sequence: Synthetic coding sequence
atggagatcgaggaggtgagcgagaacgtgctgcaggtgcacctgaacggcctgctgcagatcaacgacaagatcgccctgaaggagatcaccagacagctgaacctggagaacgtggtgggcgacaaggtgttcggcagcttcgccgagaacctgagcttcctgctggaggccctgaagaagggcgacagaaccagcagctgccccgtgatcttcatcctggacgagttcgacctgttcgcccaccacaagaaccagaccctgctgtacaacctgttcgacatcagccagagcgcccagacccccatcgccgtgatcggcctgacctgcagactggacatcctggagctgctggagaagagagtgaagagcagattcagccacagacagatccacctgatgaacagcttcggcttcccccagtacgtgaagatcttcaaggagcagctgagcctgcccgccgagttccccgacaaggtgttcgccgagaagtggaacgagaacgtgcagtacctgagcgaggacagaagcgtgcaggaggtgctgcagaagcacttcaacatcagcaagaacctgagaagcctgcacatgctgctgatgctggccctgaacagagtgaccgccagccaccccttcatgaccgccgtggacctgatggaggccagccagctgtgcagcatggacagcaaggccaacatcgtgcacggcctgagcgtgctggagatctgcctgatcatcgccatgaagcacctgaacgacatctacgaggaggagcccttcaacttccagatggtgtacaacgagttccagaagttcgtgcagagaaaggcccacagcgtgtacaacttcgagaagcccgtggtgatgaaggccttcgagcacctgcagcagctggagctgatcaagcccatggagagaaccagcggcaacagccagagagagtaccagctgatgaagctgctgctggacaacacccagatcatgaacgccctgcagaagtaccccaactgccccaccgacgtgagacagtgggccaccagcagcctgagctggctgtag

SEQ ID NO: 92020 - DNA, 1089 bp, Artificial Sequence
  Description of Artificial Sequence: Synthetic coding sequence
atgctgatcaaccacgccctgaaggagctgatggagatcgaggaggtgagcgagaacgtgctgcaggtgcacctgaacggcctgctgcagatcaacgacaagatcgccctgaaggagatcaccagacagctgaacctggagaacgtggtgggcgacaaggtgttcggcagcttcgccgagaacctgagcttcctgctggaggccctgaagaagggcgacagaaccagcagctgccccgtgatcttcatcctggacgagttcgacctgttcgcccaccacaagaaccagaccctgctgtacaacctgttcgacatcagccagagcgcccagacccccatcgccgtgatcggcctgacctgcagactggacatcctggagctgctggagaagagagtgaagagcagattcagccacagacagatccacctgatgaacagcttcggcttcccccagtacgtgaagatcttcaaggagcagctgagcctgcccgccgagttccccgacaaggtgttcgccgagaagtggaacgagaacgtgcagtacctgagcgaggacagaagcgtgcaggaggtgctgcagaagcacttcaacatcagcaagaacctgagaagcctgcacatgctgctgatgctggccctgaacagagtgaccgccagccaccccttcatgaccgccgtggacctgatggaggccagccagctgtgcagcatggacagcaaggccaacatcgtgcacggcctgagcgtgctggagatctgcctgatcatcgccatgaagcacctgaacgacatctacgaggaggagcccttcaacttccagatggtgtacaacgagttccagaagttcgtgcagagaaaggcccacagcgtgtacaacttcgagaagcccgtggtgatgaaggccttcgagcacctgcagcagctggagctgatcaagcccatggagagaaccagcggcaacagccagagagagtaccagctgatgaagctgctgctggacaacacccagatcatgaacgccctgcagaagtaccccaactgccccaccgacgtgagacagtgggccaccagcagcctgagctggctgtag

SEQ ID NO: 92021 - DNA, 660 bp, Artificial Sequence
  Description of Artificial Sequence: Synthetic coding sequence
atgaacagcttcggcttcccccagtacgtgaagatcttcaaggagcagctgagcctgcccgccgagttccccgacaaggtgttcgccgagaagtggaacgagaacgtgcagtacctgagcgaggacagaagcgtgcaggaggtgctgcagaagcacttcaacatcagcaagaacctgagaagcctgcacatgctgctgatgctggccctgaacagagtgaccgccagccaccccttcatgaccgccgtggacctgatggaggccagccagctgtgcagcatggacagcaaggccaacatcgtgcacggcctgagcgtgctggagatctgcctgatcatcgccatgaagcacctgaacgacatctacgaggaggagcccttcaacttccagatggtgtacaacgagttccagaagttcgtgcagagaaaggcccacagcgtgtacaacttcgagaagcccgtggtgatgaaggccttcgagcacctgcagcagctggagctgatcaagcccatggagagaaccagcggcaacagccagagagagtaccagctgatgaagctgctgctggacaacacccagatcatgaacgccctgcagaagtaccccaactgccccaccgacgtgagacagtgggccaccagcagcctgagctggctgtag

SEQ ID NO: 92022 - DNA, 1308 bp, Artificial Sequence
  Description of Artificial Sequence: Synthetic coding sequence
atgccccacctggagaacgtggtgctgtgcagagagagccaggtgagcatcctgcagagcctgttcggcgagagacaccacttcagcttccccagcatcttcatctacggccacaccgccagcggcaagacctacgtgacccagaccctgctgaagaccctggagctgccccacgtgttcgtgaactgcgtggagtgcttcaccctgagactgctgctggagcagatcctgaacaagctgaaccacctgagcagcagcgaggacggctgcagcaccgagatcacctgcgagaccttcaacgacttcgtgagactgttcaagcaggtgaccaccgccgagaacctgaaggaccagaccgtgtacatcgtgctggacaaggccgagtacctgagagacatggaggccaacctgctgcccggcttcctgagactgcaggagctggccgacagaaacgtgaccgtgctgttcctgagcgagatcgtgtgggagaagttcagacccaacaccggctgcttcgagcccttcgtgctgtacttccccgactacagcatcggcaacctgcagaagatcctgagccacgaccacccccccgagtacagcgccgacttctacgccgcctacatcaacatcctgctgggcgtgttctacaccgtgtgcagagacctgaaggagctgagacacctggccgtgctgaacttccccaagtactgcgagcccgtggtgaagggcgaggccagcgagagagacaccagaaagctgtggagaaacatcgagccccacctgaagaaggccatgcagaccgtgtacctgagagagatcagcagcagccagtgggagaagctgcagaaggacgacaccgaccccggccagctgaagggcctgagcgcccacacccacgtggagctgccctactacagcaagttcatcctgatcgccgcctacctggccagctacaaccccgccagaaccgacaagagattcttcctgaagcaccacggcaagatcaagaagaccaacttcctgaagaagcacgagaagaccagcaaccacctgctgggccccaagcccttccccctggacagactgctggccatcctgtacagcatcgtggacagcagagtggcccccaccgccaacatcttcagccagatcaccagcctggtgaccctgcagctgctgaccctggtgggccacgacgaccagctggacggccccaagtacaagtgcaccgtgagcctggacttcatcagagccatcgccagaaccgtgaacttcgacatcatcaagtacctgtacgacttcctgtag

SEQ ID NO: 92023 - DNA, 975 bp, Artificial Sequence
  Description of Artificial Sequence: Synthetic coding sequence
atgccccacctggagaacgtggtgctgtgcagagagagccaggtgagcatcctgcagagcctgttcggcgagagacaccacttcagcttccccagcatcttcatctacggccacaccgccagcggcaagacctacgtgacccagaccctgctgaagaccctggagctgccccacgtgttcgtgaactgcgtggagtgcttcaccctgagactgctgctggagcagatcctgaacaagctgaaccacctgagcagcagcgaggacggctgcagcaccgagatcacctgcgagaccttcaacgacttcgtgagactgttcaagcaggtgaccaccgccgagaacctgaaggaccagaccgtgtacatcgtgctggacaaggccgagtacctgagagacatggaggccaacctgctgcccggcttcctgagactgcaggagctggccgacagaaacgtgaccgtgctgttcctgagcgagatcgtgtgggagaagttcagacccaacaccggctgcttcgagcccttcgtgctgtacttccccgactacagcatcggcaacctgcagaagatcctgagccacgaccacccccccgagtacagcgccgacttctacgccgcctacatcaacatcctgctgggcgtgttctacaccgtgtgcagagacctgaaggagctgagacacctggccgtgctgaacttccccaagtactgcgagcccgtggtgaagggcgaggccagcgagagagacaccagaaagctgtggagaaacatcgagccccacctgaagaaggccatgcagaccgtgtacctgagagagatcagcagcagccagtgggagaagctgcagaaggacgacaccgaccccggccagctgaagggcatcagaggcagcatcgagaccgtgaccggcgacaccagcagcgccaactaccaggacaccaaggtgaacaccaaggagcacagcgtgagaaagtag

SEQ ID NO: 92024 - DNA, 912 bp, Artificial Sequence
  Description of Artificial Sequence: Synthetic coding sequence
atggaggccaacctgctgcccggcttcctgagactgcaggagctggccgacagaaacgtgaccgtgctgttcctgagcgagatcgtgtgggagaagttcagacccaacaccggctgcttcgagcccttcgtgctgtacttccccgactacagcatcggcaacctgcagaagatcctgagccacgaccacccccccgagtacagcgccgacttctacgccgcctacatcaacatcctgctgggcgtgttctacaccgtgtgcagagacctgaaggagctgagacacctggccgtgctgaacttccccaagtactgcgagcccgtggtgaagggcgaggccagcgagagagacaccagaaagctgtggagaaacatcgagccccacctgaagaaggccatgcagaccgtgtacctgagagagatcagcagcagccagtgggagaagctgcagaaggacgacaccgaccccggccagctgaagggcctgagcgcccacacccacgtggagctgccctactacagcaagttcatcctgatcgccgcctacctggccagctacaaccccgccagaaccgacaagagattcttcctgaagcaccacggcaagatcaagaagaccaacttcctgaagaagcacgagaagaccagcaaccacctgctgggccccaagcccttccccctggacagactgctggccatcctgtacagcatcgtggacagcagagtggcccccaccgccaacatcttcagccagatcaccagcctggtgaccctgcagctgctgaccctggtgggccacgacgaccagctggacggccccaagtacaagtgcaccgtgagcctggacttcatcagagccatcgccagaaccgtgaacttcgacatcatcaagtacctgtacgacttcctgtag

SEQ ID NO: 92025 - DNA, 1665 bp, Artificial Sequence
  Description of Artificial Sequence: Synthetic coding sequence
atgagcgccgacggcggcggcatccaggacacccaggacaaggagaccccccccgaggtgcccgacagaggccacccccaccaggagatgcccagcaagctgggcgaggccgtgcccagcggcgacacccaggagagcctgcacatcaagatggagcccgaggagccccacagcgagggcgccagccaggaggacggcgcccagggcgcctggggctgggcccccctgagccacggcagcaaggagaaggccctgttcctgcccggcggcgccctgcccagccccagaatccccgtgctgagcagagagggcagaaccagagacagacagatggccgccgccctgctgaccgcctggagccagatgcccgtgaccttcgaggacgtggccctgtacctgagcagagaggagtggggcagactggaccacacccagcagaacttctacagagacgtgctgcagaagaagaacggcctgagcctgggcttccccttcagcagacccttctgggccccccaggcccacggcaagggcgaggccagcggcagcagcagacaggccggcgacgagaaggagtggagaggcgcctgcaccggcgccgtggaggtgggccagagagtgcagaccagcagcgtggccgccctgggcaacgtgaagcccttcagaaccagagccggcagagtgcagtggggcgtgccccagtgcgcccaggaggccgcctgcggcagaagcagcggccccgccaaggacagcggccagcccgccgagcccgacagaacccccgacgccgccccccccgaccccagccccaccgagccccaggagtacagagtgcccgagaagcccaacgaggaggagaagggcgcccccgagagcggcgaggagggcctggcccccgacagcgaggtgggcagaaagagctacagatgcgagcagtgcggcaagggcttcagctggcacagccacctggtgacccacagaagaacccacaccggcgagaagccctacgcctgcaccgactgcggcaagagattcggcagaagcagccacctgatccagcaccagatcatccacaccggcgagaagccctacacctgccccgcctgcagaaagagcttcagccaccacagcaccctgatccagcaccagagaatccacaccggcgagaagccctacgtgtgcgacagatgcgccaagagattcaccagaagaagcgacctggtgacccaccagggcacccacaccggcgccaagccccacaagtgccccatctgcgccaagtgcttcacccagagcagcgccctggtgacccaccagagaacccacaccggcgtgaagccctacccctgccccgagtgcggcaagtgcttcagccagagaagcaacctgatcgcccacaacagaacccacaccggcgagaagccctaccactgcctggactgcggcaagagcttcagccacagcagccacctgaccgcccaccagagaacccacagaggcgtgagaccctacgcctgccccctgtgcggcaagagcttcagcagaagaagcaacctgcacagacacgagaagatccacaccaccggccccaaggccctggccatgctgatgctgggcgccgccgccgccggcgccctggccacccccccccccgcccccacctag

SEQ ID NO: 92026 - DNA, 462 bp, Artificial Sequence
  Description of Artificial Sequence: Synthetic coding sequence
atgaacgtgggcgtggcccacagcgaggtgaaccccaacaccagagtgatgaacagcagaggcatgtggctgacctacgccctgggcgtgggcctgctgcacatcgtgctgctgagcatccccttcttcagcgtgcccgtggcctggaccctgaccaacatcatccacaacctgggcatgtacgtgttcctgcacgccgtgaagggcacccccttcgagacccccgaccagggcaaggccagactgctgacccactgggagcagctggactacggcgtgcagttcaccagcagcagaaagttcttcaccatcagccccatcatcctgtacttcctggccagcttctacaccaagtacgaccccacccacttcatcctgaacaccgccagcctgctgagcgtgctgatccccaagatgccccagctgcacggcgtgagaatcttcggcatcaacaagtactag

SEQ ID NO: 92027 - DNA, 462 bp, Artificial Sequence; identical to SEQ ID NO: 92026
  Description of Artificial Sequence: Synthetic coding sequence

SEQ ID NO: 92028 - DNA, 462 bp, Artificial Sequence; identical to SEQ ID NO: 92026
  Description of Artificial Sequence: Synthetic coding sequence

SEQ ID NO: 92029 - DNA, 330 bp, Artificial Sequence
  Description of Artificial Sequence: Synthetic coding sequence
atgaacgtgggcgtggcccacagcgaggtgaaccccaacaccagagtgatgaacagcagaggcatgtggctgacctacgccctgggcgtgggcctgctgcacatcgtgctgctgagcatccccttcttcagcgtgcccgtggcctggaccctgaccaacatcatccacaacctgggcatgtacgtgttcctgcacgccgtgaagggcacccccttcgagacccccgaccagggcaaggccagactgctgacccactgggagcagctggactacggcgtgcagttcaccagcagcagaaagttcttcaccatcagccccatcatcctgtag

SEQ ID NO: 92030 - DNA, 330 bp, Artificial Sequence; identical to SEQ ID NO: 92029
  Description of Artificial Sequence: Synthetic coding sequence

SEQ ID NO: 92031 - DNA, 462 bp, Artificial Sequence
  Description of Artificial Sequence: Synthetic coding sequence
atgaacgtgggcgtggcccacagcgaggtgaaccccaacaccagagtgatgaacagcagaggcatctggctggcctacatcatcctggtgggcctgctgcacatggtgctgctgagcatccccttcttcagcatccccgtggtgtggaccctgaccaacgtgatccacaacctggccacctacgtgttcctgcacaccgtgaagggcacccccttcgagacccccgaccagggcaaggccagactgctgacccactgggagcagatggactacggcctgcagttcaccagcagcagaaagttcctgagcatcagccccatcgtgctgtacctgctggccagcttctacaccaagtacgacgccgcccacttcctgatcaacaccgccagcctgctgagcgtgctgctgcccaagctgccccagttccacggcgtgagagtgttcggcatcaacaagtactag

SEQ ID NO: 92032 - DNA, 462 bp, Artificial Sequence; identical to SEQ ID NO: 92031
  Description of Artificial Sequence: Synthetic coding sequence

SEQ ID NO: 92033 - DNA, 462 bp, Artificial Sequence
  Description of Artificial Sequence: Synthetic coding sequence
atgaacgtgggcaccgcccacagcgaggtgaaccccaacaccagagtgatgaacagcagaggcatctggctgagctacgtgctggccatcggcctgctgcacatcgtgctgctgagcatccccttcgtgagcgtgcccgtggtgtggaccctgaccaacctgatccacaacatgggcatgtacatcttcctgcacaccgtgaagggcacccccttcgagacccccgaccagggcaaggccagactgctgacccactgggagcagatggactacggcgtgcagttcaccgccagcagaaagttcctgaccatcacccccatcgtgctgtacttcctgaccagcttctacaccaagtacgaccagatccacttcgtgctgaacaccgtgagcctgatgagcgtgctgatccccaagctgccccagctgcacggcgtgagaatcttcggcatcaacaagtactag

SEQ ID NO: 92034 - DNA, 462 bp, Artificial Sequence; identical to SEQ ID NO: 92033
  Description of Artificial Sequence: Synthetic coding sequence

SEQ ID NO: 92035 - DNA, 1320 bp, Artificial Sequence
  Description of Artificial Sequence: Synthetic coding sequence
atgttcagcaagctggcccacctgcagagattcgccgtgctgagcagaggcgtgcacagcagcgtggccagcgccaccagcgtggccaccaagaagaccgtgcagggcccccccaccagcgacgacatcttcgagagagagtacaagtacggcgcccacaactaccaccccctgcccgtggccctggagagaggcaagggcatctacctgtgggacgtggagggcagaaagtacttcgacttcctgagcagctacagcgccgtgaaccagggccactgccaccccaagatcgtgaacgccctgaagagccaggtggacaagctgaccctgaccagcagagccttctacaacaacgtgctgggcgagtacgaggagtacatcaccaagctgttcaactaccacaaggtgctgcccatgaacaccggcgtggaggccggcgagaccgcctgcaagctggccagaaagtggggctacaccgtgaagggcatccagaagtacaaggccaagatcgtgttcgccgccggcaacttctggggcagaaccctgagcgccatcagcagcagcaccgaccccaccagctacgacggcttcggccccttcatgcccggcttcgacatcatcccctacaacgacctgcccgccctggagagagccctgcaggaccccaacgtggccgccttcatggtggagcccatccagggcgaggccggcgtggtggtgcccgaccccggctacctgatgggcgtgagagagctgtgcaccagacaccaggtgctgttcatcgccgacgagatccagaccggcctggccagaaccggcagatggctggccgtggactacgagaacgtgagacccgacatcgtgctgctgggcaaggccctgagcggcggcctgtaccccgtgagcgccgtgctgtgcgacgacgacatcatgctgaccatcaagcccggcgagcacggcagcacctacggcggcaaccccctgggctgcagagtggccatcgccgccctggaggtgctggaggaggagaacctggccgagaacgccgacaagctgggcatcatcctgagaaacgagctgatgaagctgcccagcgacgtggtgaccgccgtgagaggcaagggcctgctgaacgccatcgtgatcaaggagaccaaggactgggacgcctggaaggtgtgcctgagactgagagacaacggcctgctggccaagcccacccacggcgacatcatcagattcgccccccccctggtgatcaaggaggacgagctgagagagagcatcgagatcatcaacaagaccatcctgagcttctag

SEQ ID NO: 92036 - DNA, 906 bp, Artificial Sequence
  Description of Artificial Sequence: Synthetic coding sequence
atgaacaccggcgtggaggccggcgagaccgcctgcaagctggccagaaagtggggctacaccgtgaagggcatccagaagtacaaggccaagatcgtgttcgccgccggcaacttctggggcagaaccctgagcgccatcagcagcagcaccgaccccaccagctacgacggcttcggccccttcatgcccggcttcgacatcatcccctacaacgacctgcccgccctggagagagccctgcaggaccccaacgtggccgccttcatggtggagcccatccagggcgaggccggcgtggtggtgcccgaccccggctacctgatgggcgtgagagagctgtgcaccagacaccaggtgctgttcatcgccgacgagatccagaccggcctggccagaaccggcagatggctggccgtggactacgagaacgtgagacccgacatcgtgctgctgggcaaggccctgagcggcggcctgtaccccgtgagcgccgtgctgtgcgacgacgacatcatgctgaccatcaagcccggcgagcacggcagcacctacggcggcaaccccctgggctgcagagtggccatcgccgccctggaggtgctggaggaggagaacctggccgagaacgccgacaagctgggcatcatcctgagaaacgagctgatgaagctgcccagcgacgtggtgaccgccgtgagaggcaagggcctgctgaacgccatcgtgatcaaggagaccaaggactgggacgcctggaaggtgtgcctgagactgagagacaacggcctgctggccaagcccacccacggcgacatcatcagattcgccccccccctggtgatcaaggaggacgagctgagagagagcatcgagatcatcaacaagaccatcctgagcttctag

SEQ ID NO: 92037 - DNA, 405 bp, Artificial Sequence; identical to SEQ ID NO: 85151
  Description of Artificial Sequence: Synthetic coding sequence

SEQ ID NO: 92038 - DNA, 1386 bp, Artificial Sequence
  Description of Artificial Sequence: Synthetic coding sequence
atgaacaacttcggcaacgaggagttcgactgccacttcctggacgagggcttcaccgccaaggacatcctggaccagaagatcaacgaggtgagcagcagcgacgacaaggacgccttctacgtggccgacctgggcgacatcctgaagaagcacctgagatggctgaaggccctgcccagagtgacccccttctacgccgtgaagtgcaacgacagcaaggccatcgtgaagaccctggccgccaccggcaccggcttcgactgcgccagcaagaccgagatccagctggtgcagagcctgggcgtgccccccgagagaatcatctacgccaacccctgcaagcaggtgagccagatcaagtacgccgccaacaacggcgtgcagatgatgaccttcgacagcgaggtggagctgatgaaggtggccagagcccaccccaaggccaagctggtgctgagaatcgccaccgacgacagcaaggccgtgtgcagactgagcgtgaagttcggcgccaccctgagaaccagcagactgctgctggagagagccaaggagctgaacatcgacgtggtgggcgtgagcttccacgtgggcagcggctgcaccgaccccgagaccttcgtgcaggccatcagcgacgccagatgcgtgttcgacatgggcgccgaggtgggcttcagcatgtacctgctggacatcggcggcggcttccccggcagcgaggacgtgaagctgaagttcgaggagatcaccggcgtgatcaaccccgccctggacaagtacttccccagcgacagcggcgtgagaatcatcgccgagcccggcagatactacgtggccagcgccttcaccctggccgtgaacatcatcgccaagaagatcgtgctgaaggagcagaccggcagcgacgacgaggacgagagcagcgagcagaccttcatgtactacgtgaacgacggcgtgtacggcagcttcaactgcatcctgtacgaccacgcccacgtgaagcccctgctgcagaagagacccaagcccgacgagaagtactacagcagcagcatctggggccccacctgcgacggcctggacagaatcgtggagagatgcgacctgcccgagatgcacgtgggcgactggatgctgttcgagaacatgggcgcctacaccgtggccgccgccagcaccttcaacggcttccagagacccaccatctactacgtgatgagcggccccgcctggcagctgatgcagcagttccagaaccccgacttcccccccgaggtggaggagcaggacgccagcaccctgcccgtgagctgcgcctgggagagcggcatgaagagacacagagccgcctgcgccagcgccagcatcaacgtgtag

SEQ ID NO: 92039 - DNA, 207 bp, Artificial Sequence
  Description of Artificial Sequence: Synthetic coding sequence
atgaacaacttcggcaacgaggagttcgactgccacttcctggacgagggcttcaccgccaaggacatcctggaccagaagatcaacgaggtgagcagcagcgacgacaaggacgccttctacgtggccgacctgggcgacatcctgaagaagcacctgagatggctgaaggccctgcccagagtgacccccttctacgccgtgtag

SEQ ID NO: 92040 - DNA, 927 bp, Artificial Sequence
  Description of Artificial Sequence: Synthetic coding sequence
atgatgaccttcgacagcgaggtggagctgatgaaggtggccagagcccaccccaaggccaagctggtgctgagaatcgccaccgacgacagcaaggccgtgtgcagactgagcgtgaagttcggcgccaccctgagaaccagcagactgctgctggagagagccaaggagctgaacatcgacgtggtgggcgtgagcttccacgtgggcagcggctgcaccgaccccgagaccttcgtgcaggccatcagcgacgccagatgcgtgttcgacatgggcgccgaggtgggcttcagcatgtacctgctggacatcggcggcggcttccccggcagcgaggacgtgaagctgaagttcgaggagatcaccggcgtgatcaaccccgccctggacaagtacttccccagcgacagcggcgtgagaatcatcgccgagcccggcagatactacgtggccagcgccttcaccctggccgtgaacatcatcgccaagaagatcgtgctgaaggagcagaccggcagcgacgacgaggacgagagcagcgagcagaccttcatgtactacgtgaacgacggcgtgtacggcagcttcaactgcatcctgtacgaccacgcccacgtgaagcccctgctgcagaagagacccaagcccgacgagaagtactacagcagcagcatctggggccccacctgcgacggcctggacagaatcgtggagagatgcgacctgcccgagatgcacgtgggcgactggatgctgttcgagaacatgggcgcctacaccgtggccgccgccagcaccttcaacggcttccagagacccaccatctactacgtgatgagcggccccgcctggcagctgatgcagcagttccagaaccccgacttccccccctgcctgtgcctggtgcccggcagagtgggctag

SEQ ID NO: 92041 - DNA, 684 bp, Artificial Sequence
  Description of Artificial Sequence: Synthetic coding sequence
atggtgaagagcagcctgcagagaatcctgaacagccactgcttcgccagagagaaggagggcgacaagcccagcgccaccatccacgccagcagaaccatgcccctgctgagcctgcacagcagaggcggcagcagcagcgagagcagcagagtgagcctgcactgctgcagcaaccccggccccggccccagatggtgcgacgccccccacccccccctgaagatccccggcggcagaggcaacagccagagagaccacaacctgagcgccaacctgttctacagcgacgacagactgaacgtgaccgaggagctgaccagcaacgacaagaccagaatcctgaacgtgcagagcagactgaccgacgccaagagaatcaactggagaaccgtgctgagcggcggcagcctgtacatcgagatccccggcggcgccctgcccgagggcagcaaggacagcttcgccgtgctgctggagttcgccgaggagcagctgagagccgaccacgtgttcatctgcttccacaagaacagagaggacagagccgccctgctgagaaccttcagcttcctgggcttcgagatcgtgagacccggccaccccctggtgcccaagagacccgacgcctgcttcatggcctacaccttcgagagagagagcagcggcgaggaggaggagtag

SEQ ID NO: 92042 - DNA, 831 bp, Artificial Sequence
  Description of Artificial Sequence: Synthetic coding sequence
atgtggatcaccagcctgatcaccatgaaggacgaggacatcttcgacctggccggcgacccccaggacagcctgatccccggccccagccccacccccaagcagaaccccgtgtgcaacgaggccttcttcggccaccagaccttcagcctgagagagaccggcctgaagagcgtgcactgccagggccaggaggccgagaacatggagagagagaagttccagcagaaggccctgaagcagaccaagcagaagaagagcaagagcgccgagttcctgatggtgaaggaggacagagaggccaccgagggcaccggcaaccccgccttcaacatgagcagccccgacctgagcgcctgccagaccgccgagaagaaggtgatcagacacgacatgcccgacagaaccctggccgcccaccagcagaagttcagactgcccgccagcgccgagcccaagggcaacgagtacggcagaaactacttcgaccccctgatggacgaggagatcaaccccagacagtgcgccaccgaggtgagcagagaggacgagagcggcagagaggagaccctgaacagcgaggcccccggcagcagcaacaagagccacgagatccacaaggaggccagcgaggccaccaccgcccacctggaggagttccagagaagccagaagaccatcatcctgctgggcagcagccccctggagcaggagatcagaagcaccagcctgcactgcatggaggacgagatgagccacccctggatcctgctgctgaaggtgaccgccgtgatcagaagcagaagatactacagagagcagagattctag

SEQ ID NO: 92043 - DNA, 1443 bp, Artificial Sequence
  Description of Artificial Sequence: Synthetic coding sequence
atggagagagagaagttccagcagaaggccctgaagcagaccaagcagaagaagagcaagagcgccgagttcctgatggtgaaggaggacagagaggccaccgagggcaccggcaaccccgccttcaacatgagcagccccgacctgagcgcctgccagaccgccgagaagaaggtgatcagacacgacatgcccgacagaaccctggccgcccaccagcagaagttcagactgcccgccagcgccgagcccaagggcaacgagtacggcagaaactacttcgaccccctgatggacgaggagatcaaccccagacagtgcgccaccgaggtgagcagagaggtgtgcctgatggccaagggcgagaaggccgagagcggcgtggacaacaccgccggcctgagcgagaaggagacccagaagaaccccagagcccccatggacgaggccgacgtgaagagcgccgcccacagcagccagggcagcatccccaagaagatcggcccctgcagcatggactacgaccccaacctgctggaggaggacgacgagctgcacagccagggcgacagcctgaccgaccacagcgtgaagggcaagagcaccgtgtggagaatcggcgaggccgaggactacagccaggacatcagctacctggaggagctggaggagcacagattcagcgtgtgctgcagcagcgtggccgacagcagatacggcgacttcttcaagcacctgcacttcgtgctggtgagcgccagcagcgagctgcagctgagccagtggcagagccagggcttctggtacatcatcctgctgatgttcttcctgtggttcctgagactgtacctgcactacctgggccagtggctgttcctgcaggccatcagcacccccgtgaccaagttccacttcagcctgcacatcgtggagctgtgctaccccaccagcagcctgcacatcggcgaggagctgcccgtggtggtgatgggccccctgatgctgaacgccatcctgctgctgctggtgctgatcagatggggctgccagctgctgttcgccagctgccccgacgtgctgagcaagctgatcatcaccatgggcctgtggaccatcctggaccccctggccgtgttcatcctggacaccctgctgggcagactgaccgacaacgaggagacccccgtggccgacgccgccaagctgtactggatgttcgtgagaaccgtgcagcccggcatcctgggcgtggtgatcaccgtgctgctgtacatcctgctgttcgtgatcagcagcctgatcctgtacctgtactgcctgagactgcacaacgacagctggatcctggacgccttccagagaatccacagcgaggagaccaagttcttcatcccctacgacctggagatcagcaaccaggagctgagctacatcgtgaagtag

SEQ ID NO: 92044 - DNA, 606 bp, Artificial Sequence
  Description of Artificial Sequence: Synthetic coding sequence
atggccctgagctgggtgctgaccgtgctgagcctgctgcccctgctggaggcccagatccccctgtgcgccaacctggtgcccgtgcccatcaccaacgccaccctggacagaatcaccggcaagtggttctacatcgccagcgccttcagaaacgaggagtacaacaagagcgtgcaggagatccaggccaccttcttctacttcacccccaacaagaccgaggacaccatcttcctgagagagtaccagaccagacaggaccagtgcatctacaacaccacctacctgaacgtgcagagagagaacggcaccatcagcagatacgtgggcggccaggagcacttcgcccacctgctgatcctgagagacaccaagacctacatgctggccttcgacgtgaacgacgagaagaactggggcctgagcgtgtacgccgacaagcccgagaccaccaaggagcagctgggcgagttctacgaggccctggactgcctgagaatccccaagagcgacgtggtgtacaccgactggaagaaggacaagtgcgagcccctggagaagcagcacgagaaggagagaaagcaggaggagggcgagagctag

SEQ ID NO: 92045 - DNA, 585 bp, Artificial Sequence
  Description of Artificial Sequence: Synthetic coding sequence
atggccctgagctgggtgctgaccgtgctgagcctgctgcccctgctggaggcccagatccccctgtgcgccaacctggtgcccgtgcccatcaccaacgccaccctggacagagtgagcgcctgggccagccccgtgctgagcacctgggccgccgccagcctgctgtgggccagcctgagcctgctggccgtggtgggcccccccctgcccgccctgcccttcagcctgctgggcccccagggcgagatcctgaccagccccggcgacagcggcggcaccccctgcctgcagacccagaagccccactgcagagtgctgcacggcggcagattctgcgccggccccggcggcgccgcctggggcgccatgaccgacccccagggcgagctgctgcacgcccactgcccccccggcgccagcagcccccacctgcagaaccagggcgagatctgcctgagcctgctgcccgccgacagccagagattcagcatcaagccccccagccccgcccccaccttcagccccgaccactggcaggtggtgctgtacagaatcggcctgagcaagagaggcgtgcagtag

SEQ ID NO: 92046 - DNA, 585 bp, Artificial Sequence
  Description of Artificial Sequence: Synthetic coding sequence
atggccctgagctgggtgctgaccgtgctgagcctgctgcccctgctggaggcccagatccccctgtgcgccaacctggtgcccgtgcccatcaccaacgccaccctggacagagtgagcgcctgggccagccccgtgctgagcacctgggccgccgccagcctgctgtgggccagcctgtacctgctggccgtggtggccccccccctgcccgccctgcccttcagcctgctgggcccccagggcgagatcctgaccagccccggcgacagcggcggcaccccctgcctgcagacccagaagccccactgcagagtgctgcacggcggcagattctgcgccggccccggcggcgccgcctggggcgccatgaccgacccccagggcgagctgctgcacgcccactgcccccccggcgccagcagcccccacctgcagaaccagggcgagatctgcctgagcctgctgcccgccgacagccagagattcagcatcaagccccccagccccgccccccccttcagccccgaccactggcaggtggtgctgtacagaatcggcctgagcaagagaggcgtgcagtag

SEQ ID NO: 92047 - DNA, 606 bp, Artificial Sequence
  Description of Artificial Sequence: Synthetic coding sequence
atggccctgagctgggtgctgaccgtgctgagcctgctgcccctgctggaggcccagatccccctgtgcgccaacctggtgcccgtgcccatcaccaacgccaccctggacagaatcaccggcaagtggttctacatcgccagcgccttcagaaacgaggagtacaacaagagcgtgcaggagatccaggccaccttcttctacttcacccccaacaagaccgaggacaccatcttcctgagagagtaccagaccagacagaaccagtgcttctacaacagcagctacctgaacgtgcagagagagaacggcaccgtgagcagatacgagggcggcagagagcacgtggcccacctgctgttcctgagagacaccaagaccctgatgttcggcagctacctggacgacgagaagaactggggcctgagcttctacgccgacaagcccgagaccaccaaggagcagctgggcgagttctacgaggccctggactgcctgtgcatccccagaagcgacgtgatgtacaccgactggaagaaggacaagtgcgagcccctggagaagcagcacgagaaggagagaaagcaggaggagggcgagagctag

SEQ ID NO: 92048 - DNA, 1065 bp, Artificial Sequence
  Description of Artificial Sequence: Synthetic coding sequence
atgatgagctacctgaagcagcccccctacggcatgaacggcctgggcctggccggccccgccatggacctgctgcaccccagcgtgggctaccccgccacccccagaaagcagagaagagagagaaccaccttcaccagaagccagctggacgtgctggaggccctgttcgccaagaccagataccccgacatcttcatgagagaggaggtggccctgaagatcaacctgcccgagagcagagtgcaggtgtggttcaagaacagaagagccaagtgcagacagcagcagcagagcggcagcggcaccaagagcagacccgccaagaagaagagcagccccgtgagagagagcagcggcagcgagagcagcggccagttcaccccccccgccgtgagcagcagcgccagcagcagcagcagcgccagcagcagcagcgccaaccccgccgccgccgccgccgccggcctgggcggcaaccccgtggccgccgccagcagcctgagcacccccgccgccagcagcatctggagccccgccagcatcagccccggcagcgcccccgccagcgtgagcgtgcccgagcccctggccgcccccagcaacaccagctgcatgcagagaagcgtggccgccggcgccgccaccgccgccgccagctaccccatgagctacggccagggcggcagctacggccagggctaccccacccccagcagcagctacttcggcggcgtggactgcagcagctacctggcccccatgcacagccaccaccacccccaccagctgagccccatggcccccagcagcatggccggccaccaccaccaccacccccacgcccaccaccccctgagccagagcagcggccaccaccaccaccaccaccaccaccaccaccagggctacggcggcagcggcctggccttcaacagcgccgactgcctggactacaaggagcccggcgccgccgccgccagcagcgcctggaagctgaacttcaacagccccgactgcctggactacaaggaccaggccagctggagattccaggtgctgtag

SEQ ID NO: 92049 - DNA, 1065 bp, Artificial Sequence; identical to SEQ ID NO: 92048
  Description of Artificial Sequence: Synthetic coding sequence

SEQ ID NO: 92050 - DNA, 894 bp, Artificial Sequence
  Description of Artificial Sequence: Synthetic coding sequence
atgatgagctacctgaagcagcccccctacgccgtgaacggcctgagcctgaccaccagcggcatggacctgctgcaccccagcgtgggctaccccggcccctgggccagctgccccgccgccacccccagaaagcagagaagagagagaaccaccttcaccagagcccagctggacgtgctggaggccctgttcgccaagaccagataccccgacatcttcatgagagaggaggtggccctgaagatcaacctgcccgagagcagagtgcaggtgtggttcaagaacagaagagccaagtgcagacagcagcagcagcagcagcagaacggcggccagaacaaggtgagacccgccaagaagaagaccagccccgccagagaggtgagcagcgagagcggcaccagcggccagttcaccccccccagcagcaccagcgtgcccaccatcgccagcagcagcgcccccgtgagcatctggagccccgccagcatcagccccctgagcgaccccctgagcaccagcagcagctgcatgcagagaagctaccccatgacctacacccaggccagcggctacagccagggctacgccggcagcaccagctacttcggcggcatggactgcggcagctacctgacccccatgcaccaccagctgcccggccccggcgccaccctgagccccatgggcaccaacgccgtgaccagccacctgaaccagagccccgccagcctgagcacccagggctacggcgccagcagcctgggcttcaacagcaccaccgactgcctggactacaaggaccagaccgccagctggaagctgaacttcaacgccgactgcctggactacaaggaccagaccagcagctggaagttccaggtgctgtag

SEQ ID NO: 92051 - DNA, 870 bp, Artificial Sequence
  Description of Artificial Sequence: Synthetic coding sequence
atgatgagctacctgaagcagcccccctacgccgtgaacggcctgagcctgaccaccagcggcatggacctgctgcaccccagcgtgggctaccccgccacccccagaaagcagagaagagagagaaccaccttcaccagagcccagctggacgtgctggaggccctgttcgccaagaccagataccccgacatcttcatgagagaggaggtggccctgaagatcaacctgcccgagagcagagtgcaggtgtggttcaagaacagaagagccaagtgcagacagcagcagcagcagcagcagaacggcggccagaacaaggtgagacccgccaagaagaagaccagccccgccagagaggtgagcagcgagagcggcaccagcggccagttcaccccccccagcagcaccagcgtgcccaccatcgccagcagcagcgcccccgtgagcatctggagccccgccagcatcagccccctgagcgaccccctgagcaccagcagcagctgcatgcagagaagctaccccatgacctacacccaggccagcggctacagccagggctacgccggcagcaccagctacttcggcggcatggactgcggcagctacctgacccccatgcaccaccagctgcccggccccggcgccaccctgagccccatgggcaccaacgccgtgaccagccacctgaaccagagccccgccagcctgagcacccagggctacggcgccagcagcctgggcttcaacagcaccaccgactgcctggactacaaggaccagaccgccagctggaagctgaacttcaacgccgactgcctggactacaaggaccagaccagcagctggaagttccaggtgctgtag

SEQ ID NO: 92052 - DNA, 720 bp, Artificial Sequence
  Description of Artificial Sequence: Synthetic coding sequence
atgatgagctacctgaagcagcccccctacgccgtgaacggcctgagcctgaccaccagcggcatggacctgctgcaccccagcgtgggctaccccggcccctgggccagctgccccgccgccacccccagaaagcagagaagagagagaaccaccttcaccagagcccagctggacgtgctggaggccctgttcgccaagaccagataccccgacatcttcatgagagaggaggtggccctgaagatcaacctgcccgagagcagagtgcaggtgtggttcaagaacagaagagccaagtgcagacagcagcagcagcagcagcagaacggcggccagaacaaggtgagacccgccaagaagaagaccagccccgccagagaggtgagcagcgagagcggcaccagcggccagttcaccccccccagcagcaccagcgtgcccaccatcgccagcagcagcgcccccgtgagcatctggagccccgccagcatcagccccctgagcgaccccctgagcaccagcagcagctgcatgcagagaagctaccccatgacctacacccaggccagcggctacagccagggctacgccggcagcaccagctacttcggcggcatggactgcggcagctacctgacccccatgcaccaccagctgcccggccccggcgccaccctgagccccatgggcaccaacgccgtgaccagccacctgtag

SEQ ID NO: 92053 - DNA, 870 bp, Artificial Sequence; identical to SEQ ID NO: 92051
  Description of Artificial Sequence: Synthetic coding sequence

SEQ ID NO: 92054 - DNA, 492 bp, Artificial Sequence
  Description of Artificial Sequence: Synthetic coding sequence
atgatgagctacctgaagcagcccccctacgccgtgaacggcctgagcctgaccaccagcggcatggacctgctgcaccccagcgtgggctaccccgccacccccagaaagcagagaagagagagaaccaccttcaccagagcccagctggacgtgctggaggccctgttcgccaagaccagataccccgacatcttcatgagagaggaggtggccctgaagatcaacctgcccgagagcagagtgcaggtgtggttcaagaacagaagagccaagtgcagacagcagcagcagcagcagcagaacggcggccagaacaaggtgagacccgccaagaagaagaccagccccgccagagaggtgagcagcgagagcggcaccagcggccagttcaccccccccagcagcaccagcgtgcccaccatcgccagcagcagcgcccccgtgagcatctggagccccgccagcatcagccccctgagcgacccctag

SEQ ID NO: 92055 - DNA, 978 bp, Artificial Sequence
  Description of Artificial Sequence: Synthetic coding sequence
atgctgagccacgccgacctgctggacgccagactgggcatgaaggacgccgccgagctgctgggccacagagaggccgtgaagtgcagactgggcgtgggcggcagcgaccccggcggccaccccggcgacctggcccccaacagcgaccccgtggagggcgccaccctgctgcccggcgaggacatcaccaccgtgggcagcacccccgccagcctggccgtgagcgccaaggaccccgacaagcagcccggcccccagggcggccccaaccccagccaggccggccagcagcagggccagcagaagcagaagagacacagaaccagattcacccccgcccagctgaacgagctggagagaagcttcgccaagacccactaccccgacatcttcatgagagaggagctggccctgagaatcggcctgaccgagagcagagtgcaggtgtggttccagaacagaagagccaagtggaagaagagaaagaagaccaccaacgtgttcagagcccccggcaccctgctgcccacccccggcctgccccagttccccagcgccgccgccgccgccgccgccgccatgggcgacagcctgtgcagcttccacgccaacgacaccagatgggccgccgccgccatgcccggcgtgagccagctgcccctgccccccgccctgggcagacagcaggccatggcccagagcctgagccagtgcagcctggccgccggccccccccccaacagcatgggcctgagcaacagcctggccggcagcaacggcgccggcctgcagagccacctgtaccagcccgccttccccggcatggtgcccgccagcctgcccggccccagcaacgtgagcggcagcccccagctgtgcagcagccccgacagcagcgacgtgtggagaggcaccagcatcgccagcctgagaagaaaggccctggagcacaccgtgagcatgagcttcacctag

SEQ ID NO: 92056 - DNA, 912 bp, Artificial Sequence
  Description of Artificial Sequence: Synthetic coding sequence
atgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgttcaccagcagcagactgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagatcaacctgctgttccccatcatctacctgctgttctgggccttcctgctggtgttcagcctgtggagcgagcccgtggtgtgcggcatcggcctggccatcatgctgaccggcgtgcccgtgtacttcctgggcgtgtactggcagcacaagcccaagtgcttcagcgacttcatcgagctgctgaccctggtgagccagaagatgtgcgtggtggtgtaccccgaggtggagggcctgagagacagaggcggctag

SEQ ID NO: 92057 - DNA, 861 bp, Artificial Sequence
  Description of Artificial Sequence: Synthetic coding sequence
atggccctggtgctgatcctgcagctgctgaccctgtggcccctgtgccacaccgacatcacccccagcgtggccatcatcgtgccccccgccagctaccaccccaagccctggctgggcgcccagcccgccaccgtggtgacccccggcgtgaacgtgaccctgagatgcagagccccccagcccgcctggagattcggcctgttcaagcccggcgagatcgcccccctgctgttcagagacgtgagcagcgagctggccgagttcttcctggaggaggtgacccccgcccagggcggcatctacagatgctgctacagaagacccgactggggccccggcgtgtggagccagcccagcgacgtgctggagctgctggtgaccgaggagctgcccagacccagcctggtggccctgcccggccccgtggtgggccccggcgccaacgtgagcctgagatgcgccggcagactgagaaacatgagcttcgtgctgtacagagagggcgtggccgcccccctgcagtacagacacagcgcccagccctgggccgacttcaccctgctgggcgccagagcccccggcacctacagctgctactaccacacccccagcgccccctacgtgctgagccagagaagcgaggtgctggtgatcagctgggagggcgagggccccgaggccagacccgccagcagcgcccccggcatgcaggcccccggccccccccccagcgaccccggcgcccaggcccccagcctgagcagcttcagacccagaggcctggtgctgcagcccctgctgccccagacccaggacagctgggaccccgcccccccccccagcgaccccggcgtgtag

SEQ ID NO: 92058 - DNA, 849 bp, Artificial Sequence
  Description of Artificial Sequence: Synthetic coding sequence
atggccctggtgctgatcctgcagctgctgaccctgtggcccctgtgccacaccgacatcacccccagcgtgccccccgccagctaccaccccaagccctggctgggcgcccagcccgccaccgtggtgacccccggcgtgaacgtgaccctgagatgcagagccccccagcccgcctggagattcggcctgttcaagcccggcgagatcgcccccctgctgttcagagacgtgagcagcgagctggccgagttcttcctggaggaggtgacccccgcccagggcggcatctacagatgctgctacagaagacccgactggggccccggcgtgtggagccagcccagcgacgtgctggagctgctggtgaccgaggagctgcccagacccagcctggtggccctgcccggccccgtggtgggccccggcgccaacgtgagcctgagatgcgccggcagactgagaaacatgagcttcgtgctgtacagagagggcgtggccgcccccctgcagtacagacacagcgcccagccctgggccgacttcaccctgctgggcgccagagcccccggcacctacagctgctactaccacacccccagcgccccctacgtgctgagccagagaagcgaggtgctggtgatcagctgggagggcgagggccccgaggccagacccgccagcagcgcccccggcatgcaggcccccggccccccccccagcgaccccggcgcccaggcccccagcctgagcagcttcagacccagaggcctggtgctgcagcccctgctgccccagacccaggacagctgggaccccgcccccccccccagcgaccccggcgtgtag

SEQ ID NO: 92059 - DNA, 759 bp, Artificial Sequence
  Description of Artificial Sequence: Synthetic coding sequence
atggccctggtgctgatcctgcagctgctgaccctgttcccccccgccagctaccaccccaagccctggctgggcgcccagcccgccaccgtggtgacccccggcgtgaacgtgaccctgagatgcagagccccccagcccgcctggagattcggcctgttcaagcccggcgagatcgcccccctgctgttcagagacgtgagcagcgagctggccgagttcttcctggaggaggtgacccccgcccagggcggcatctacagatgctgctacagaagacccgactggggccccggcgtgtggagccagcccagcgacgtgctggagctgctggtgaccgaggagctgcccagacccagcctggtggccctgcccggccccgtggtgggccccggcgccaacgtgagcctgagatgcgccggcagactgagaaacatgagcttcgtgctgtacagagagggcgtggccgcccccctgcagtacagacacagcgcccagccctgggccgacttcaccctgctgggcgccagagcccccggcacctacagctgctactaccacacccccagcgccccctacgtgctgagccagagaagcgaggtgctggtgatcagctgggaggacagcggcagcagcgactacaccagaggcaacctggtgagactgggcctggccggcctggtgctgatcagcctgggcgccctggtgaccttcgactggagaagccagaacagagcccccgccggcatcagaccctag

SEQ ID NO: 92060 - DNA, 804 bp, Artificial Sequence
  Description of Artificial Sequence: Synthetic coding sequence
atggccctggtgctgatcctgcagctgctgaccctgtggcccctgtgccacaccgacatcacccccagcgtggccatcatcgtgccccccgccagctaccaccccaagccctggctgggcgcccagcccgccaccgtggtgacccccggcgtgaacgtgaccctgagatgcagagccccccagcccgcctggagattcggcctgttcaagcccggcgagatcgcccccctgctgttcagagacgtgagcagcgagctggccgagttcttcctggaggaggtgacccccgcccagggcggcatctacagatgctgctacagaagacccgactggggccccggcgtgtggagccagcccagcgacgtgctggagctgctggtgaccgaggagctgcccagacccagcctggtggccctgcccggccccgtggtgggccccggcgccaacgtgagcctgagatgcgccggcagactgagaaacatgagcttcgtgctgtacagagagggcgtggccgcccccctgcagtacagacacagcgcccagccctgggccgacttcaccctgctgggcgccagagcccccggcacctacagctgctactaccacacccccagcgccccctacgtgctgagccagagaagcgaggtgctggtgatcagctgggaggacagcggcagcagcgactacaccagaggcaacctggtgagactgggcctggccggcctggtgctgatcagcctgggcgccctggtgaccttcgactggagaagccagaacagagcccccgccggcatcagaccctag

SEQ ID NO: 92061 - DNA, 792 bp, Artificial Sequence
  Description of Artificial Sequence: Synthetic coding sequence
atggccctggtgctgatcctgcagctgctgaccctgtggcccctgtgccacaccgacatcacccccagcgtgccccccgccagctaccaccccaagccctggctgggcgcccagcccgccaccgtggtgacccccggcgtgaacgtgaccctgagatgcagagccccccagcccgcctggagattcggcctgttcaagcccggcgagatcgcccccctgctgttcagagacgtgagcagcgagctggccgagttcttcctggaggaggtgacccccgcccagggcggcatctacagatgctgctacagaagacccgactggggccccggcgtgtggagccagcccagcgacgtgctggagctgctggtgaccgaggagctgcccagacccagcctggtggccctgcccggccccgtggtgggccccggcgccaacgtgagcctgagatgcgccggcagactgagaaacatgagcttcgtgctgtacagagagggcgtggccgcccccctgcagtacagacacagcgcccagccctgggccgacttcaccctgctgggcgccagagcccccggcacctacagctgctactaccacacccccagcgccccctacgtgctgagccagagaagcgaggtgctggtgatcagctgggaggacagcggcagcagcgactacaccagaggcaacctggtgagactgggcctggccggcctggtgctgatcagcctgggcgccctggtgaccttcgactggagaagccagaacagagcccccgccggcatcagaccctag

SEQ ID NO: 92062 - DNA, 645 bp, Artificial Sequence
  Description of Artificial Sequence: Synthetic coding sequence
atgagcaagcccccccccaagcccgtgaagcccggccaggtgaaggtgttcagagccctgtacaccttcgagcccagaacccccgacgagctgtacttcgaggagggcgacatcatctacatcaccgacatgagcgacaccaactggtggaagggcaccagcaagggcagaaccggcctgatccccagcaactacgtggccgagcaggccgagagcatcgacaaccccctgcacgaggccgccaagagaggcaacctgagctggctgagagagtgcctggacaacagagtgggcgtgaacggcctggacaaggccggcagcaccgccctgtactgggcctgccacggcggccacaaggacatcgtggagatgctgttcacccagcccaacatcgagctgaaccagcagaacaagctgggcgacaccgccctgcacgccgccgcctggaagggctacgccgacatcgtgcagctgctgctggccaagggcgccagaaccgacctgagaaacatcgagaagaagctggccttcgacatggccaccaacgccgcctgcgccagcctgctgaagaagaagcagggcaccgacgccgtgagaaccctgagcaacgccgaggactacctggacgacgaggacagcgactag

SEQ ID NO: 92063 - DNA, 897 bp, Artificial Sequence
  Description of Artificial Sequence: Synthetic coding sequence
atgaagaccctgcagagcaccctgctgctgctgctgctggtgcccctgatcaagcccgccccccccacccagcaggacagcagaatcatctacgactacggcaccgacaacttcgaggagagcatcttcagccaggactacgaggacaagtacctggacggcaagaacatcaaggagaaggagaccgtgatcatccccaacgagaagagcctgcagctgcagaaggacgaggccatcacccccctgccccccaagaaggagaacgacgagatgcccacctgcctgctgtgcgtgtgcctgagcggcagcgtgtactgcgaggaggtggacatcgacgccgtgccccccctgcccaaggagagcgcctacctgtacgccagattcaacaagatcaagaagctgaccgccaaggacttcgccgacatccccaacctgagaagactggacttcaccggcaacctgatcgaggacatcgaggacggcaccttcagcaagctgagcctgctggaggagctgagcctggccgagaaccagctgctgaagctgcccgtgctgccccccaagctgaccctgttcaacgccaagtacaacaagatcaagagcagaggcatcaaggccaacgccttcaagaagctgaacaacctgaccttcctgtacctggaccacaacgccctggagagcgtgcccctgaacctgcccgagagcctgagagtgatccacctgcagttcaacaacatcgccagcatcaccgacgacaccttctgcaaggccaacgacaccagctacatcagagacagaatcgaggagatcagactggagggcaaccccatcgtgctgggcaagcaccccaacagcttcatctgcctgaagagactgcccatcggcagctacttctag

SEQ ID NO: 92064 - DNA, 897 bp, Artificial Sequence; identical to SEQ ID NO: 92063
  Description of Artificial Sequence: Synthetic coding sequence

SEQ ID NO: 92065 - DNA, 807 bp, Artificial Sequence
  Description of Artificial Sequence: Synthetic coding sequence
atgctggccaagatcagcaccacctggaagctgttcctgaagctgctgggccccgagatcctgctgagcagcctgaagagcagacacagcttcagccacagccccagccacctgggcctgatgcacagacacgagcacctgctgagaaagaccaccaagaacttcaagaccgccaccaccaccctgcagagcaccctgctgctgctgctgctggtgcccctgatcaagcccgccccccccacccagcaggacagcagaatcatctacgactacggcaccgacaacttcgaggagagcatcttcagccaggactacgaggacaagtacctggacggcaagaacatcaaggagaaggagaccgtgatcatccccaacgagaagagcctgcagctgcagaaggacgaggccatcacccccctgccccccaagaaggagaacgacgagatgcccacctgcctgctgtgcgtgtgcctgagcggcagcgtgtactgcgaggaggtggacatcgacgccgtgccccccctgcccaaggagagcgcctacctgtacgccagattcaacaagatcaagaagctgaccgccaaggacttcgccgacatccccaacctgagaagactggacttcaccggcaacctgatcgaggacatcgaggacggcaccttcagcaagctgagcctgctggaggagctgagcctggccgagaaccagctgctgaagctgcccgtgctgccccccaagctgaccctgttcaacgccaagtacaacaagatcaagagcagaggcatcaaggccaacgccttcaagtag

SEQ ID NO: 92066 - DNA, 1842 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaaggccagcaagcagcacagactgaagagataccacagccagacctacggcaacggcagcaagtgcgacctgaacggcagacccagagaggccgaggtgagattcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgtggacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgaggtgaaggccggcatggagagagagctggagaacatcatccaggagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92067 - DNA, 1959 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaaggccagcaagcagcacagactgaagagataccacagccagacctacggcaacggcagcaagtgcgacctgaacggcagacccagagaggccgaggtgagattcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccgaggaggaccccgagcacagagtgagagtgagagtgaccaagctgagactgggcggccccaaccaggacctgaccgtgctggagatgaagagagagaacccccagctgaagcagatcgagggcctggtgaaggagctgctggagagagagggcctgaccgccgccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92068 - DNA, 1683 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgagttcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgaggtgaaggccggcatggagagagagctggagaacatcatccaggagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92069 - DNA, 1743 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaagttcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgtggacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgaggtgaaggccggcatggagagagagctggagaacatcatccaggagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92070 - DNA, 2004 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaaggccagcaagcagcacagactgaagagataccacagccagacctacggcaacggcagcaagtgcgacctgaacggcagacccagagaggccgaggtgagattcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgaggtgaaggccggcatggagagagagctggagaacatcatccaggagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccgaggaggaccccgagcacagagtgagagtgagagtgaccaagctgagactgggcggccccaaccaggacctgaccgtgctggagatgaagagagagaacccccagctgaagcagatcgagggcctggtgaaggagctgctggagagagagggcctgaccgccgccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92071 - DNA, 1794 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaaggccagcaagcagcacagactgaagagataccacagccagacctacggcaacggcagcaagtgcgacctgaacggcagacccagagaggccgaggtgagattcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92072 - DNA, 1839 bp, Artificial Sequence
  Description of Artificial Sequence: Synthetic coding sequence
atggccgccgagaccctgctgagcagcctgctgggcctgctgctgctgggcctgctgctgcccgccagcctgaccggcggcgtgggcagcctgaacctggaggagctgagcgagatgagatacggcatcgagatcctgcccctgcccgtgatgggcggccagagccagagcagcgacgtggtgatcgtgagcagcaagtacaagcagagatacgagtgcagactgcccgccggcgccatccacttccagagagagagagaggaggagacccccgcctaccagggccccggcatccccgagctgctgagccccatgagagacgccccctgcctgctgaagaccaaggactggtggacctacgagttctgctacggcagacacatccagcagtaccacatggaggacagcgagatcaagggcgaggtgctgtacctgggctactaccagagcgccttcgactgggacgacgagaccgccaaggccagcaagcagcacagactgaagagataccacagccagacctacggcaacggcagcaagtgcgacctgaacggcagacccagagaggccgaggtgagattcctgtgcgacgagggcgccggcatcagcggcgactacatcgacagagtggacgagcccctgagctgcagctacgtgctgaccatcagaacccccagactgtgcccccaccccctgctgagacccccccccagcgccgccccccaggccatcctgtgccaccccagcctgcagcccgaggagtacatggcctacgtgcagagacaggccgacagcaagcagtacggcgacaagatcatcgaggagctgcaggacctgggcccccaggtgtggagcgagaccaagagcggcgtggccccccagaagatggccggcgccagccccaccaaggacgacagcaaggacagcgacttctggaagatgctgaacgagcccgaggaccaggcccccggcggcgaggaggtgcccgccgaggagcaggaccccagccccgaggccgccgacagcgccagcggcgcccccaacgacttccagaacaacgtgcaggtgaaggtgatcagaagccccgccgacctgatcagattcatcgaggagctgaagggcggcaccaagaagggcaagcccaacatcggccaggagcagcccgtggacgacgccgccgaggtgccccagagagagcccgagaaggagagaggcgaccccgagagacagagagagatggaggaggaggaggacgaggacgaggacgaggacgaggacgaggacgagagacagctgctgggcgagttcgagaaggagctggagggcatcctgctgcccagcgacagagacagactgagaagcgaggtgaaggccggcatggagagagagctggagaacatcatccaggagaccgagaaggagctggaccccgacggcctgaagaaggagagcgagagagacagagccatgctggccctgaccagcaccctgaacaagctgatcaagagactggaggagaagcagagccccgagctggtgaagaagcacaagaagaagagagtggtgcccaagaagcccccccccagcccccagcccaccggcaagatcgagatcaagatcgtgagaccctgggccgagggcaccgaggagggcgccagatggctgaccgacgaggacaccagaaacctgaaggagatcttcttcaacatcctggtgcccggcgccgaggaggcccagaaggagagacagagacagaaggagctggagagcaactacagaagagtgtggggcagccccggcggcgagggcaccggcgacctggacgagttcgacttctag

SEQ ID NO: 92073 - DNA, 3462 bp, Artificial Sequence
  Description of Artificial Sequence: Synthetic coding sequence
atgagccaggagcccaccacctacagcctgttcctgttcctgttcctgagccacggcgtgagcagctacaccgtgcccaacagcagacaggacctgcaccccctgctgcagaacatggccgaggagatcatcgacggcagctacctgaacgccctgctggacctgatccagttccagagcagccacgtgtggaccgacgacctgagccacagagtgctggcctacctgaacagcagaaacgtggccttcaccatccccagcctgcaggccgccgtggagaaccacctggagcagagactgcaccagccccagaagctgctggaggacctgagaaagaccgacgcccagcagttcagaaccgccatgaagtgcctgctggaggacaagaaggacggcctggacctgaaggacatcatcatcgacctgggcgagatcagagagagagccctgcagagccccggcgtgaacagaagcctgttcctgatcaccctggagagatgcttccagatgctgaacagcctggagtgcgtggagatcctgggcaaggtgctgagaggcagcagcggcagcttcctgcagcccgacatcaccgagagactgcccagagacctgagagaggacgccttcaagaacctgagcgccgtgttcaaggacctgtacgacaagaccagcgcccacagccagagagccctgtacagctggatgaccggcatcctgcagaccagcagcaacgccaccgacgacagcgccagctgggtgagcgccgagcacctgtgggtgctgggcagatacatggtgcacctgagcttcgaggagatcaccaagatcagccccatcgagatcggcctgttcatcagctacgacaacgccaccaagcagctggacatggtgtacgacatcacccccgagctggcccaggccttcctggagagaatcagcagcagcaacttcaacatgagaaacaccagcaccatccacagacaggcccacgagctgtgggccctggagcccttccccaagatgctgggcctgctggtgtgcttctacaacgacctggagctgctggacgccaccgtggcccaggtgctgctgtaccagatgatcaagtgcagccacctgagaggcttccaggccggcgtgcagaagctgaaggccgagctgctggacatcgccatggagaaccagaccctgaacgagaccctgggcagcctgagcgacgccgtggtgggcctgacctacagccagctggagagcctgagccccgaggccgtgcacggcgccatcagcaccctgaaccaggtgagcggctgggccaagagccaggtgatcatcctgagcgccaagtacctggcccacgagaaggtgctgagcttctacaacgtgagccagatgggcgccctgctggccggcgtgagcacccaggccttctgcagcatgaagagaaaggacatcagccaggtgctgagaagcgccgtgagccagtacgtgagcgacctgagccccgcccagcagcagggcatcctgagcaagatggtgcaggccgaggacaccgcccccggcatcgtggagatccagggcgccttcttcaaggaggtgagcctgttcgacctgagaagacagcccggcttcaacagcaccgtgctgaaggacaaggagctgggcagaagccaggccctgttcctgtacgagctgctgctgaagaccaccagaagacccgaggagctgctgagcgccggccagctggtgaagggcgtgacctgcagccacatcgacgccatgagcaccgacttcttcctggcccacttccaggacttccagaacaacttcgccctgctgagcccctaccaggtgaactgcctggcctggaagtactgggaggtgagcagactgagcatgccccccttcctgctggccgccctgcccgccagatacctggccagcgtgcccgccagccagtgcgtgcccttcctgatcagcctgggcaagagctggctggacagcctggtgctggacagccacaagaagaccagcgtgctgagaaaggtgcagcagtgcctggacgacagcatcgccgacgagtacaccgtggacatcatgggcaacctgctgtgccacctgcccgccgccatcatcgacagaggcatcagccccagagcctgggccaccgccctgcacggcctgagagactgccccgacctgaaccccgagcagaaggccgccgtgagactgaagctgctgggccagtacggcctgccccagcactggaccgccgagaccaccaaggacctgggccccttcctggtgctgttcagcggcgacgagctgagcagcatcgccaccaagttccccgagatcctgctgcaggccgccagcaagatggccagaaccctgcccaccaaggagttcctgtgggccgtgttccagagcgtgagaaacagcagcgacaagatccccagctacgaccccatgcccggctgccacggcgtggtggcccccagcagcgacgacatcttcaagctggccgaggccaacgcctgctgggccctggaggacctgagatgcatggaggaggacaccttcatcagaaccgtggagctgctgggcgccgtgcagggcttcagcagaccccagctgatgaccctgaaggagaaggccatccaggtgtgggacatgcccagctactggagagagcaccacatcgtgagcctgggcagaatcgccctggccctgaacgagagcgagctggagcagctggacctgagcagcatcgacaccgtggccagcctgagctggcagaccgagtggacccccggccaggccgagagcatcctgcagggctacctggacgacagcggctacagcatccaggacctgaagagcttccacctggtgggcctgggcgccaccctgtgcgccatcaacatcaccgagatccccctgatcaagatcagcgagttcagagtggtggtggccagaatcggcaccctgctgtgcagcacccacgtgctggccgagttcaagagaaaggccgaggtggtgttcggcgaccccaccgagtggaccagcagcgtgctgcaggagctgggcaccatcgccgccggcctgaccaaggccgagctgagaatgctggacaaggacctgatgccctacttccagcccagcgccatcaagtgcctgcccgacgagatcttcaaggagctgagcgccgagcagatcgccagcctgggccccgagaacgccgccgccgtgacccacgcccagagaagaagactgagccccctgcagctgcagagcctgcagcaggccctggacggcgccaagacccacagctggcaggacgcccccgccagcgccggccccaccagaaccagcagcagcagaagccccgccggcgccctgcagagctggggcctgtggctgggctgccccctgctggtgctgatggccaagctgctgtggtag

SEQ ID NO: 92074 - DNA, 1647 bp, Artificial Sequence
  Description of Artificial Sequence: Synthetic coding sequence
cccagagccgtgtgggtggaggccagaggcggcgcccagcaccccaccatgagaagaaccgcccccctgcacagaggcacctggagcaagatgagcatcatcctgagagccagatacctggccagcgtgcccgccagccagtgcgtgcccttcctgatcagcctgggcaagagctggctggacagcctggtgctggacagccacaagaagaccagcgtgctgagaaaggtgcagcagtgcctggacgacagcatcgccgacgagtacaccgtggacatcatgggcaacctgctgtgccacctgcccgccgccatcatcgacagaggcatcagccccagagcctgggccaccgccctgcacggcctgagagactgccccgacctgaaccccgagcagaaggccgccgtgagactgaagctgctgggccagtacggcctgccccagcactggaccgccgagaccaccaaggacctgggccccttcctggtgctgttcagcggcgacgagctgagcagcatcgccaccaagttccccgagatcctgctgcaggccgccagcaagatggccagaaccctgcccaccaaggagttcctgtgggccgtgttccagagcgtgagaaacagcagcgacaagatccccagctacgaccccatgcccggctgccacggcgtggtggcccccagcagcgacgacatcttcaagctggccgaggccaacgcctgctgggccctggaggacctgagatgcatggaggaggacaccttcatcagaaccgtggagctgctgggcgccgtgcagggcttcagcagaccccagctgatgaccctgaaggagaaggccatccaggtgtgggacatgcccagctactggagagagcaccacatcgtgagcctgggcagaatcgccctggccctgaacgagagcgagctggagcagctggacctgagcagcatcgacaccgtggccagcctgagctggcagaccgagtggacccccggccaggccgagagcatcctgcagggctacctggacgacagcggctacagcatccaggacctgaagagcttccacctggtgggcctgggcgccaccctgtgcgccatcaacatcaccgagatccccctgatcaagatcagcgagttcagagtggtggtggccagaatcggcaccctgctgtgcagcacccacgtgctggccgagttcaagagaaaggccgaggtggtgttcggcgaccccaccgagtggaccagcagcgtgctgcaggagctgggcaccatcgccgccggcctgaccaaggccgagctgagaatgctggacaaggacctgatgccctacttccagcccagcgccatcaagtgcctgcccgacgagatcttcaaggagctgagcgccgagcagatcgccagcctgggccccgagaacgccgccgccgtgacccacgcccagagaagaagactgagccccctgcagctgcagagcctgcagcaggccctggacggcgccaagacccacagctggcaggacgcccccgccagcgccggccccaccagaaccagcagcagcagaagccccgccggcgccctgcagagctggggcctgtggctgggctgccccctgctggtgctgatggccaagctgctgtggtag

SEQ ID NO: 92075 - DNA, 3183 bp, Artificial Sequence
  Description of Artificial Sequence: Synthetic coding sequence
atgggcaacagcatcacctacagagaccaggccgccgtggagaaccacctggagcagagactgcaccagccccagaagctgctggaggacctgagaaagaccgacgcccagcagttcagaaccgccatgaagtgcctgctggaggacaagaaggacggcctggacctgaaggacatcatcatcgacctgggcgagatcagagagagagccctgcagagccccggcgtgaacagaagcctgttcctgatcaccctggagagatgcttccagatgctgaacagcctggagtgcgtggagatcctgggcaaggtgctgagaggcagcagcggcagcttcctgcagcccgacatcaccgagagactgcccagagacctgagagaggacgccttcaagaacctgagcgccgtgttcaaggacctgtacgacaagaccagcgcccacagccagagagccctgtacagctggatgaccggcatcctgcagaccagcagcaacgccaccgacgacagcgccagctgggtgagcgccgagcacctgtgggtgctgggcagatacatggtgcacctgagcttcgaggagatcaccaagatcagccccatcgagatcggcctgttcatcagctacgacaacgccaccaagcagctggacatggtgtacgacatcacccccgagctggcccaggccttcctggagagaatcagcagcagcaacttcaacatgagaaacaccagcaccatccacagactgggcctgctggtgtgcttctacaacgacctggagctgctggacgccaccgtggcccaggtgctgctgtaccagatgatcaagtgcagccacctgagaggcttccaggccggcgtgcagaagctgaaggccgagctgctggacatcgccatggagaaccagaccctgaacgagaccctgggcagcctgagcgacgccgtggtgggcctgacctacagccagctggagagcctgagccccgaggccgtgcacggcgccatcagcaccctgaaccaggtgagcggctgggccaagagccaggtgatcatcctgagcgccaagtacctggcccacgagaaggtgctgagcttctacaacgtgagccagatgggcgccctgctggccggcgtgagcacccaggccttctgcagcatgaagagaaaggacatcagccaggtgctgagaagcgccgtgagccagtacgtgagcgacctgagccccgcccagcagcagggcatcctgagcaagatggtgcaggccgaggacaccgcccccggcatcgtggagatccagggcgccttcttcaaggaggtgagcctgttcgacctgagaagacagcccggcttcaacagcaccgtgctgaaggacaaggagctgggcagaagccaggccctgttcctgtacgagctgctgctgaagaccaccagaagacccgaggagctgctgagcgccggccagctggtgaagggcgtgacctgcagccacatcgacgccatgagcaccgacttcttcctggcccacttccaggacttccagaacaacttcgccctgctgagcccctaccaggtgaactgcctggcctggaagtactgggaggtgagcagactgagcatgccccccttcctgctggccgccctgcccgccagatacctggccagcgtgcccgccagccagtgcgtgcccttcctgatcagcctgggcaagagctggctggacagcctggtgctggacagccacaagaagaccagcgtgctgagaaaggtgcagcagtgcctggacgacagcatcgccgacgagtacaccgtggacatcatgggcaacctgctgtgccacctgcccgccgccatcatcgacagaggcatcagccccagagcctgggccaccgccctgcacggcctgagagactgccccgacctgaaccccgagcagaaggccgccgtgagactgaagctgctgggccagtacggcctgccccagcactggaccgccgagaccaccaaggacctgggccccttcctggtgctgttcagcggcgacgagctgagcagcatcgccaccaagttccccgagatcctgctgcaggccgccagcaagatggccagaaccctgcccaccaaggagttcctgtgggccgtgttccagagcgtgagaaacagcagcgacaagatccccagctacgaccccatgcccggctgccacggcgtggtggcccccagcagcgacgacatcttcaagctggccgaggccaacgcctgctgggccctggaggacctgagatgcatggaggaggacaccttcatcagaaccgtggagctgctgggcgccgtgcagggcttcagcagaccccagctgatgaccctgaaggagaaggccatccaggtgtgggacatgcccagctactggagagagcaccacatcgtgagcctgggcagaatcgccctggccctgaacgagagcgagctggagcagctggacctgagcagcatcgacaccgtggccagcctgagctggcagaccgagtggacccccggccaggccgagagcatcctgcagggctacctggacgacagcggctacagcatccaggacctgaagagcttccacctggtgggcctgggcgccaccctgtgcgccatcaacatcaccgagatccccctgatcaagatcagcgagttcagagtggtggtggccagaatcggcaccctgctgtgcagcacccacgtgctggccgagttcaagagaaaggccgaggtggtgttcggcgaccccaccgagtggaccagcagcgtgctgcaggagctgggcaccatcgccgccggcctgaccaaggccgagctgagaatgctggacaaggacctgatgccctacttccagcccagcgccatcaagtgcctgcccgacgagatcttcaaggagctgagcgccgagcagatcgccagcctgggccccgagaacgccgccgccgtgacccacgcccagagaagaagactgagccccctgcagctgcagagcctgcagcaggccctggacggcgccaagacccacagctggcaggacgcccccgccagcgccggccccaccagaaccagcagcagcagaagccccgccggcgccctgcagagctggggcctgtggctgggctgccccctgctggtgctgatggccaagctgctgtggtag

SEQ ID NO: 92076 - DNA, 2448 bp, Artificial Sequence
  Description of Artificial Sequence: Synthetic coding sequence
atgttcagactgggcctgctggtgtgcttctacaacgacctggagctgctggacgccaccgtggcccaggtgctgctgtaccagatgatcaagtgcagccacctgagaggcttccaggccggcgtgcagaagctgaaggccgagctgctggacatcgccatggagaaccagaccctgaacgagaccctgggcagcctgagcgacgccgtggtgggcctgacctacagccagctggagagcctgagccccgaggccgtgcacggcgccatcagcaccctgaaccaggtgagcggctgggccaagagccaggtgatcatcctgagcgccaagtacctggcccacgagaaggtgctgagcttctacaacgtgagccagatgggcgccctgctggccggcgtgagcacccaggccttctgcagcatgaagagaaaggacatcagccaggtgctgagaagcgccgtgagccagtacgtgagcgacctgagccccgcccagcagcagggcatcctgagcaagatggtgcaggccgaggacaccgcccccggcatcgtggagatccagggcgccttcttcaaggaggtgagcctgttcgacctgagaagacagcccggcttcaacagcaccgtgctgaaggacaaggagctgggcagaagccaggccctgttcctgtacgagctgctgctgaagaccaccagaagacccgaggagctgctgagcgccggccagctggtgaagggcgtgacctgcagccacatcgacgccatgagcaccgacttcttcctggcccacttccaggacttccagaacaacttcgccctgctgagcccctaccaggtgaactgcctggcctggaagtactgggaggtgagcagactgagcatgccccccttcctgctggccgccctgcccgccagatacctggccagcgtgcccgccagccagtgcgtgcccttcctgatcagcctgggcaagagctggctggacagcctggtgctggacagccacaagaagaccagcgtgctgagaaaggtgcagcagtgcctggacgacagcatcgccgacgagtacaccgtggacatcatgggcaacctgctgtgccacctgcccgccgccatcatcgacagaggcatcagccccagagcctgggccaccgccctgcacggcctgagagactgccccgacctgaaccccgagcagaaggccgccgtgagactgaagctgctgggccagtacggcctgccccagcactggaccgccgagaccaccaaggacctgggccccttcctggtgctgttcagcggcgacgagctgagcagcatcgccaccaagttccccgagatcctgctgcaggccgccagcaagatggccagaaccctgcccaccaaggagttcctgtgggccgtgttccagagcgtgagaaacagcagcgacaagatccccagctacgaccccatgcccggctgccacggcgtggtggcccccagcagcgacgacatcttcaagctggccgaggccaacgcctgctgggccctggaggacctgagatgcatggaggaggacaccttcatcagaaccgtggagctgctgggcgccgtgcagggcttcagcagaccccagctgatgaccctgaaggagaaggccatccaggtgtgggacatgcccagctactggagagagcaccacatcgtgagcctgggcagaatcgccctggccctgaacgagagcgagctggagcagctggacctgagcagcatcgacaccgtggccagcctgagctggcagaccgagtggacccccggccaggccgagagcatcctgcagggctacctggacgacagcggctacagcatccaggacctgaagagcttccacctggtgggcctgggcgccaccctgtgcgccatcaacatcaccgagatccccctgatcaagatcagcgagttcagagtggtggtggccagaatcggcaccctgctgtgcagcacccacgtgctggccgagttcaagagaaaggccgaggtggtgttcggcgaccccaccgagtggaccagcagcgtgctgcaggagctgggcaccatcgccgccggcctgaccaaggccgagctgagaatgctggacaaggacctgatgccctacttccagcccagcgccatcaagtgcctgcccgacgagatcttcaaggagctgagcgccgagcagatcgccagcctgggccccgagaacgccgccgccgtgacccacgcccagagaagaagactgagccccctgcagctgcagagcctgcagcaggccctggacggcgccaagacccacagctggcaggacgcccccgccagcgccggccccaccagaaccagcagcagcagaagccccgccggcgccctgcagagctggggcctgtggctgggctgccccctgctggtgctgatggccaagctgctgtggtag

SEQ ID NO: 92077 - DNA, 3420 bp, Artificial Sequence
  Description of Artificial Sequence: Synthetic coding sequence
atgagccaggagcccaccacctacagcctgttcctgttcctgttcctgagccacggcgtgagcagctacaccgtgcccaacagcagacaggacctgcaccccctgctgcagaacatggccgaggagatcatcgacggcagctacctgaacgccctgctggacctgatccagttccagagcagccacgtgtggaccgacgacctgagccacagagtgctggcctacctgaacagcagaaacgtggccttcaccatccccagcctgcaggccgccgtggagaaccacctggagcagagactgcaccagccccagaagctgctggaggacctgagaaagaccgacgcccagcagttcagaaccgccatgaagtgcctgctggaggacaagaaggacggcctggacctgaaggacatcatcatcgacctgggcgagatcagagagagagccctgcagagccccggcgtgaacagaagcctgttcctgatcaccctggagagatgcttccagatgctgaacagcctggagtgcgtggagatcctgggcaaggtgctgagaggcagcagcggcagcttcctgcagcccgacatcaccgagagactgcccagagacctgagagaggacgccttcaagaacctgagcgccgtgttcaaggacctgtacgacaagaccagcgcccacagccagagagccctgtacagctggatgaccggcatcctgcagaccagcagcaacgccaccgacgacagcgccagctgggtgagcgccgagcacctgtgggtgctgggcagatacatggtgcacctgagcttcgaggagatcaccaagatcagccccatcgagatcggcctgttcatcagctacgacaacgccaccaagcagctggacatggtgtacgacatcacccccgagctggcccaggccttcctggagagaatcagcagcagcaacttcaacatgagaaacaccagcaccatccacagactgggcctgctggtgtgcttctacaacgacctggagctgctggacgccaccgtggcccaggtgctgctgtaccagatgatcaagtgcagccacctgagaggcttccaggccggcgtgcagaagctgaaggccgagctgctggacatcgccatggagaaccagaccctgaacgagaccctgggcagcctgagcgacgccgtggtgggcctgacctacagccagctggagagcctgagccccgaggccgtgcacggcgccatcagcaccctgaaccaggtgagcggctgggccaagagccaggtgatcatcctgagcgccaagtacctggcccacgagaaggtgctgagcttctacaacgtgagccagatgggcgccctgctggccggcgtgagcacccaggccttctgcagcatgaagagaaaggacatcagccaggtgctgagaagcgccgtgagccagtacgtgagcgacctgagccccgcccagcagcagggcatcctgagcaagatggtgcaggccgaggacaccgcccccggcatcgtggagatccagggcgccttcttcaaggaggtgagcctgttcgacctgagaagacagcccggcttcaacagcaccgtgctgaaggacaaggagctgggcagaagccaggccctgttcctgtacgagctgctgctgaagaccaccagaagacccgaggagctgctgagcgccggccagctggtgaagggcgtgacctgcagccacatcgacgccatgagcaccgacttcttcctggcccacttccaggacttccagaacaacttcgccctgctgagcccctaccaggtgaactgcctggcctggaagtactgggaggtgagcagactgagcatgccccccttcctgctggccgccctgcccgccagatacctggccagcgtgcccgccagccagtgcgtgcccttcctgatcagcctgggcaagagctggctggacagcctggtgctggacagccacaagaagaccagcgtgctgagaaaggtgcagcagtgcctggacgacagcatcgccgacgagtacaccgtggacatcatgggcaacctgctgtgccacctgcccgccgccatcatcgacagaggcatcagccccagagcctgggccaccgccctgcacggcctgagagactgccccgacctgaaccccgagcagaaggccgccgtgagactgaagctgctgggccagtacggcctgccccagcactggaccgccgagaccaccaaggacctgggccccttcctggtgctgttcagcggcgacgagctgagcagcatcgccaccaagttccccgagatcctgctgcaggccgccagcaagatggccagaaccctgcccaccaaggagttcctgtgggccgtgttccagagcgtgagaaacagcagcgacaagatccccagctacgaccccatgcccggctgccacggcgtggtggcccccagcagcgacgacatcttcaagctggccgaggccaacgcctgctgggccctggaggacctgagatgcatggaggaggacaccttcatcagaaccgtggagctgctgggcgccgtgcagggcttcagcagaccccagctgatgaccctgaaggagaaggccatccaggtgtgggacatgcccagctactggagagagcaccacatcgtgagcctgggcagaatcgccctggccctgaacgagagcgagctggagcagctggacctgagcagcatcgacaccgtggccagcctgagctggcagaccgagtggacccccggccaggccgagagcatcctgcagggctacctggacgacagcggctacagcatccaggacctgaagagcttccacctggtgggcctgggcgccaccctgtgcgccatcaacatcaccgagatccccctgatcaagatcagcgagttcagagtggtggtggccagaatcggcaccctgctgtgcagcacccacgtgctggccgagttcaagagaaaggccgaggtggtgttcggcgaccccaccgagtggaccagcagcgtgctgcaggagctgggcaccatcgccgccggcctgaccaaggccgagctgagaatgctggacaaggacctgatgccctacttccagcccagcgccatcaagtgcctgcccgacgagatcttcaaggagctgagcgccgagcagatcgccagcctgggccccgagaacgccgccgccgtgacccacgcccagagaagaagactgagccccctgcagctgcagagcctgcagcaggccctggacggcgccaagacccacagctggcaggacgcccccgccagcgccggccccaccagaaccagcagcagcagaagccccgccggcgccctgcagagctggggcctgtggctgggctgccccctgctggtgctgatggccaagctgctgtggtag

SEQ ID NO: 92078 - DNA, 1434 bp, Artificial Sequence
  Description of Artificial Sequence: Synthetic coding sequence
atgatcgccttcctgctgaccagcgtgctgatgatcccccacgccggcggccaccccctggacaccccccacctgccccaggagctgccccccggcctgcccaacaacatcaacatcaccttcttcagcggcatgttcaagaacgtggagagcgtggccgagatcttcgactgcctgggcccccacttcacctggctgcaggccgtgttcaccaacttccccgtgctgatccagttcgtgaacggcatgaagtgcgtggccggcctgtgccccagagacttcgaggactacggctgcacctgcagattcgagatggagggcctgcccgtggacgagagcgacagctgctgcttccagcacagaagatgctacgaggaggccgccgagatggactgcctgcaggaccccgccaagctgagcaccgaggtgaactgcgtgagcaagaagatcatctgcgagagcaaggacaactgcgagcacctgctgtgcacctgcgacaaggccgccatcgagtgcctggccagaagcagcctgaacagcagcctgaacctgctggacaccagcttctgcctggcccagacccccgagaccaccatcaaggaggacctgaccaccctgctgcccagagtggtgcccgtggagcccaccgacaccagcctgaccgccctgagcggcgaggaggccggccacgaccaggagggcgtgggcgccgccagagccaccagcccccccggcagcgccgagatcgtggccaccagagtgaccgccaagatcgtgaccctggtgcccgccggcatcaagagcctgggcctggccgtgagcagcgtggagaacgaccccgaggagaccaccgagaaggcctgcgacagattcaccttcctgcacctgggcagcggcgacaacatgcaggtgatgccccagctgggcgagatgctgttctgcctgaccagcagatgccccgaggagttcgagagctacggctgctactgcggccaggagggcagaggcgagcccagagacgacctggacagatgctgcctgagccaccactgctgcctggagcaggtgagaagactgggctgcctgctggagagactgccctggagccccgtggtgtgcgtggaccacacccccaagtgcggcggccagagcctgtgcgagaagctgctgtgcgcctgcgaccagaccgccgccgagtgcatgaccagcgccagcttcaaccagagcctgaagagccccagcagactgggctgccccggccagcccgccgcctgcgaggacagcctgcaccccgtgcccgccgcccccaccctgggcagcagcagcgaggaggacagcgaggaggaccccccccaggaggacctgggcagagccaagagattcctgagaaagagcctgggccccctgggcatcggccccctgcacggcagatag

SEQ ID NO: 92079 - DNA, 1482 bp, Artificial Sequence
  Description of Artificial Sequence: Synthetic coding sequence
atgatcgccttcctgctgaccagcgtgctgatgatcccccacgccggcggccaccccctggacaccccccacctgccccaggagctgccccccggcctgcccaacaacatcaacatcaccttcttcagcggcatgttcaagaacgtggagagcgtggccgagatcttcgactgcctgggcccccacttcacctggctgcaggccgtgttcaccaacttccccgtgctgatccagttcgtgaacggcatgaagtgcgtggccggcctgtgccccagagacttcgaggactacggctgcacctgcagattcgagatggagggcctgcccgtggacgagagcgacagctgctgcttccagcacagaagatgctacgaggaggccgccgagatggactgcctgcaggaccccgccaagctgagcaccgaggtgaactgcgtgagcaagaagatcatctgcgagagcaaggacaactgcgagcacctgctgtgcacctgcgacaaggccgccatcgagtgcctggccagaagcagcctgaacagcagcctgaacctgctggacaccagcttctgcctggcccagacccccgagaccaccatcaaggaggacctgaccaccctgctgcccagagtggtgcccgtggagcccaccgacaccagcctgaccgccctgagcggcgaggtggccgccgagaccgaggccgacagactgatcaccctgagcaagaagaaggccggccacgaccaggagggcgtgggcgccgccagagccaccagcccccccggcagcgccgagatcgtggccaccagagtgaccgccaagatcgtgaccctggtgcccgccggcatcaagagcctgggcctggccgtgagcagcgtggagaacgaccccgaggagaccaccgagaaggcctgcgacagattcaccttcctgcacctgggcagcggcgacaacatgcaggtgatgccccagctgggcgagatgctgttctgcctgaccagcagatgccccgaggagttcgagagctacggctgctactgcggccaggagggcagaggcgagcccagagacgacctggacagatgctgcctgagccaccactgctgcctggagcaggtgagaagactgggctgcctgctggagagactgccctggagccccgtggtgtgcgtggaccacacccccaagtgcggcggccagagcctgtgcgagaagctgctgtgcgcctgcgaccagaccgccgccgagtgcatgaccagcgccagcttcaaccagagcctgaagagccccagcagactgggctgccccggccagcccgccgcctgcgaggacagcctgcaccccgtgcccgccgcccccaccctgggcagcagcagcgaggaggacagcgaggaggaccccccccaggaggacctgggcagagccaagagattcctgagaaagagcctgggccccctgggcatcggccccctgcacggcagatag

SEQ ID NO: 92080 - DNA, 5994 bp, Artificial Sequence
  Description of Artificial Sequence: Synthetic coding sequence
atggccctgctgatccacctgaagaccgtgagcgagctgagaggcagaggcgacagaatcgccaaggtgaccttcagaggccagagcttctacagcagagtgctggagaactgcgaggacgtggccgacttcgacgagaccttcagatggcccgtggccagcagcatcgacagaaacgagatgctggagatccaggtgttcaactacagcaaggtgttcagcaacaagctgatcggcaccttcagaatggtgctgcagaaggtggtggaggagagccacgtggaggtgaccgacaccctgatcgacgacaacaacgccatcatcaagaccagcctgtgcgtggaggtgagataccaggccaccgacggcaccgtgggcagctgggacgacggcgacttcctgggcgacgagagcctgcaggaggaggagaaggacagccaggagaccgacggcctgctgcccggcagcagacccagcagcagaccccccggcgagaagagcttcagaagagccggcagaagcgtgttcagcgccatgaagctgggcaagaacagaagccacaaggaggagccccagagacccgacgagcccgccgtgctggagatggaggacctggaccacctggccatcagactgggcgacggcctggaccccgacagcgtgagcctggccagcgtgaccgccctgaccaccaacgtgagcaacaagagaagcaagcccgacatcaagatggagcccagcgccggcagacccatggactaccaggtgagcatcaccgtgatcgaggccagacagctggtgggcctgaacatggaccccgtggtgtgcgtggaggtgggcgacgacaagaagtacaccagcatgaaggagagcaccaactgcccctactacaacgagtacttcgtgttcgacttccacgtgagccccgacgtgatgttcgacaagatcatcaagatcagcgtgatccacagcaagaacctgctgagaagcggcaccctggtgggcagcttcaagatggacgtgggcaccgtgtacagccagcccgagcaccagttccaccacaagtgggccatcctgagcgaccccgacgacatcagcagcggcctgaagggctacgtgaagtgcgacgtggccgtggtgggcaagggcgacaacatcaagaccccccacaaggccaacgagaccgacgaggacgacatcgagggcaacctgctgctgcccgagggcgtgccccccgagagacagtgggccagattctacgtgaagatctacagagccgagggcctgcccagaatgaacaccagcctgatggccaacgtgaagaaggccttcatcggcgagaacaaggacctggtggacccctacgtgcaggtgttcttcgccggccagaagggcaagaccagcgtgcagaagagcagctacgagcccctgtggaacgagcaggtggtgttcaccgacctgttcccccccctgtgcaagagaatgaaggtgcagatcagagacagcgacaaggtgaacgacgtggccatcggcacccacttcatcgacctgagaaagatcagcaacgacggcgacaagggcttcctgcccaccctgggccccgcctgggtgaacatgtacggcagcaccagaaactacaccctgctggacgagcaccaggacctgaacgagggcctgggcgagggcgtgagcttcagagccagactgctgctgggcctggccgtggagatcgtggacaccagcaaccccgagctgaccagcagcaccgaggtgcaggtggagcaggccacccccatcagcgagagctgcgccggcaagatggaggagttcttcctgttcggcgccttcctggaggccagcatgatcgacagaagaaacggcgacaagcccatcaccttcgaggtgaccatcggcaactacggcaacgaggtggacggcctgagcagaccccagagacccagacccagaaaggagcccggcgacgaggaggaggtggacctgatccagaacgccagcgacgacgaggccggcgacgccggcgacctggccagcgtgagcagcaccccccccatgagaccccaggtgaccgacagaaactacttccacctgccctacctggagagaaagccctgcatctacatcaagagctggtggcccgaccagagaagaagactgtacaacgccaacatcatggaccacatcgccgacaagctggaggagggcctgaacgacatccaggagatgatcaagaccgagaagagctaccccgagagaagactgagaggcgtgctggaggagctgagctgcggctgctgcagattcctgagcctggccgacaaggaccagggccacagcagcagaaccagactggacagagagagactgaagagctgcatgagagagctggagaacatgggccagcaggccagaatgctgagagcccaggtgaagagacacaccgtgagagacaagctgagactgtgccagaacttcctgcagaagctgagattcctggccgacgagccccagcacagcatccccgacatcttcatctggatgatgagcaacaacaagagagtggcctacgccagagtgcccagcaaggacctgctgttcagcatcgtggaggaggagaccggcaaggactgcgccaaggtgaagaccctgttcctgaagctgcccggcaagagaggcttcggcagcgccggctggaccgtgcaggccaaggtggagctgtacctgtggctgggcctgagcaagcagagaaaggagttcctgtgcggcctgccctgcggcttccaggaggtgaaggccgcccagggcctgggcctgcacgccttcccccccgtgagcctggtgtacaccaagaagcaggccttccagctgagagcccacatgtaccaggccagaagcctgttcgccgccgacagcagcggcctgagcgaccccttcgccagagtgttcttcatcaaccagagccagtgcaccgaggtgctgaacgagaccctgtgccccacctgggaccagatgctggtgttcgacaacctggagctgtacggcgaggcccacgagctgagagacgacccccccatcatcgtgatcgagatctacgaccaggacagcatgggcaaggccgacttcatgggcagaaccttcgccaagcccctggtgaagatggccgacgaggcctactgcccccccagattccccccccagctggagtactaccagatctacagaggcaacgccaccgccggcgacctgctggccgccttcgagctgctgcagatcggccccgccggcaaggccgacctgccccccatcaacggccccgtggacgtggacagaggccccatcatgcccgtgcccatgggcatcagacccgtgctgagcaagtacagagtggaggtgctgttctggggcctgagagacctgaagagagtgaacctggcccaggtggacagacccagagtggacatcgagtgcgccggcaagggcgtgcagagcagcctgatccacaactacaagaagaaccccaacttcaacaccctggtgaagtggttcgaggtggacctgcccgagaacgagctgctgcacccccccctgaacatcagagtggtggactgcagagccttcggcagatacaccctggtgggcagccacgccgtgagcagcctgagaagattcatctacagaccccccgacagaagcgcccccagctggaacaccaccgtgagactgctgagaagatgcagagtgctgtgcaacggcggcagcagcagccacagcaccggcgaggtggtggtgaccatggagcccgaggtgcccatcaagaagctggagaccatggtgaagctggacgccaccagcgaggccgtggtgaaggtggacgtggccgaggaggagaaggagaagaagaagaagaagaagggcaccgccgaggagcccgaggaggaggagcccgacgagagcatgctggactggtggagcaagtacttcgccagcatcgacaccatgaaggagcagctgagacagcaggagcccagcggcatcgacctggaggagaaggaggaggtggacaacaccgagggcctgaagggcagcatgaagggcaaggagaaggccagagccgccaaggaggagaagaagaagaagacccagagcagcggcagcggccagggcagcgaggcccccgagaagaagaagcccaagatcgacgagctgaaggtgtaccccaaggagctggagagcgagttcgacaacttcgaggactggctgcacaccttcaacctgctgagaggcaagaccggcgacgacgaggacggcagcaccgaggaggagagaatcgtgggcagattcaagggcagcctgtgcgtgtacaaggtgcccctgcccgaggacgtgagcagagaggccggctacgacagcacctacggcatgttccagggcatccccagcaacgaccccatcaacgtgctggtgagagtgtacgtggtgagagccaccgacctgcaccccgccgacatcaacggcaaggccgacccctacatcgccatcagactgggcaagaccgacatcagagacaaggagaactacatcagcaagcagctgaaccccgtgttcggcaagagcttcgacatcgaggccagcttccccatggagagcatgctgaccgtggccgtgtacgactgggacctggtgggcaccgacgacctgatcggcgagaccaagatcgacctggagaacagattctacagcaagcacagagccacctgcggcatcgcccagacctacagcacccacggctacaacatctggagagaccccatgaagcccagccagatcctgaccagactgtgcaaggacggcaaggtggacggcccccacttcggcccccccggcagagtgaaggtggccaacagagtgttcaccggccccagcgagatcgaggacgagaacggccagagaaagcccaccgacgagcacgtggccctgctggccctgagacactgggaggacatccccagagccggctgcagactggtgcccgagcacgtggagaccagacccctgctgaaccccgacaagcccggcatcgagcagggcagactggagctgtgggtggacatgttccccatggacatgcccgcccccggcacccccctggacatcagccccagaaagcccaagaagtacgagctgagagtgatcatctggaacaccgacgaggtggtgctggaggacgacgacttcttcaccggcgagaagagcagcgacatcttcgtgagaggctggctgaagggccagcaggaggacaagcaggacaccgacgtgcactaccacagcctgaccggcgagggcaacttcaactggagatacctgttccccttcgactacctggccgccgaggagaagatcgtgatcagcaagaaggagagcatgttcagctgggacgagaccgagtacaagatccccgccagactgaccctgcagatctgggacgccgaccacttcagcgccgacgacttcctgggcgccatcgagctggacctgaacagattccccagaggcgccaagaccgccaagcagtgcaccatggagatggccaccggcgaggtggacgtgcccctggtgagcatcttcaagcagaagagagtgaagggctggtggcccctgctggccagaaacgagaacgacgagttcgagctgaccggcaaggtggaggccgagctgcacctgctgaccgccgaggaggccgagaagaaccccgtgggcctggccagaaacgagcccgaccccctggagaagcccaacagacccgacaccagcttcatctggttcctgaaccccctgaagagcgccagatacttcctgtggcacacctacagatggctgctgctgaagctgctgctgctgctgctgctgctgctgctgctggccctgttcctgtacagcgtgcccggctacctggtgaagaagatcctgggcgcctag

SEQ ID NO: 92081 - DNA, 3693 bp, Artificial Sequence
  Description of Artificial Sequence: Synthetic coding sequence
atgatcaagaccgagaagagctaccccgagagaagactgagaggcgtgctggaggagctgagctgcggctgctgcagattcctgagcctggccgacaaggaccagggccacagcagcagaaccagactggacagagagagactgaagagctgcatgagagagctggagaacatgggccagcaggccagaatgctgagagcccaggtgaagagacacaccgtgagagacaagctgagactgtgccagaacttcctgcagaagctgagattcctggccgacgagccccagcacagcatccccgacatcttcatctggatgatgagcaacaacaagagagtggcctacgccagagtgcccagcaaggacctgctgttcagcatcgtggaggaggagaccggcaaggactgcgccaaggtgaagaccctgttcctgaagctgcccggcaagagaggcttcggcagcgccggctggaccgtgcaggccaaggtggagctgtacctgtggctgggcctgagcaagcagagaaaggagttcctgtgcggcctgccctgcggcttccaggaggtgaaggccgcccagggcctgggcctgcacgccttcccccccgtgagcctggtgtacaccaagaagcaggccttccagctgagagcccacatgtaccaggccagaagcctgttcgccgccgacagcagcggcctgagcgaccccttcgccagagtgttcttcatcaaccagagccagtgcaccgaggtgctgaacgagaccctgtgccccacctgggaccagatgctggtgttcgacaacctggagctgtacggcgaggcccacgagctgagagacgacccccccatcatcgtgatcgagatctacgaccaggacagcatgggcaaggccgacttcatgggcagaaccttcgccaagcccctggtgaagatggccgacgaggcctactgcccccccagattccccccccagctggagtactaccagatctacagaggcaacgccaccgccggcgacctgctggccgccttcgagctgctgcagatcggccccgccggcaaggccgacctgccccccatcaacggccccgtggacgtggacagaggccccatcatgcccgtgcccatgggcatcagacccgtgctgagcaagtacagagtggaggtgctgttctggggcctgagagacctgaagagagtgaacctggcccaggtggacagacccagagtggacatcgagtgcgccggcaagggcgtgcagagcagcctgatccacaactacaagaagaaccccaacttcaacaccctggtgaagtggttcgaggtggacctgcccgagaacgagctgctgcacccccccctgaacatcagagtggtggactgcagagccttcggcagatacaccctggtgggcagccacgccgtgagcagcctgagaagattcatctacagaccccccgacagaagcgcccccagctggaacaccaccggcgaggtggtggtgaccatggagcccgaggtgcccatcaagaagctggagaccatggtgaagctggacgccaccagcgaggccgtggtgaaggtggacgtggccgaggaggagaaggagaagaagaagaagaagaagggcaccgccgaggagcccgaggaggaggagcccgacgagagcatgctggactggtggagcaagtacttcgccagcatcgacaccatgaaggagcagctgagacagcaggagcccagcggcatcgacctggaggagaaggaggaggtggacaacaccgagggcctgaagggcagcatgaagggcaaggagaaggccagagccgccaaggaggagaagaagaagaagacccagagcagcggcagcggccagggcagcgaggcccccgagaagaagaagcccaagatcgacgagctgaaggtgtaccccaaggagctggagagcgagttcgacaacttcgaggactggctgcacaccttcaacctgctgagaggcaagaccggcgacgacgaggacggcagcaccgaggaggagagaatcgtgggcagattcaagggcagcctgtgcgtgtacaaggtgcccctgcccgaggacgtgagcagagaggccggctacgacagcacctacggcatgttccagggcatccccagcaacgaccccatcaacgtgctggtgagagtgtacgtggtgagagccaccgacctgcaccccgccgacatcaacggcaaggccgacccctacatcgccatcagactgggcaagaccgacatcagagacaaggagaactacatcagcaagcagctgaaccccgtgttcggcaagagcttcgacatcgaggccagcttccccatggagagcatgctgaccgtggccgtgtacgactgggacctggtgggcaccgacgacctgatcggcgagaccaagatcgacctggagaacagattctacagcaagcacagagccacctgcggcatcgcccagacctacagcacccacggctacaacatctggagagaccccatgaagcccagccagatcctgaccagactgtgcaaggacggcaaggtggacggcccccacttcggcccccccggcagagtgaaggtggccaacagagtgttcaccggccccagcgagatcgaggacgagaacggccagagaaagcccaccgacgagcacgtggccctgctggccctgagacactgggaggacatccccagagccggctgcagactggtgcccgagcacgtggagaccagacccctgctgaaccccgacaagcccggcatcgagcagggcagactggagctgtgggtggacatgttccccatggacatgcccgcccccggcacccccctggacatcagccccagaaagcccaagaagtacgagctgagagtgatcatctggaacaccgacgaggtggtgctggaggacgacgacttcttcaccggcgagaagagcagcgacatcttcgtgagaggctggctgaagggccagcaggaggacaagcaggacaccgacgtgcactaccacagcctgaccggcgagggcaacttcaactggagatacctgttccccttcgactacctggccgccgaggagaagatcgtgatcagcaagaaggagagcatgttcagctgggacgagaccgagtacaagatccccgccagactgaccctgcagatctgggacgccgaccacttcagcgccgacgacttcctgggcgccatcgagctggacctgaacagattccccagaggcgccaagaccgccaagcagtgcaccatggagatggccaccggcgaggtggacgtgcccctggtgagcatcttcaagcagaagagagtgaagggctggtggcccctgctggccagaaacgagaacgacgagttcgagctgaccggcaaggtggaggccgagctgcacctgctgaccgccgaggaggccgagaagaaccccgtgggcctggccagaaacgagcccgaccccctggagaagcccaacagacccgacaccagcttcatctggttcctgaaccccctgaagagcgccagatacttcctgtggcacacctacagatggctgctgctgaagctgctgctgctgctgctgctgctgctgctgctggccctgttcctgtacagcgtgcccggctacctggtgaagaagatcctgggcgcctag

SEQ ID NO: 92082 - DNA, 3693 bp, Artificial Sequence
  Description of Artificial Sequence: Synthetic coding sequence
atgatcaagaccgagaagagctaccccgagagaagactgagaggcgtgctggaggagctgagctgcggctgctgcagattcctgagcctggccgacaaggaccagggccacagcagcagaaccagactggacagagagagactgaagagctgcatgagagagctggagaacatgggccagcaggccagaatgctgagagcccaggtgaagagacacaccgtgagagacaagctgagactgtgccagaacttcctgcagaagctgagattcctggccgacgagccccagcacagcatccccgacatcttcatctggatgatgagcaacaacaagagagtggcctacgccagagtgcccagcaaggacctgctgttcagcatcgtggaggaggagaccggcaaggactgcgccaaggtgaagaccctgttcctgaagctgcccggcaagagaggcttcggcagcgccggctggaccgtgcaggccaaggtggagctgtacctgtggctgggcctgagcaagcagagaaaggagttcctgtgcggcctgccctgcggcttccaggaggtgaaggccgcccagggcctgggcctgcacgccttcccccccgtgagcctggtgtacaccaagaagcaggccttccagctgagagcccacatgtaccaggccagaagcctgttcgccgccgacagcagcggcctgagcgaccccttcgccagagtgttcttcatcaaccagagccagtgcaccgaggtgctgaacgagaccctgtgccccacctgggaccagatgctggtgttcgacaacctggagctgtacggcgaggcccacgagctgagagacgacccccccatcatcgtgatcgagatctacgaccaggacagcatgggcaaggccgacttcatgggcagaaccttcgccaagcccctggtgaagatggccgacgaggcctactgcccccccagattccccccccagctggagtactaccagatctacagaggcaacgccaccgccggcgacctgctggccgccttcgagctgctgcagatcggccccgccggcaaggccgacctgccccccatcaacggccccgtggacgtggacagaggccccatcatgcccgtgcccatgggcatcagacccgtgctgagcaagtacagagtggaggtgctgttctggggcctgagagacctgaagagagtgaacctggcccaggtggacagacccagagtggacatcgagtgcgccggcaagggcgtgcagagcagcctgatccacaactacaagaagaaccccaacttcaacaccctggtgaagtggttcgaggtggacctgcccgagaacgagctgctgcacccccccctgaacatcagagtggtggactgcagagccttcggcagatacaccctggtgggcagccacgccgtgagcagcctgagaagattcatctacagaccccccgacagaagcgcccccagctggaacaccaccggcgaggtggtggtgaccatggagcccgaggtgcccatcaagaagctggagaccatggtgaagctggacgccaccagcgaggccgtggtgaaggtggacgtggccgaggaggagaaggagaagaagaagaagaagaagggcaccgccgaggagcccgaggaggaggagcccgacgagagcatgctggactggtggagcaagtacttcgccagcatcgacaccatgaaggagcagctgagacagcaggagcccagcggcatcgacctggaggagaaggaggaggtggacaacaccgagggcctgaagggcagcatgaagggcaaggagaaggccagagccgccaaggaggagaagaagaagaagacccagagcagcggcagcggccagggcagcgaggcccccgagaagaagaagcccaagatcgacgagctgaaggtgtaccccaaggagctggagagcgagttcgacaacttcgaggactggctgcacaccttcaacctgctgagaggcaagaccggcgacgacgaggacggcagcaccgaggaggagagaatcgtgggcagattcaagggcagcctgtgcgtgtacaaggtgcccctgcccgaggacgtgagcagagaggccggctacgacagcacctacggcatgttccagggcatccccagcaacgaccccatcaacgtgctggtgagagtgtacgtggtgagagccaccgacctgcaccccgccgacatcaacggcaaggccgacccctacatcgccatcagactgggcaagaccgacatcagagacaaggagaactacatcagcaagcagctgaaccccgtgttcggcaagagcttcgacatcgaggccagcttccccatggagagcatgctgaccgtggccgtgtacgactgggacctggtgggcaccgacgacctgatcggcgagaccaagatcgacctggagaacagattctacagcaagcacagagccacctgcggcatcgcccagacctacagcacccacggctacaacatctggagagaccccatgaagcccagccagatcctgaccagactgtgcaaggacggcaaggtggacggcccccacttcggcccccccggcagagtgaaggtggccaacagagtgttcaccggccccagcgagatcgaggacgagaacggccagagaaagcccaccgacgagcacgtggccctgctggccctgagacactgggaggacatccccagagccggctgcagactggtgcccgagcacgtggagaccagacccctgctgaaccccgacaagcccggcatcgagcagggcagactggagctgtgggtggacatgttccccatggacatgcccgcccccggcacccccctggacatcagccccagaaagcccaagaagtacgagctgagagtgatcatctggaacaccgacgaggtggtgctggaggacgacgacttcttcaccggcgagaagagcagcgacatcttcgtgagaggctggctgaagggccagcaggaggacaagcaggacaccgacgtgcactaccacagcctgaccggcgagggcaacttcaactggagatacctgttccccttcgactacctggccgccgaggagaagatcgtgatcagcaagaaggagagcatgttcagctgggacgagaccgagtacaagatccccgccagactgaccctgcagatctgggacgccgaccacttcagcgccgacgacttcctgggcgccatcgagctggacctgaacagattccccagaggcgccaagaccgccaagcagtgcaccatggagatggccaccggcgaggtggacgtgcccctggtgagcatcttcaagcagaagagagtgaagggctggtggcccctgctggccagaaacgagaacgacgagttcgagctgaccggcaaggtggaggccgagctgcacctgctgaccgccgaggaggccgagaagaaccccgtgggcctggccagaaacgagcccgaccccctggagaagcccaacagacccgacaccgccttcgtgtggttcctgaaccccctgaagagcatcaagtacctgatctgcaccagatacaagtggctgatcatcaagatcgtgctggccctgctgggcctgctgatgctgggcctgttcctgtacagcctgcccggctacatggtgaagaagctgctgggcgcctag

SEQ ID NO: 92083 - DNA, 234 bp, Artificial Sequence
  Description of Artificial Sequence: Synthetic coding sequence
gaggccgagaagaaccccgtgggcctggccagaaacgagcccgaccccctggagaagcccaacagacccgacaccgccttcgtgtggttcctgaaccccctgaagagcatcaagtacctgatctgcaccagatacaagtggctgatcatcaagatcgtgctggccctgggctgcagctgctggggccccctgcagcccccctggctgcacggccagaaggccccctggggctag

SEQ ID NO: 92084 - DNA, 342 bp, Artificial Sequence
  Description of Artificial Sequence: Synthetic coding sequence
gacttcctgggcgacgagagcctgcaggaggaggagaaggacagccaggagaccgacggcctgctgcccggcagcagacccagcagcagaccccccggcgagaagagcttcagaagcaagggcagagagaagaccaagggcggcagagacgacgagcacaaggccggcagaagcgtgttcagcgccatgaagctgggcaagaacagaagccacaaggaggagccccagagacccgacgagcccgccgtgctggagatggaggacctggaccacctggccatcagactgggcgacggcctggaccccgacagcgtgagcctggccagcgtgaccgccctgtag

SEQ ID NO: 92085 - DNA, 3924 bp, Artificial Sequence
  Description of Artificial Sequence: Synthetic coding sequence
atgatgaccgacacccaggacggccccagcgagagcagccagatcatgagaagcctgacccccctgatcaacagagaggaggccttcggcgaggccggcgaggccggcctgtggcccagcatcacccacacccccgacagccaggaggagggcctgaacgacatccaggagatgatcaagaccgagaagagctaccccgagagaagactgagaggcgtgctggaggagctgagctgcggctgctgcagattcctgagcctggccgacaaggaccagggccacagcagcagaaccagactggacagagagagactgaagagctgcatgagagagctggagaacatgggccagcaggccagaatgctgagagcccaggtgaagagacacaccgtgagagacaagctgagactgtgccagaacttcctgcagaagctgagattcctggccgacgagccccagcacagcatccccgacatcttcatctggatgatgagcaacaacaagagagtggcctacgccagagtgcccagcaaggacctgctgttcagcatcgtggaggaggagaccggcaaggactgcgccaaggtgaagaccctgttcctgaagctgcccggcaagagaggcttcggcagcgccggctggaccgtgcaggccaaggtggagctgtacctgtggctgggcctgagcaagcagagaaaggagttcctgtgcggcctgccctgcggcttccaggaggtgaaggccgcccagggcctgggcctgcacgccttcccccccgtgagcctggtgtacaccaagaagcaggccttccagctgagagcccacatgtaccaggccagaagcctgttcgccgccgacagcagcggcctgagcgaccccttcgccagagtgttcttcatcaaccagagccagtgcaccgaggtgctgaacgagaccctgtgccccacctgggaccagatgctggtgttcgacaacctggagctgtacggcgaggcccacgagctgagagacgacccccccatcatcgtgatcgagatctacgaccaggacagcatgggcaaggccgacttcatgggcagaaccttcgccaagcccctggtgaagatggccgacgaggcctactgcccccccagattccccccccagctggagtactaccagatctacagaggcaacgccaccgccggcgacctgctggccgccttcgagctgctgcagatcggccccgccggcaaggccgacctgccccccatcaacggccccgtggacgtggacagaggccccatcatgcccgtgcccatgggcatcagacccgtgctgagcaagtacagagtggaggtgctgttctggggcctgagagacctgaagagagtgaacctggcccaggtggacagacccagagtggacatcgagtgcgccggcaagggcgtgcagagcagcctgatccacaactacaagaagaaccccaacttcaacaccctggtgaagtggttcgaggtggacctgcccgagaacgagctgctgcacccccccctgaacatcagagtggtggactgcagagccttcggcagatacaccctggtgggcagccacgccgtgagcagcctgagaagattcatctacagaccccccgacagaagcgcccccagctggaacaccaccgtgagactgctgagaagatgcagagtgctgtgcaacggcggcagcagcagccacagcaccggcgaggtggtggtgaccatggagcccgaggtgcccatcaagaagctggagaccatggtgaagctggacgccaccagcgaggccgtggtgaaggtggacgtggccgaggaggagaaggagaagaagaagaagaagaagggcaccgccgaggagcccgaggaggaggagcccgacgagagcatgctggactggtggagcaagtacttcgccagcatcgacaccatgaaggagcagctgagacagcaggagcccagcggcatcgacctggaggagaaggaggaggtggacaacaccgagggcctgaagggcagcatgaagggcaaggagaaggccagagccgccaaggaggagaagaagaagaagacccagagcagcggcagcggccagggcagcgaggcccccgagaagaagaagcccaagatcgacgagctgaaggtgtaccccaaggagctggagagcgagttcgacaacttcgaggactggctgcacaccttcaacctgctgagaggcaagaccggcgacgacgaggacggcagcaccgaggaggagagaatcgtgggcagattcaagggcagcctgtgcgtgtacaaggtgcccctgcccgaggacgtgagcagagaggccggctacgacagcacctacggcatgttccagggcatccccagcaacgaccccatcaacgtgctggtgagagtgtacgtggtgagagccaccgacctgcaccccgccgacatcaacggcaaggccgacccctacatcgccatcagactgggcaagaccgacatcagagacaaggagaactacatcagcaagcagctgaaccccgtgttcggcaagagcttcgacatcgaggccagcttccccatggagagcatgctgaccgtggccgtgtacgactgggacctggtgggcaccgacgacctgatcggcgagaccaagatcgacctggagaacagattctacagcaagcacagagccacctgcggcatcgcccagacctacagcacccacggctacaacatctggagagaccccatgaagcccagccagatcctgaccagactgtgcaaggacggcaaggtggacggcccccacttcggcccccccggcagagtgaaggtggccaacagagtgttcaccggccccagcgagatcgaggacgagaacggccagagaaagcccaccgacgagcacgtggccctgctggccctgagacactgggaggacatccccagagccggctgcagactggtgcccgagcacgtggagaccagacccctgctgaaccccgacaagcccggcatcgagcagggcagactggagctgtgggtggacatgttccccatggacatgcccgcccccggcacccccctggacatcagccccagaaagcccaagaagtacgagctgagagtgatcatctggaacaccgacgaggtggtgctggaggacgacgacttcttcaccggcgagaagagcagcgacatcttcgtgagaggctggctgaagggccagcaggaggacaagcaggacaccgacgtgcactaccacagcctgaccggcgagggcaacttcaactggagatacctgttccccttcgactacctggccgccgaggagaagatcgtgatcagcaagaaggagagcatgttcagctgggacgagaccgagtacaagatccccgccagactgaccctgcagatctgggacgccgaccacttcagcgccgacgacttcctgggcgccatcgagctggacctgaacagattccccagaggcgccaagaccgccaagcagtgcaccatggagatggccaccggcgaggtggacgtgcccctggtgagcatcttcaagcagaagagagtgaagggctggtggcccctgctggccagaaacgagaacgacgagttcgagctgaccggcaaggtggaggccgagctgcacctgctgaccgccgaggaggccgagaagaaccccgtgggcctggccagaaacgagcccgaccccctggagaagcccaacagacccgacaccagcttcatctggttcctgaaccccctgaagagcgccagatacttcctgtggcacacctacagatggctgctgctgaagctgctgctgctgctgctgctgctgctgctgctggccctgttcctgtacagcgtgcccggctacctggtgaagaagatcctgggcgcctag

SEQ ID NO: 92086 - DNA, 4527 bp, Artificial Sequence
  Description of Artificial Sequence: Synthetic coding sequence
atgttccccgccagaggcgtgcccctgcacctggagggcgagggcgtgttcccctggggccccggcgacgtgagcctgccctacctgagcaccagcgacgtgagcttcagcgtgatcgtggagaacgtgaactgctacagcagcggcatgatctgcagaaagttcatcagcatcaacgtgggcaacagcctgatcgtgttcgacgacgacagcggcaaccccagccccgagagcttcctggacgacaagcaggaggtgcacacctggagagtgggcttcttcaccctggtgcacttcccccaggagcacatcaccctgctgtgggaccagagaaccaccgtgcacgtgcaggccggcccccagtggcagggccagctggccggcctgtgcggcaacttcgacctgaagaccatcaacgagatgagaacccccgagaacctggagctgaccaacccccaggagttcggcagcagctgggccgccgtggagtgccccgacaccctggaccccagagacatgtgcgtgctgaaccccctgagagagcccttcgccaagaaggagtgcagcatcctgctgagcgaggtgttcgagatctgccaccccgtggtggacgtgacctggttctacagcaactgcctgaccgacacctgcggctgcagccagggcggcgactgcgagtgcttctgcgccagcgtgagcgcctacgcccaccagtgctgccagcacggcgtggccgtggactggagaacccccagactgtgcctgctgggcaagggcccctaccagctgagcagcctggccgccggcggcgccctggtgggcatgaaggccgtgggcgacgacatcgtgctggtgagaaccgaggacgtggcccccgccgacatcgtgagcttcctgctgaccgccgccctgtacaaggccaaggcccacgaccccgacgtggtgagcctggaggccgccgacagacccaacttcttcctgcacgtgaccgccaacggcagcctggagctggccaagtggcagggcagagacaccttccagcagcacgccagcttcctgctgcacagaggcaccagacaggccggcctggtggccctggagagcctggccaagcccagcagcttcctgtacgtgagcggcgccgtgctggccctgagactgtacgagcacaccgaggtgttcagaagaggcaccctgttcagactgctggacgccaagcccagcggcgccgcctaccccatctgcgagtggagatacgacgcctgcgccagcccctgcttccagacctgcagagaccccagagccgccagctgcagagacgtgcccagagtggagggctgcgtgcccgtgtgccccaccccccaggtgctggacgaggtgacccagagatgcgtgtacctggaggactgcgtggagcccgccgtgtgggtgcccaccgaggccctgggcaacgagaccctgccccccagccagggcctgcccacccccagcgacgaggagccccagctgagccaggagagccccagaacccccacccacagacccgccctgacccccgccgcccccctgaccaccgccctgaacccccccgtgaccgccaccgaggagcccgtggtgagccccggccccacccagaccaccctgcagcagcccctggagctgaccgccagccagctgcccgccggccccaccgagagccccgccagcaagggcgtgaccgccagcctgctggccatcccccacacccccgagagcagcagcctgcccgtggccctgcagacccccacccccggcatggtgagcggcgccatggagaccaccagagtgaccgtgatcttcgccggcagccccaacatcaccgtgagcagcagaagcccccccgcccccagattccccctgatgaccaaggccgtgaccgtgagaggccacggcagcctgcccgtgagaaccacccccccccagcccagcctgaccgccagccccagcagcagacccgtggccagccccggcgccatcagcagaagccccaccagcagcggcagccacaaggccgtgctgacccccgccgtgaccaaggtgatcagcagaaccggcgtgccccagcccacccaggcccagagcgccagcagccccagcacccccctgaccgtggccggcaccgccgccgagcaggtgcccgtgagccccctggccaccagaagcctggagatcgtgctgagcaccgagaagggcgaggccggccacagccagcccatgggcagccccgccagcccccagccccaccccctgcccagcgccccccccagacccgcccagcacaccaccatggccaccagaagccccgccctgccccccgagacccccgccgccgccagcctgagcaccgccaccgacggcctggccgccacccccttcatgagcctggagagcaccagacccagccagctgctgagcggcctgccccccgacaccagcctgcccctggccaaggtgggcaccagcgcccccgtggccacccccggccccaaggccagcgtgatcaccacccccctgcagccccaggccaccaccctgcccgcccagaccctgagccccgtgctgcccttcacccccgccgccatgacccaggcccacccccccacccacatcgccccccccgccgccggcaccgcccccggcctgctgctgggcgccaccctgcccaccagcggcgtgctgcccgtggccgagggcaccgccagcatggtgagcgtggtgcccagaaagagcaccaccggcaaggtggccatcctgagcaagcaggtgagcctgcccaccagcatgtacggcagcgccgagggcggccccaccgagctgacccccgccaccagccaccccctgacccccctggtggccgagcccgagggcgcccaggccggcaccgccctgcccgtgcccaccagctacgccctgagcagagtgagcgccagaaccgccccccaggacagcatgctggtgctgctgccccagctggccgaggcccacggcaccagcgccggcccccacctggccgccgagcccgtggacgaggccaccaccgagcccagcggcagaagcgcccccgccctgagcatcgtggagggcctggccgaggccctggccaccaccaccgaggccaacaccagcaccacctgcgtgcccatcgccgagcaggactgcgtgagacacatctgcctggagggccagctgatcagagtgaaccagagccagcactgcccccagggcgccgccccccccagatgcggcatcctgggcctggccgtgagagtgggcggcgacagatgctgccccctgtgggagtgcgcctgcagatgcagcatcttccccgacctgagcttcgtgaccttcgacggcagccacgtggccctgttcaaggaggccatctacatcctgagccagagccccgacgagatgctgaccgtgcacgtgctggactgcaagagcgccaacctgggccacctgaactggccccccttctgcctggtgatgctgaacatgacccacctggcccaccaggtgaccatcgacagattcaacagaaaggtgaccgtggacctgcagcccgtgtggccccccgtgagcagatacggcttcagaatcgaggacaccggccacatgtacatgatcctgacccccagcgacatccagatccagtggctgcacagcagcggcctgatgatcgtggaggccagcaagaccagcaaggcccagggccacggcctgtgcggcatctgcgacggcgacgccgccaacgacctgaccctgaaggacggcagcgtggtgggcggcgccgaggaccccgcccccttcctggacagctggcaggtgcccagcagcctgaccagcgtgggccagaccagattcagacccgacagctgcgccaccaccgactgcagcccctgcctgagaatggtgagcaacagaaccttcagcgcctgccacagattcgtgccccccgagagcttctgcgagctgtggatcagagacaccaagtacgtgcagcagccctgcgtggccctgaccgtgtacgtggccatgtgccacaagttccacgtgtgcatcgagtggagaagaagcgactactgccccttcctgtgcagcagcgacagcacctaccaggcctgcgtgaccgcctgcgagccccccaagacctgccaggacggcatcctgggccccctggaccccgagcactgccaggtgctgggcgagggctgcgtgtgcagcgagggcaccatcctgcacagaagacacagcgccctgtgcatccccgaggccaagtgcgcctgcggcgactgccccgacagcatccccgagtgccaggagggcgaggccctgaccgtgcacagaaacaccaccgagctgtgctgccccctgtaccagtgcgtgtgcgagaacttcagatgcccccaggtgcagtgcggcctgggcaccgccctggtggaggtgtggagccccgacagatgctgcccctacaagagctgcggctag

SEQ ID NO: 92087 - DNA, 8778 bp, Artificial Sequence
  Description of Artificial Sequence: Synthetic coding sequence
atgggcgtgctggccagcgccctgtgctggctgctgtgcgtgtggctgccctggggcgagcaggccgccgagagcctgagagtgcagagactgggcgagagagtggtggacagcggcagaagcggcgccagaggcatgagaaacgtgaagggcatgagaaacggccccgcccagaccagagtgagcagcagcagcagccaccaggaggccaccctggccatgggcgacaaggccaccgtggtgggcggccagcaggccgaggcccccgacagcgtggccatgagcagctgggagagaagactgcacagagccaagtgcgcccccagctacctgttcagctgcttcaacggcggcgagtgcgtgcaccccgccttctgcgactgcagaagattcaacgccaccggccccagatgccagatggtgtacaacgccggccccgagagagacagcatctgcagagcctggggccagcaccacgtggagaccttcgacggcctgtactactacctgagcggcaagggcagctacaccctggtgggcagacacgagcccgagggccagagcttcagcatccaggtgcacaacgacccccagtgcggcagcagcccctacacctgcagcagagccgtgagcctgttcttcgtgggcgagcaggagatccacctggccaaggaggtgacccacggcggcatgagagtgcagctgccccacgtgatgggcagcgccagactgcagcagctggccggctacgtgatcgtgagacaccagagcgccttcaccctggcctgggacggcgccagcgccgtgtacatcaagatgagccccgagctgctgggctggacccacggcctgtgcggcaacaacaacgccgaccccaaggacgacctggtgaccagcagcggcaagctgaccgacgacgtggtggagttcgtgcacagctggcaggagcaggcccccaaccagccccccggccccaccaccagcagcctgcccagacccccctgcctgcagcagaaccccggcaccatgcagggcgtgtacgagcagtgcgaggccctgctgagaccccccttcgacgcctgccacgcctacgtgagccccctgcccttcaccgccagctgcaccagcgacctgtgccagagcatgggcgacgtggccacctggtgcagagccctggccgagtacgccagagcctgcgcccaggccggcagacccctgcagggctggagaacccagctgagacagtgcaccgtgcactgcaaggagaaggccttcacctacaacgagtgcatcgcctgctgccccgccagctgccaccccagagccagctgcgtggacagcgagatcgcctgcgtggacggctgctactgccccaacggcctgatcttcgaggacggcggctgcgtggcccccgccgagtgcccctgcgagttccacggcaccctgtacccccccggcagcgtggtgaaggaggactgcaacacctgcacctgcaccagcggcaagtgggagtgcagcaccgccgtgtgccccgccgagtgcagcgtgaccggcgacatccacttcaccaccttcgacggcagaagatacaccttccccgccacctgccagtacatcctggccaagagcagaagcagcggcaccttcaccgtgaccctgcagaacgccccctgcggcctgaaccaggacggcgcctgcgtgcagagcgtgagcgtgatcctgcaccaggaccccagaagacaggtgaccctgacccaggccggcgacgtgctgctgttcgaccagtacaagatcatccccccctacaccgacgacgccttcgagatcagaagactgagcagcgtgttcctgagagtgagaaccaacgtgggcgtgagagtgctgtacgacagagagggcctgagactgtacctgcaggtggaccagagatgggtggaggacaccgtgggcctgtgcggcaccttcaacggcaacacccaggacgacttcctgagccccgtgggcgtgcccgagagcaccccccagctgttcggcaacagctggaagaccctgagcgcctgcagccccctggtgagcggcagccccctggacccctgcgacgtgcacctgcaggccgccagctacagcgtgcaggcctgcagcgtgctgaccggcgagatgttcgccccctgcagcgccttcctgagccccgtgccctacttcgagcagtgcagaagagacgcctgcagatgcggccagccctgcctgtgcgccaccctggcccactacgcccacctgtgcagaagacacggcctgcccgtggacttcagagccagactgcccgcctgcgccctgagctgcgaggccagcaaggagtacagcccctgcgtggccccctgcggcagaacctgccaggacctggccagccccgaggcctgcggcgtggacggcggcgacgacctgagcagagacgagtgcgtggagggctgcgcctgcccccccgacacctacctggacacccaggccgacctgtgcgtgcccagaaaccagtgcagctgccacttccagggcgtggactacccccccggcgacagcgacatccccagcctgggccactgccactgcaaggacggcgtgatgagctgcgacagcagagcccccgccgccgcctgccccgccggccaggtgttcgtgaactgcagcgacctgcacaccgacctggagctgagcagagagagaacctgcgagcagcagctgctgaacctgagcgtgagcgccagaggcccctgcctgagcggctgcgcctgcccccagggcctgctgagacacggcgacgcctgcttcctgcccgaggagtgcccctgcacctggaagggcaaggagtacttccccggcgaccaggtgatgagcccctgccacacctgcgtgtgccagagaggcagcttccagtgcaccctgcacccctgcgccagcacctgcaccgcctacggcgacagacactacagaaccttcgacggcctgcccttcgacttcgtgggcgcctgcaaggtgcacctggtgaagagcaccagcgacgtgagcttcagcgtgatcgtggagaacgtgaactgctacagcagcggcatgatctgcagaaagttcatcagcatcaacgtgggcaacagcctgatcgtgttcgacgacgacagcggcaaccccagccccgagagcttcctggacgacaagcaggaggtgcacacctggagagtgggcttcttcaccctggtgcacttcccccaggagcacatcaccctgctgtgggaccagagaaccaccgtgcacgtgcaggccggcccccagtggcagggccagctggccggcctgtgcggcaacttcgacctgaagaccatcaacgagatgagaacccccgagaacctggagctgaccaacccccaggagttcggcagcagctgggccgccgtggagtgccccgacaccctggaccccagagacatgtgcgtgctgaaccccctgagagagcccttcgccaagaaggagtgcagcatcctgctgagcgaggtgttcgagatctgccaccccgtggtggacgtgacctggttctacagcaactgcctgaccgacacctgcggctgcagccagggcggcgactgcgagtgcttctgcgccagcgtgagcgcctacgcccaccagtgctgccagcacggcgtggccgtggactggagaacccccagactgtgcccctacgactgcgacttcttcaacaaggtgctgggcaagggcccctaccagctgagcagcctggccgccggcggcgccctggtgggcatgaaggccgtgggcgacgacatcgtgctggtgagaaccgaggacgtggcccccgccgacatcgtgagcttcctgctgaccgccgccctgtacaaggccaaggcccacgaccccgacgtggtgagcctggaggccgccgacagacccaacttcttcctgcacgtgaccgccaacggcagcctggagctggccaagtggcagggcagagacaccttccagcagcacgccagcttcctgctgcacagaggcaccagacaggccggcctggtggccctggagagcctggccaagcccagcagcttcctgtacgtgagcggcgccgtgctggccctgagactgtacgagcacaccgaggtgttcagaagaggcaccctgttcagactgctggacgccaagcccagcggcgccgcctaccccatctgcgagtggagatacgacgcctgcgccagcccctgcttccagacctgcagagaccccagagccgccagctgcagagacgtgcccagagtggagggctgcgtgcccgtgtgccccaccccccaggtgctggacgaggtgacccagagatgcgtgtacctggaggactgcgtggagcccgccgtgtgggtgcccaccgaggccctgggcaacgagaccctgccccccagccagggcctgcccacccccagcgacgaggagccccagctgagccaggagagccccagaacccccacccacagacccgccctgacccccgccgcccccctgaccaccgccctgaacccccccgtgaccgccaccgaggagcccgtggtgagccccggccccacccagaccaccctgcagcagcccctggagctgaccgccagccagctgcccgccggccccaccgagagccccgccagcaagggcgtgaccgccagcctgctggccatcccccacacccccgagagcagcagcctgcccgtggccctgcagacccccacccccggcatggtgagcggcgccatggagaccaccagagtgaccgtgatcttcgccggcagccccaacatcaccgtgagcagcagaagcccccccgcccccagattccccctgatgaccaaggccgtgaccgtgagaggccacggcagcctgcccgtgagaaccacccccccccagcccagcctgaccgccagccccagcagcagacccgtggccagccccggcgccatcagcagaagccccaccagcagcggcagccacaaggccgtgctgacccccgccgtgaccaaggtgatcagcagaaccggcgtgccccagcccacccaggcccagagcgccagcagccccagcacccccctgaccgtggccggcaccgccgccgagcaggtgcccgtgagccccctggccaccagaagcctggagatcgtgctgagcaccgagaagggcgaggccggccacagccagcccatgggcagccccgccagcccccagccccaccccctgcccagcgccccccccagacccgcccagcacaccaccatggccaccagaagccccgccctgccccccgagacccccgccgccgccagcctgagcaccgccaccgacggcctggccgccacccccttcatgagcctggagagcaccagacccagccagctgctgagcggcctgccccccgacaccagcctgcccctggccaaggtgggcaccagcgcccccgtggccacccccggccccaaggccagcgtgatcaccacccccctgcagccccaggccaccaccctgcccgcccagaccctgagccccgtgctgcccttcacccccgccgccatgacccaggcccacccccccacccacatcgccccccccgccgccggcaccgcccccggcctgctgctgggcgccaccctgcccaccagcggcgtgctgcccgtggccgagggcaccgccagcatggtgagcgtggtgcccagaaagagcaccaccggcaaggtggccatcctgagcaagcaggtgagcctgcccaccagcatgtacggcagcgccgagggcggccccaccgagctgacccccgccaccagccaccccctgacccccctggtggccgagcccgagggcgcccaggccggcaccgccctgcccgtgcccaccagctacgccctgagcagagtgagcgccagaaccgccccccaggacagcatgctggtgctgctgccccagctggccgaggcccacggcaccagcgccggcccccacctggccgccgagcccgtggacgaggccaccaccgagcccagcggcagaagcgcccccgccctgagcatcgtggagggcctggccgaggccctggccaccaccaccgaggccaacaccagcaccacctgcgtgcccatcgccgagcaggactgcgtgagacacatctgcctggagggccagctgatcagagtgaaccagagccagcactgcccccagggcgccgccccccccagatgcggcatcctgggcctggccgtgagagtgggcggcgacagatgctgccccctgtgggagtgcgcctgcagatgcagcatcttccccgacctgagcttcgtgaccttcgacggcagccacgtggccctgttcaaggaggccatctacatcctgagccagagccccgacgagatgctgaccgtgcacgtgctggactgcaagagcgccaacctgggccacctgaactggccccccttctgcctggtgatgctgaacatgacccacctggcccaccaggtgaccatcgacagattcaacagaaaggtgaccgtggacctgcagcccgtgtggccccccgtgagcagatacggcttcagaatcgaggacaccggccacatgtacatgatcctgacccccagcgacatccagatccagtggctgcacagcagcggcctgatgatcgtggaggccagcaagaccagcaaggcccagggccacggcctgtgcggcatctgcgacggcgacgccgccaacgacctgaccctgaaggacggcagcgtggtgggcggcgccgaggaccccgcccccttcctggacagctggcaggtgcccagcagcctgaccagcgtgggccagaccagattcagacccgacagctgcgccaccaccgactgcagcccctgcctgagaatggtgagcaacagaaccttcagcgcctgccacagattcgtgccccccgagagcttctgcgagctgtggatcagagacaccaagtacgtgcagcagccctgcgtggccctgaccgtgtacgtggccatgtgccacaagttccacgtgtgcatcgagtggagaagaagcgactactgccccttcctgtgcagcagcgacagcacctaccaggcctgcgtgaccgcctgcgagccccccaagacctgccaggacggcatcctgggccccctggaccccgagcactgccaggtgctgggcgagggctgcgtgtgcagcgagggcaccatcctgcacagaagacacagcgccctgtgcatccccgaggccaagtgcgcctgcaccgacagcatgggcgtgcccagagccctgggcgagacctggaacagcagcctgagcggctgctgccagcaccagtgccaggcccccgacaccatcgtgcccgtggacctgggctgccccagccccagacccgagagctgcctgagattcggcgaggtggccctgctgctgcccaccaaggacccctgctgcctgggcaccgtgtgcgtgtgcaaccagaccctgtgcgagggcctggcccccacctgcagacccggccacagactgctgacccacttccaggaggacagctgctgccccagctacagctgcgagtgcgaccccgacctgtgcgaggccgagctggtgcccagctgcagacaggaccagatcctgatcaccggcagactgggcgacagctgctgcaccagctacttctgcgcctgcggcgactgccccgacagcatccccgagtgccaggagggcgaggccctgaccgtgcacagaaacaccaccgagctgtgctgccccctgtaccagtgcgtgtgcgagaacttcagatgcccccaggtgcagtgcggcctgggcaccgccctggtggaggtgtggagccccgacagatgctgcccctacaagagctgcgagtgcgactgcgacaccatccccgtgcccagatgccacctgtgggagaagagccagctggacgaggagttcatgcacagcgtggagaacgtgtgcggctgcgccaagtacgagtgcgtgaaggcccccgtgtgcctgagcagagagctgggcgtgatgcagcccggccagaccgtggtggagctgagcgccgacggcgtgtgccacaccagcagatgcaccaccgtgctggaccccctgaccaacttctaccagatcaacaccaccagcgtgctgtgcgacatccactgcgaggccaaccaggagtacgagcaccccagagacctggccgcctgctgcggcagctgcagaaacgtgagctgcctgttcaccttccccaacggcaccaccagcctgttcctgcccggcgccagctggatcgccgactgcgccagacaccactgcagcagcacccccctgggcgccgtgctggtgagaagccccatcagctgcccccccctgaacgagaccgagtgcgccaaggtgggcggcagcgtggtgcccagcctggagggctgctgcagaacctgcaaggaggacggcagaagctgcaagaaggtgaccatcagaatgaccatcagaaagaacgagtgcagaagcagcacccccgtgaacctggtgagctgcgacggcagatgccccagcgccagcatctacaactacaacatcaacacctacgccagattctgcaagtgctgcagagaggtgggcctgcagagaagaagcgtgcagctgttctgcgccaccaacgccacctgggtgccctacaccgtgcaggagcccaccgactgcgcctgccagtggagctag

SEQ ID NO: 92088 - DNA, 387 bp, Artificial Sequence
  Description of Artificial Sequence: Synthetic coding sequence
atggccagaatcctgctgctgttcctgcccggcctggtggccgtgtgcgccgtgcacggcatcttcatggacagactggccagcaagaagctgtgcgccgacgacgagtgcgtgtacaccatcagcctggccagcgcccaggaggactacaacgcccccgactgcagattcatcaacgtgaagaagggccagcagatctacgtgtacagcaagctggtgaaggagaacggcgccggcgagttctgggccggcagcgtgtacggcgacggccaggacgagatgggcgtggtgggctacttccccagaaacctggtgaaggagcagagagtgtaccaggaggccaccaaggaggtgcccaccaccgacatcgacttcttctgcgagtag

SEQ ID NO: 92089 - DNA, 1446 bp, Artificial Sequence
  Description of Artificial Sequence: Synthetic coding sequence
atgcagctgtacagcagcgtgtgcacccactaccccgccggcgcccccggccccaccgccgccgcccccgccccccccgccgccgccacccccttcaaggtgagcctgcagccccccggcgccgccggcgccgcccccgagcccgagaccggcgagtgccagcccgccgccgccgccgagcacagagaggccgccgccgtgcccgccgccaagatgcccgccttcagcagctgcttcgaggtggtgagcggcgccgccgcccccgccagcgccgccgccggcccccccggcgccagctgcaagccccccctgcccccccactacaccagcaccgcccagatcaccgtgagagccctgggcgccgacagactgctgctgcacggccccgaccccgtgcccggcgccgccggcagcgccgccgcccccagaggcagatgcctgctgctggcccccgcccccgccgcccccgtgccccccagaagaggcagcagcgcctggctgctggaggagctgctgagacccgactgccccgagcccgccggcctggacgccaccagagagggccccgacagaaacttcagactgagcgagcacagacaggccctggccgccgccaagcacagaggccccgccgccacccccggcagccccgaccccggccccggcccctggggcgaggagcacctggccgagagaggccccagaggctgggagagaggcggcgacagatgcgacgcccccggcggcgacgccgccagaagacccgaccccgaggccgaggccccccccgccggcagcatcgaggccgcccccagcagcgccgccgagcccgtgatcgtgagcagaagcgaccccagagacgagaagctggccctgtacctggccgaggtggagaagcaggacaagtacctgagacagagaaacaagtacagattccacatcatccccgacggcaactgcctgtacagagccgtgagcaagaccgtgtacggcgaccagagcctgcacagagagctgagagagcagaccgtgcactacatcgccgaccacctggaccacttcagccccctgatcgagggcgacgtgggcgagttcatcatcgccgccgcccaggacggcgcctgggccggctaccccgagctgctggccatgggccagatgctgaacgtgaacatccacctgaccaccggcggcagactggagagccccaccgtgagcaccatgatccactacctgggccccgaggacagcctgagacccagcatctggctgagctggctgagcaacggccactacgacgccgtgttcgaccacagctaccccaaccccgagtacgacaactggtgcaagcagacccaggtgcagagaaagagagacgaggagctggccaagagcatggccatcagcctgagcaagatgtacatcgagcagaacgcctgcagctag

SEQ ID NO: 92090 - DNA, 1197 bp, Artificial Sequence
  Description of Artificial Sequence: Synthetic coding sequence
atgagcagaaagcaggccgccaagagcagacccggcagcggcagcagaaaggccgaggccgagagaaagagagacgagagagccgccagaagagccctggccaaggagagaagaaacagacccgagagcggcggcggcggcggctgcgaggaggagttcgtgagcttcgccaaccagctgcaggccctgggcctgaagctgagagaggtgcccggcgacggcaactgcctgttcagagccctgggcgaccagctggagggccacagcagaaaccacctgaagcacagacaggagaccgtggactacatgatcaagcagagagaggacttcgagcccttcgtggaggacgacatccccttcgagaagcacgtggccagcctggccaagcccggcaccttcgccggcaacgacgccatcgtggccttcgccagaaaccaccagctgaacgtggtgatccaccagctgaacgcccccctgtggcagatcagaggcaccgagaagagcagcgtgagagagctgcacatcgcctacagatacggcgagcactacgacagcgtgagaagaatcaacgacaacagcgaggcccccgcccacctgcagaccgacttccagatgctgcaccaggacgagagcaacaagagagagaagatcaagaccaagggcatggacagcgaggacgacctgagagacgaggtggaggacgccgtgcagaaggtgtgcaacgccaccggctgcagcgacttcaacctgatcgtgcagaacctggaggccgagaactacaacatcgagagcgccatcatcgccgtgctgagaatgaaccagggcaagagaaacaacgccgaggagaacctggagcccagcggcagagtgctgaagcagtgcggccccctgtgggaggagggcggcagcggcgccagaatcttcggcaaccagggcctgaacgagggcagaaccgagaacaacaaggcccaggccagccccagcgaggagaacaaggccaacaagaaccagctggccaaggtgaccaacaagcagagaagagagcagcagtggatggagaagaagaagagacaggaggagagacacagacacaaggccctggagagcagaggcagccacagagacaacaacagaagcgaggccgaggccaacacccaggtgaccctggtgaagaccttcgccgccctgaacatctag

SEQ ID NO: 92091 - DNA, 438 bp, Artificial Sequence
  Description of Artificial Sequence: Synthetic coding sequence
atggcctgcatccactacctgagagagaacagagagaagttcgaggccttcatcgagggcagcttcgaggagtacctgaagagactggagaacccccaggagtgggtgggccaggtggagatcagcgccctgagcctgatgtacagaaaggacttcatcatctacagagagcccaacgtgagccccagccaggtgaccgagaacaacttccccgagaaggtgctgctgtgcttcagcaacggcaaccactacgacatcgtgtaccccatcaagtacaaggagagcagcgccatgtgccagagcctgctgtacgagctgctgtacgagaaggtgttcaagaccgacgtgagcaagatcgtgatggagctggacaccctggaggtggccgacgaggacaacagcgagatcagcgacagcgaggacgacagctgcaagtag

SEQ ID NO: 92092 - DNA, 3345 bp, Artificial Sequence
  Description of Artificial Sequence: Synthetic coding sequence
atggaggccgccgtgggcgtgcccgacggcggcgaccagggcggcgccggccccagagaggacgccacccccatggacgcctacctgagaaagctgggcctgtacagaaagctggtggccaaggacggcagctgcctgttcagagccgtggccgagcaggtgctgcacagccagagcagacacgtggaggtgagaatggcctgcatccactacctgagagagaacagagagaagttcgaggccttcatcgagggcagcttcgaggagtacctgaagagactggagaacccccaggagtgggtgggccaggtggagatcagcgccctgagcctgatgtacagaaaggacttcatcatctacagagagcccaacgtgagccccagccaggtgaccgagaacaacttccccgagaaggtgctgctgtgcttcagcaacggcaaccactacgacatcgtgtaccccatcaagtacaaggagagcagcgccatgtgccagagcctgctgtacgagctgctgtacgagaaggtgttcaagaccgacgtgagcaagatcgtgatggagctggacaccctggaggtggccgacgaggacaacagcgagatcagcgacagcgaggacgacagctgcaagagcaagaccgccgccgccgccgccgacgtgaacggcttcaagcccctgagcggcaacgagcagctgaagaacaacggcaacagcaccagcctgcccctgagcagaaaggtgctgaagagcctgaaccccgccgtgtacagaaacgtggagtacgagatctggctgaagagcaagcaggcccagcagaagagagactacagcatcgccgccggcctgcagtacgaggtgggcgacaagtgccaggtgagactggaccacaacggcaagttcctgaacgccgacgtgcagggcatccacagcgagaacggccccgtgctggtggaggagctgggcaagaagcacaccagcaagaacctgaaggcccccccccccgagagctggaacaccgtgagcggcaagaagatgaagaagcccagcaccagcggccagaacttccacagcgacgtggactacagaggccccaagaaccccagcaagcccatcaaggcccccagcgccctgccccccagactgcagcaccccagcggcgtgagacagcacgccttcagcagccacagcagcggcagccagagccagaagttcagcagcgagcacaagaacctgagcagaacccccagccagatcatcagaaagcccgacagagagagagtggaggacttcgaccacaccagcagagagagcaactacttcggcctgagccccgaggagagaagagagaagcaggccatcgaggagagcagactgctgtacgagatccagaacagagacgagcaggccttccccgccctgagcagcagcagcgtgaaccagagcgccagccagagcagcaacccctgcgtgcagagaaagagcagccacgtgggcgacagaaagggcagcagaagaagaatggacaccgaggagagaaaggacaaggacagcatccacggccacagccagctggacaagagacccgagcccagcaccctggagaacatcaccgacgacaagtacgccaccgtgagcagccccagcaagagcaagaagctggagtgccccagccccgccgagcagaagcccgccgagcacgtgagcctgagcaaccccgcccccctgctggtgagccccgaggtgcacctgacccccgccgtgcccagcctgcccgccaccgtgcccgcctggcccagcgagcccaccaccttcggccccaccggcgtgcccgcccccatccccgtgctgagcgtgacccagaccctgaccaccggccccgacagcgccgtgagccaggcccacctgacccccagccccgtgcccgtgagcatccaggccgtgaaccagcccctgatgcccctgccccagaccctgagcctgtaccaggaccccctgtaccccggcttcccctgcaacgagaagggcgacagagccatcgtgcccccctacagcctgtgccagaccggcgaggacctgcccaaggacaagaacatcctgagattcttcttcaacctgggcgtgaaggcctacagctgccccatgtgggccccccacagctacctgtaccccctgcaccaggcctacctggccgcctgcagaatgtaccccaaggtgcccgtgcccgtgtacccccacaacccctggttccaggaggcccccgccgcccagaacgagagcgactgcacctgcaccgacgcccacttccccatgcagaccgaggccagcgtgaacggccagatgccccagcccgagatcggcccccccaccttcagcagccccctggtgatcccccccagccaggtgagcgagagccacggccagctgagctaccaggccgacctggagagcgagacccccggccagctgctgcacgccgactacgaggagagcctgagcggcaagaacatgttcccccagcccagcttcggccccaaccccttcctgggccccgtgcccatcgccccccccttcttcccccacgtgtggtacggctaccccttccagggcttcatcgagaaccccgtgatgagacagaacatcgtgctgcccagcgacgagaagggcgagctggacctgagcctggagaacctggacctgagcaaggactgcggcagcgtgagcaccgtggacgagttccccgaggccagaggcgagcacgtgcacagcctgcccgaggccagcgtgagcagcaagcccgacgagggcagaaccgagcagagcagccagaccagaaaggccgacaccgccctggccagcatcccccccgtggccgagggcaaggcccacccccccacccagatcctgaacagagagagagagaccgtgcccgtggagctggagcccaagagaaccatccagagcctgaaggagaagaccgagaaggtgaaggaccccaagaccgccgccgacgtggtgagccccggcgccaacagcgtggacagcagagtgcagagacccaaggaggagagcagcgaggacgagaacgaggtgagcaacatcctgagaagcggcagaagcaagcagttctacaaccagacctacggcagcagaaagtacaagagcgactggggctacagcggcagaggcggctaccagcacgtgagaagcgaggagagctggaagggccagcccagcagaagcagagacgagggctaccagtaccacagaaacgtgagaggcagacccttcagaggcgacagaagaagaagcggcatgggcgacggccacagaggccagcacacctag

SEQ ID NO: 92093 - DNA, 3150 bp, Artificial Sequence
  Description of Artificial Sequence: Synthetic coding sequence
atggcctgcatccactacctgagagagaacagagagaagttcgaggccttcatcgagggcagcttcgaggagtacctgaagagactggagaacccccaggagtgggtgggccaggtggagatcagcgccctgagcctgatgtacagaaaggacttcatcatctacagagagcccaacgtgagccccagccaggtgaccgagaacaacttccccgagaaggtgctgctgtgcttcagcaacggcaaccactacgacatcgtgtaccccatcaagtacaaggagagcagcgccatgtgccagagcctgctgtacgagctgctgtacgagaaggtgttcaagaccgacgtgagcaagatcgtgatggagctggacaccctggaggtggccgacgaggacaacagcgagatcagcgacagcgaggacgacagctgcaagagcaagaccgccgccgccgccgccgacgtgaacggcttcaagcccctgagcggcaacgagcagctgaagaacaacggcaacagcaccagcctgcccctgagcagaaaggtgctgaagagcctgaaccccgccgtgtacagaaacgtggagtacgagatctggctgaagagcaagcaggcccagcagaagagagactacagcatcgccgccggcctgcagtacgaggtgggcgacaagtgccaggtgagactggaccacaacggcaagttcctgaacgccgacgtgcagggcatccacagcgagaacggccccgtgctggtggaggagctgggcaagaagcacaccagcaagaacctgaaggcccccccccccgagagctggaacaccgtgagcggcaagaagatgaagaagcccagcaccagcggccagaacttccacagcgacgtggactacagaggccccaagaaccccagcaagcccatcaaggcccccagcgccctgccccccagactgcagcaccccagcggcgtgagacagcacgccttcagcagccacagcagcggcagccagagccagaagttcagcagcgagcacaagaacctgagcagaacccccagccagatcatcagaaagcccgacagagagagagtggaggacttcgaccacaccagcagagagagcaactacttcggcctgagccccgaggagagaagagagaagcaggccatcgaggagagcagactgctgtacgagatccagaacagagacgagcaggccttccccgccctgagcagcagcagcgtgaaccagagcgccagccagagcagcaacccctgcgtgcagagaaagagcagccacgtgggcgacagaaagggcagcagaagaagaatggacaccgaggagagaaaggacaaggacagcatccacggccacagccagctggacaagagacccgagcccagcaccctggagaacatcaccgacgacaagtacgccaccgtgagcagccccagcaagagcaagaagctggagtgccccagccccgccgagcagaagcccgccgagcacgtgagcctgagcaaccccgcccccctgctggtgagccccgaggtgcacctgacccccgccgtgcccagcctgcccgccaccgtgcccgcctggcccagcgagcccaccaccttcggccccaccggcgtgcccgcccccatccccgtgctgagcgtgacccagaccctgaccaccggccccgacagcgccgtgagccaggcccacctgacccccagccccgtgcccgtgagcatccaggccgtgaaccagcccctgatgcccctgccccagaccctgagcctgtaccaggaccccctgtaccccggcttcccctgcaacgagaagggcgacagagccatcgtgcccccctacagcctgtgccagaccggcgaggacctgcccaaggacaagaacatcctgagattcttcttcaacctgggcgtgaaggcctacagctgccccatgtgggccccccacagctacctgtaccccctgcaccaggcctacctggccgcctgcagaatgtaccccaaggtgcccgtgcccgtgtacccccacaacccctggttccaggaggcccccgccgcccagaacgagagcgactgcacctgcaccgacgcccacttccccatgcagaccgaggccagcgtgaacggccagatgccccagcccgagatcggcccccccaccttcagcagccccctggtgatcccccccagccaggtgagcgagagccacggccagctgagctaccaggccgacctggagagcgagacccccggccagctgctgcacgccgactacgaggagagcctgagcggcaagaacatgttcccccagcccagcttcggccccaaccccttcctgggccccgtgcccatcgccccccccttcttcccccacgtgtggtacggctaccccttccagggcttcatcgagaaccccgtgatgagacagaacatcgtgctgcccagcgacgagaagggcgagctggacctgagcctggagaacctggacctgagcaaggactgcggcagcgtgagcaccgtggacgagttccccgaggccagaggcgagcacgtgcacagcctgcccgaggccagcgtgagcagcaagcccgacgagggcagaaccgagcagagcagccagaccagaaaggccgacaccgccctggccagcatcccccccgtggccgagggcaaggcccacccccccacccagatcctgaacagagagagagagaccgtgcccgtggagctggagcccaagagaaccatccagagcctgaaggagaagaccgagaaggtgaaggaccccaagaccgccgccgacgtggtgagccccggcgccaacagcgtggacagcagagtgcagagacccaaggaggagagcagcgaggacgagaacgaggtgagcaacatcctgagaagcggcagaagcaagcagttctacaaccagacctacggcagcagaaagtacaagagcgactggggctacagcggcagaggcggctaccagcacgtgagaagcgaggagagctggaagggccagcccagcagaagcagagacgagggctaccagtaccacagaaacgtgagaggcagacccttcagaggcgacagaagaagaagcggcatgggcgacggccacagaggccagcacacctag

SEQ ID NO: 92094 - DNA, 420 bp, Artificial Sequence
  Description of Artificial Sequence: Synthetic coding sequence
atggcctgcatccactacctgagagagaacagagagaagttcgaggccttcatcgagggcagcttcgaggagtacctgaagagactggagaacccccaggagtgggtgggccaggtggagatcagcgccctgagcctgatgtacagaaaggacttcatcatctacagagagcccaacgtgagccccagccaggtgaccgagaacaacttccccgagaaggtgctgctgtgcttcagcaacggcaaccactacgacatcgtgtaccccatcaagtacaaggagagcagcgccatgtgccagagcctgctgtacgagctgctgtacgagaaggtgttcaagaccgacgtgagcaagatcgtgatggagctggacaccctggaggtggccgacgaggacaacagcgagatcagcgacagctag

SEQ ID NO: 92095 - DNA, 438 bp, Artificial Sequence; identical to SEQ ID NO: 92091
  Description of Artificial Sequence: Synthetic coding sequence

SEQ ID NO: 92096 - DNA, 1716 bp, Artificial Sequence
  Description of Artificial Sequence: Synthetic coding sequence
atgaccatcctgcccaagaagaagccccccccccccgacgccgaccccgccaacgagccccccccccccggccccatgccccccgcccccagaagaggcggcggcgtgggcgtgggcggcggcggcaccggcgtgggcggcggcgacagagacagagacagcggcgtggtgggcgccagacccagagccagcccccccccccagggccccctgcccggcccccccggcgccctgcacagatgggccctggccgtgccccccggcgccgtggccggccccagaccccagcaggccagcccccccccctgcggcggccccggcggccccggcggcggccccggcgacgccctgggcgccgccgccgccggcgtgggcgccgccggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccggcaccagcgccgtggagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 92097 - DNA, 1701 bp, Artificial Sequence
  Description of Artificial Sequence: Synthetic coding sequence
atgaccatcctgcccaagaagaagccccccccccccgacgccgaccccgccaacgagccccccccccccggccccatgccccccgcccccagaagaggcggcggcgtgggcgtgggcggcggcggcaccggcgtgggcggcggcgacagagacagagacagcggcgtggtgggcgccagacccagagccagcccccccccccagggccccctgcccggcccccccggcgccctgcacagatgggccctggccgtgccccccggcgccgtggccggccccagaccccagcaggccagcccccccccctgcggcggccccggcggccccggcggcggccccggcgacgccctgggcgccgccgccgccggcgtgggcgccgccggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccgagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 92098 - DNA, 1701 bp, Artificial Sequence; identical to SEQ ID NO: 92097
  Description of Artificial Sequence: Synthetic coding sequence

SEQ ID NO: 92099 - DNA, 1050 bp, Artificial Sequence
  Description of Artificial Sequence: Synthetic coding sequence
atgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccgagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 92100 - DNA, 1629 bp, Artificial Sequence
  Description of Artificial Sequence: Synthetic coding sequence
atgaccatcctgcccaagaagaagccccccccccccgacgccgaccccggcggcaccggcgtgggcggcggcgacagagacagagacagcggcgtggtgggcgccagacccagagccagcccccccccccagggccccctgcccggcccccccggcgccctgcacagatgggccctggccgtgccccccggcgccgtggccggccccagaccccagcaggccagcccccccccctgcggcggccccggcggccccggcggcggccccggcgacgccctgggcgccgccgccgccggcgtgggcgccgccggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccgagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 92101 - DNA, 1335 bp, Artificial Sequence
  Description of Artificial Sequence: Synthetic coding sequence
ggcgtggtggtgggcgtgggcggcgccgtgggcgtgggcggctgctgcagcggccccggccacagcaagagaagaagacaggcccccggcgtgggcgccgtgggcggcggcagccccgagagagaggaggtgggcgccggctacaacagcgaggacgagtacgaggccgccgccgccagaatcgaggccatggaccccgccaccgtggagcagcaggagcactggttcgagaaggccctgagagacaagaagggcttcatcatcaagcagatgaaggaggacggcgcctgcctgttcagagccgtggccgaccaggtgtacggcgaccaggacatgcacgaggtggtgagaaagcactgcatggactacctgatgaagaacgccgactacttcagcaactacgtgaccgaggacttcaccacctacatcaacagaaagagaaagaacaactgccacggcaaccacatcgagatgcaggccatggccgagatgtacaacagacccgtggaggtgtaccagtacagcaccggcaccagcgccgtggagcccatcaacaccttccacggcatccaccagaacgaggacgagcccatcagagtgagctaccacagaaacatccactacaacagcgtggtgaaccccaacaaggccaccatcggcgtgggcctgggcctgcccagcttcaagcccggcttcgccgagcagagcctgatgaagaacgccatcaagaccagcgaggagagctggatcgagcagcagatgctggaggacaagaagagagccaccgactgggaggccaccaacgaggccatcgaggagcaggtggccagagagagctacctgcagtggctgagagaccaggagaagcaggccagacaggtgagaggccccagccagcccagaaaggccagcgccacctgcagcagcgccaccgccgccgccagcagcggcctggaggagtggaccagcagaagccccagacagagaagcagcgccagcagccccgagcaccccgagctgcacgccgagctgggcatgaagccccccagccccggcaccgtgctggccctggccaagccccccagcccctgcgcccccggcaccagcagccagttcagcgccggcgccgacagagccaccagccccctggtgagcctgtaccccgccctggagtgcagagccctgatccagcagatgagccccagcgccttcggcctgaacgactgggacgacgacgagatcctggccagcgtgctggccgtgagccagcaggagtacctggacagcatgaagaagaacaaggtgcacagagaccccccccccgacaagagctag

SEQ ID NO: 92102 - DNA, 867 bp, Artificial Sequence
  Description of Artificial Sequence: Synthetic coding sequence
atggacgaccccaagagcgagcagcagagaatcctgagaagacaccagagagagagacaggagctgcaggcccagatcagaagcctgaagaacagcgtgcccaagaccgacaagaccaagagaaagcagctgctgcaggacgtggccagaatggaggccgagatggcccagaagcacagacaggagctggagaagttccaggacgacagcagcatcgagagcgtggtggaggacctggccaagatgaacctggagaacagaccccccagaagcagcaaggcccacagaaagagagagagaatggagagcgaggagagagagagacaggagagcatcttccaggccgagatgagcgagcacctggccggcttcaagagagaggaggaggagaagctggccgccatcctgggcgccagaggcctggagatgaaggccatccccgccgacggccactgcatgtacagagccatccaggaccagctggtgttcagcgtgagcgtggagatgctgagatgcagaaccgccagctacatgaagaagcacgtggacgagttcctgcccttcttcagcaaccccgagaccagcgacagcttcggctacgacgacttcatgatctactgcgacaacatcgtgagaaccaccgcctggggcggccagctggagctgagagccctgagccacgtgctgaagacccccatcgaggtgatccaggccgacagccccaccctgatcatcggcgaggagtacgtgaagaagcccatcatcctggtgtacctgagatacgcctacagcctgggcgagcactacaacagcgtgacccccctggaggccggcgccgccggcggcgtgctgcccagactgctgtag

SEQ ID NO: 92103 - DNA, 972 bp, Artificial Sequence
  Description of Artificial Sequence: Synthetic coding sequence
atggagcccagagtgagagtggagggctggaaggtgcccaccagcagatgcagattcctgctggccagagtgctgggctacctggtggtgatggaggccgtgctgaccgaggagctggacgaggaggagcagctgctgagaagacacagaaaggagaagaaggagctgcaggccaagatccagggcatgaagaacgccgtgcccaagaacgacaagaagagaagaaagcagctgaccgaggacgtggccaagctggagaaggagatggagcagaagcacagagaggagctggagcagctgaagctgaccaccaaggagaacaagatcgacagcgtggccgtgaacatcagcaacctggtgctggagaaccagccccccagaatcagcaaggcccagaagagaagagagaagaaggccgccctggagaaggagagagaggagagaatcgccgaggccgagatcgagaacctgaccggcgccagacacatggagagcgagaagctggcccagatcctggccgccagacagctggagatcaagcagatccccagcgacggccactgcatgtacaaggccatcgaggaccagctgaaggagaaggactgcgccctgaccgtggtggccctgagaagccagaccgccgagtacatgcagagccacgtggaggacttcctgcccttcctgaccaaccccaacaccggcgacatgtacacccccgaggagttccagaagtactgcgaggacatcgtgaacaccgccgcctggggcggccagctggagctgagagccctgagccacatcctgcagacccccatcgagatcatccaggccgacagcccccccatcatcgtgggcgaggagtacagcaagaagcccctgatcctggtgtacatgagacacgcctacggcctgggcgagcactacaacagcgtgaccagactggtgaacatcgtgaccgagaactgcagctag

SEQ ID NO: 92104 - DNA, 579 bp, Artificial Sequence
  Description of Artificial Sequence: Synthetic coding sequence
atgatcagcaaggagaagaaggccgccctggagaaggagagagaggagagaatcgccgaggccgagatcgagaacctgaccggcgccagacacatggagagcgagaagctggcccagatcctggccgccagacagctggagatcaagcagatccccagcgacggccactgcatgtacaaggccatcgaggaccagctgaaggagaaggactgcgccctgaccgtggtggccctgagaagccagaccgccgagtacatgcagagccacgtggaggacttcctgcccttcctgaccaaccccaacaccggcgacatgtacacccccgaggagttccagaagtactgcgaggacatcgtgaacaccgccgcctggggcggccagctggagctgagagccctgagccacatcctgcagacccccatcgagatcatccaggccgacagcccccccatcatcgtgggcgaggagtacagcaagaagcccctgatcctggtgtacatgagacacgcctacggcctgggcgagcactacaacagcgtgaccagactggtgaacatcgtgaccgagaactgcagctag

SEQ ID NO: 92105 - DNA, 2781 bp, Artificial Sequence
  Description of Artificial Sequence: Synthetic coding sequence
atggtgagcagcgtgctgcccaaccccaccagcgccgagtgctgggccgccctgctgcacgaccccatgaccctggacatggacgccgtgctgagcgacttcgtgagaagcaccggcgccgagcccggcctggccagagacctgctggagggcaagaactgggacctgaccgccgccctgagcgactacgagcagctgagacaggtgcacaccgccaacctgccccacgtgttcaacgagggcagaggccccaagcagcccgagagagagccccagcccggccacaaggtggagagaccctgcctgcagagacaggacgacatcgcccaggagaagagactgagcagaggcatcagccacgccagcagcgccatcgtgagcctggccagaagccacgtggccagcgagtgcaacaacgagcagttccccctggagatgcccatctacaccttccagctgcccgacctgagcgtgtacagcgaggacttcagaagcttcatcgagagagacctgatcgagcaggccaccatggtggccctggagcaggccggcagactgaactggtggagcaccgtgtgcaccagctgcaagagactgctgcccctggccaccaccggcgacggcaactgcctgctgcacgccgccagcctgggcatgtggggcttccacgacagagacctggtgctgagaaaggccctgtacaccatgatgagaaccggcgccgagagagaggccctgaagagaagatggagatggcagcagacccagcagaacaaggaggaggagtgggagagagagtggaccgagctgctgaagctggccagcagcgagcccagaacccacttcagcaagaacggcggcaccggcggcggcgtggacaacagcgaggaccccgtgtacgagagcctggaggagttccacgtgttcgtgctggcccacatcctgagaagacccatcgtggtggtggccgacaccatgctgagagacagcggcggcgaggccttcgcccccatccccttcggcggcatctacctgcccctggaggtgccccccaacagatgccactgcagccccctggtgctggcctacgaccaggcccacttcagcgccctggtgagcatggagcagagagaccagcagagagagcaggccgtgatccccctgaccgacagcgagcacaagctgctgcccctgcacttcgccgtggaccccggcaaggactgggagtggggcaaggacgacaacgacaacgccagactggcccacctgatcctgagcctggaggccaagctgaacctgctgcacagctacatgaacgtgacctggatcagaatccccagcgagaccagagcccccctggcccagcccgagagccccaccgccagcgccggcgaggacgtgcagagcctggccgacagcctggacagcgacagagacagcgtgtgcagcaacagcaacagcaacaacggcaagaacggcaaggacaaggagaaggagaagcagagaaaggagaaggacaagaccagagccgacagcgtggccaacaagctgggcagcttcagcaagaccctgggcatcaagctgaagaagaacatgggcggcctgggcggcctggtgcacggcaagatgggcagagccaacagcgccaacggcaagaacggcgacagcgccgagagaggcaaggagaagaaggccaagagcagaaagggcagcaaggaggagagcggcgccagcgccagcaccagccccagcgagaagaccacccccagccccaccgacaaggccgccggcgccagccccgccgagaagggcggcggccccagaggcgacgcctggaagtacagcaccgacgtgaagctgagcctgaacatcctgagagccgccatgcagggcgagagaaagttcatcttcgccggcctgctgctgaccagccacagacaccagttccacgaggagatgatcggctactacctgaccagcgcccaggagagattcagcgccgagcaggagcagagaagaagagacgccgccaccgccgccgccgccgccgccgccgccgccgccgccaccgccaagagaccccccagaagacccgagaccgagggcgtgcccgtgcccgagagagccagccccggcccccccacccagctggtgctgaagctgaaggagagacccagccccggccccgccgccggcagagccgccagagccgccgccggcggcaccgccagccccggcggcggcgccagaagagccagcgccagcggccccgtgcccggcagaagcccccccgcccccgccagacagagcgtgatccacgtgcaggccagcggcgccagagacgaggcctgcgcccccgccgtgggcgccctgagaccctgcgccacctacccccagcagaacagaagcctgagcagccagagctacagccccgccagagccgccgccctgagaaccgtgaacaccgtggagagcctggccagagccgtgcccggcgccctgcccggcgccgccggcaccgccggcgccgccgagcacaagagccagacctacaccaacggcttcggcgccctgagagacggcctggagttcgccgacgccgacgcccccaccgccagaagcaacggcgagtgcggcagaggcggccccggccccgtgcagagaagatgccagagagagaactgcgccttctacggcagagccgagaccgagcactactgcagctactgctacagagaggagctgagaagaagaagagaggccagaggcgccagaccctag

SEQ ID NO: 92106 - DNA, 2802 bp, Artificial Sequence
  Description of Artificial Sequence: Synthetic coding sequence
atggtgagcagcgtgctgcccaaccccaccagcgccgagtgctgggccgccctgctgcacgaccccatgaccctggacatggacgccgtgctgagcgacttcgtgagaagcaccggcgccgagcccggcctggccagagacctgctggagggcaagaactgggacctgaccgccgccctgagcgactacgagcagctgagacaggtgcacaccgccaacctgccccacgtgttcaacgagggcagaggccccaagcagcccgagagagagccccagcccggccacaaggtggagagaccctgcctgcagagacaggacgacatcgcccaggagaagagactgagcagaggcatcagccacgccagcagcgccatcgtgagcctggccagaagccacgtggccagcgagtgcaacaacgagcagttccccctggagatgcccatctacaccttccagctgcccgacctgagcgtgtacagcgaggacttcagaagcttcatcgagagagacctgatcgagcaggccaccatggtggccctggagcaggccggcagactgaactggtggagcaccgtgtgcaccagctgcaagagactgctgcccctggccaccaccggcgacggcaactgcctgctgcacgccgccagcctgggcatgtggggcttccacgacagagacctggtgctgagaaaggccctgtacaccatgatgagaaccggcgccgagagagaggccctgaagagaagatggagatggcagcagacccagcagaacaaggagagcggcctggtgtacaccgaggaggagtgggagagagagtggaccgagctgctgaagctggccagcagcgagcccagaacccacttcagcaagaacggcggcaccggcggcggcgtggacaacagcgaggaccccgtgtacgagagcctggaggagttccacgtgttcgtgctggcccacatcctgagaagacccatcgtggtggtggccgacaccatgctgagagacagcggcggcgaggccttcgcccccatccccttcggcggcatctacctgcccctggaggtgccccccaacagatgccactgcagccccctggtgctggcctacgaccaggcccacttcagcgccctggtgagcatggagcagagagaccagcagagagagcaggccgtgatccccctgaccgacagcgagcacaagctgctgcccctgcacttcgccgtggaccccggcaaggactgggagtggggcaaggacgacaacgacaacgccagactggcccacctgatcctgagcctggaggccaagctgaacctgctgcacagctacatgaacgtgacctggatcagaatccccagcgagaccagagcccccctggcccagcccgagagccccaccgccagcgccggcgaggacgtgcagagcctggccgacagcctggacagcgacagagacagcgtgtgcagcaacagcaacagcaacaacggcaagaacggcaaggacaaggagaaggagaagcagagaaaggagaaggacaagaccagagccgacagcgtggccaacaagctgggcagcttcagcaagaccctgggcatcaagctgaagaagaacatgggcggcctgggcggcctggtgcacggcaagatgggcagagccaacagcgccaacggcaagaacggcgacagcgccgagagaggcaaggagaagaaggccaagagcagaaagggcagcaaggaggagagcggcgccagcgccagcaccagccccagcgagaagaccacccccagccccaccgacaaggccgccggcgccagccccgccgagaagggcggcggccccagaggcgacgcctggaagtacagcaccgacgtgaagctgagcctgaacatcctgagagccgccatgcagggcgagagaaagttcatcttcgccggcctgctgctgaccagccacagacaccagttccacgaggagatgatcggctactacctgaccagcgcccaggagagattcagcgccgagcaggagcagagaagaagagacgccgccaccgccgccgccgccgccgccgccgccgccgccgccaccgccaagagaccccccagaagacccgagaccgagggcgtgcccgtgcccgagagagccagccccggcccccccacccagctggtgctgaagctgaaggagagacccagccccggccccgccgccggcagagccgccagagccgccgccggcggcaccgccagccccggcggcggcgccagaagagccagcgccagcggccccgtgcccggcagaagcccccccgcccccgccagacagagcgtgatccacgtgcaggccagcggcgccagagacgaggcctgcgcccccgccgtgggcgccctgagaccctgcgccacctacccccagcagaacagaagcctgagcagccagagctacagccccgccagagccgccgccctgagaaccgtgaacaccgtggagagcctggccagagccgtgcccggcgccctgcccggcgccgccggcaccgccggcgccgccgagcacaagagccagacctacaccaacggcttcggcgccctgagagacggcctggagttcgccgacgccgacgcccccaccgccagaagcaacggcgagtgcggcagaggcggccccggccccgtgcagagaagatgccagagagagaactgcgccttctacggcagagccgagaccgagcactactgcagctactgctacagagaggagctgagaagaagaagagaggccagaggcgccagaccctag

SEQ ID NO: 92107 - DNA, 333 bp, Artificial Sequence
  Description of Artificial Sequence: Synthetic coding sequence
atggtgagcagcgtgctgcccaaccccaccagcgccgagtgctgggccgccctgctgcacgaccccatgaccctggacatggacgccgtgctgagcgacttcgtgagaagcaccggcgccgagcccggcctggccagagacctgctggagggcaagaactgggacctgaccgccgccctgagcgactacgagcagctgagacaggtgcacaccgccaacctgccccacgtgttcaacgagggcagaggccccaagcagcccgagagagagccccagcccggccacaaggtggagagaccctgcctgcagagacaggacgacatcgcccagtag

SEQ ID NO: 92108 - DNA, 2532 bp, Artificial Sequence
  Description of Artificial Sequence: Synthetic coding sequence
atgaccctggacatggacgccgtgctgagcgacttcgtgagaagcaccggcgccgagcccggcctggccagagacctgctggagggcaagaactgggacgtgaacgccgccctgagcgacttcgagcagctgagacaggtgcacgccggcaacctgccccccagcttcagcgagggcagcggcggcagcagaacccccgagaagggcttcagcgacagagagcccaccagaccccccagacccatcctgcagagacaggacgacatcgtgcaggagaagagactgagcagaggcatcagccacgccagcagcagcatcgtgagcctggccagaagccacgtgagcagcaacggcggcggcggcggcagcaacgagcaccccctggagatgcccatctgcgccttccagctgcccgacctgaccgtgtacaacgaggacttcagaagcttcatcgagagagacctgatcgagcagagcatgctggtggccctggagcaggccggcagactgaactggtgggtgagcgtggaccccaccagccagagactgctgcccctggccaccaccggcgacggcaactgcctgctgcacgccgccagcctgggcatgtggggcttccacgacagagacctgatgctgagaaaggccctgtacgccctgatggagaagggcgtggagaaggaggccctgaagagaagatggagatggcagcagacccagcagaacaaggagagcggcctggtgtacaccgaggacgagtggcagaaggagtggaacgagctgatcaagctggccagcagcgagcccagaatgcacctgggcaccaacggcgccaactgcggcggcgtggagagcagcgaggagcccgtgtacgagagcctggaggagttccacgtgttcgtgctggcccacgtgctgagaagacccatcgtggtggtggccgacaccatgctgagagacagcggcggcgaggccttcgcccccatccccttcggcggcatctacctgcccctggaggtgcccgccagccagtgccacagaagccccctggtgctggcctacgaccaggcccacttcagcgccctggtgagcatggagcagaaggagaacaccaaggagcaggccgtgatccccctgaccgacagcgagtacaagctgctgcccctgcacttcgccgtggaccccggcaagggctgggagtggggcaaggacgacagcgacaacgtgagactggccagcgtgatcctgagcctggaggtgaagctgcacctgctgcacagctacatgaacgtgaagtggatccccctgagcagcgacgcccaggcccccctggcccagcccgagagccccaccgccagcgccggcgacgagcccagaagcacccccgagagcggcgacagcgacaaggagagcgtgggcagcagcagcaccagcaacgagggcggcagaagaaaggagaagagcaagagagacagagagaaggacaagaagagagccgacagcgtggccaacaagctgggcagcttcggcaagaccctgggcagcaagctgaagaagaacatgggcggcctgatgcacagcaagggcagcaagcccggcggcgtgggcaccggcctgggcggcagcagcggcaccgagaccctggagaagaagaagaagaacagcctgaagagctggaagggcggcaaggaggaggccgccggcgacggccccgtgagcgagaagccccccgccgagagcgtgggcaacggcggcagcaagtacagccaggaggtgatgcagagcctgagcatcctgagaaccgccatgcagggcgagggcaagttcatcttcgtgggcaccctgaagatgggccacagacaccagtaccaggaggagatgatccagagatacctgagcgacgccgaggagagattcctggccgagcagaagcagaaggaggccgagagaaagatcatgaacggcggcatcggcggcggccccccccccgccaagaagcccgagcccgacgccagagaggagcagcccaccggcccccccgccgagagcagagccatggccttcagcaccggctaccccggcgacttcaccatccccagacccagcggcggcggcgtgcactgccaggagcccagaagacagctggccggcggcccctgcgtgggcggcctgcccccctacgccaccttccccagacagtgcccccccggcagaccctacccccaccaggacagcatccccagcctggagcccggcagccacagcaaggacggcctgcacagaggcgccctgctgccccccccctacagagtggccgacagctacagcaacggctacagagagccccccgagcccgacggctgggccggcggcctgagaggcctgccccccacccagaccaagtgcaagcagcccaactgcagcttctacggccaccccgagaccaacaacttctgcagctgctgctacagagaggagctgagaagaagagagagagagcccgacggcgagctgctggtgcacagattctag

SEQ ID NO: 92109 - DNA, 1284 bp, Artificial Sequence
  Description of Artificial Sequence: Synthetic coding sequence
atgaccctggacatggacgccgtgctgagcgacttcgtgagaagcaccggcgccgagcccggcctggccagagacctgctggagggcaagaactgggacgtgaacgccgccctgagcgacttcgagcagctgagacaggtgcacgccggcaacctgccccccagcttcagcgagggcagcggcggcagcagaacccccgagaagggcttcagcgacagagagcccaccagaccccccagacccatcctgcagagacaggacgacatcgtgcaggagaagagactgagcagaggcatcagccacgccagcagcagcatcgtgagcctggccagaagccacgtgagcagcaacggcggcggcggcggcagcaacgagcaccccctggagatgcccatctgcgccttccagctgcccgacctgaccgtgtacaacgaggacttcagaagcttcatcgagagagacctgatcgagcagagcatgctggtggccctggagcaggccggcagactgaactggtgggtgagcgtggaccccaccagccagagactgctgcccctggccaccaccggcgacggcaactgcctgctgcacgccgccagcctgggcatgtggggcttccacgacagagacctgatgctgagaaaggccctgtacgccctgatggagaagggcgtggagaaggaggccctgaagagaagatggagatggcagcagacccagcagaacaaggagagcggcctggtgtacaccgaggacgagtggcagaaggagtggaacgagctgatcaagctggccagcagcgagcccagaatgcacctgggcaccaacggcgccaactgcggcggcgtggagagcagcgaggagcccgtgtacgagagcctggaggagttccacgtgttcgtgctggcccacgtgctgagaagacccatcgtggtggtggccgacaccatgctgagagacagcggcggcgaggccttcgcccccatccccttcggcggcatctacctgcccctggaggtgcccgccagccagtgccacagaagccccctggtgctggcctacgaccaggcccacttcagcgccctggtgagcatggagcagaaggagaacaccaaggagcaggccgtgatccccctgaccgacagcgagtacaagctgctgcccctgcacttcgccgtggaccccggcaagggctgggagtggggcaaggacgacagcgacaacgtgagactggccagcgtgatcctgagcctggaggtgaagctgcacctgctgcacagctag

SEQ ID NO: 92110 - DNA, 2445 bp, Artificial Sequence
  Description of Artificial Sequence: Synthetic coding sequence
atgaccctggacatggacgccgtgctgagcgacttcgtgagaagcaccggcgccgagcccggcctggccagagacctgctggagggcaagaactgggacgtgaacgccgccctgagcgacttcgagcagctgagacaggtgcacgccggcaacctgccccccagcttcagcgagggcagcggcggcagcagaacccccgagaagggcttcagcgacagagagcccaccagaccccccagacccatcctgcagagacaggacgacatcgtgcaggagaagagactgagcagaggcatcagccacgccagcagcagcatcgtgagcctggccagaagccacgtgagcagcaacggcggcggcggcggcagcaacgagcaccccctggagatgcccatctgcgccttccagctgcccgacctgaccgtgtacaacgaggacttcagaagcttcatcgagagagacctgatcgagcagagcatgctggtggccctggagcaggccggcagactgaactggtgggtgagcgtggaccccaccagccagagactgctgcccctggccaccaccggcgacggcaactgcctgctgcacgccgccagcctgggcatgtggggcttccacgacagagacctgatgctgagaaaggccctgtacgccctgatggagaagggcgtggagaaggaggccctgaagagaagatggagatggcagcagacccagcagaacaaggagagcggcctggtgtacaccgaggacgagtggcagaaggagtggaacgagctgatcaagctggccagcagcgagcccagaatgcacctgggcaccaacggcgccaactgcggcggcgtggagagcagcgaggagcccgtgtacgagagcctggaggagttccacgtgttcgtgctggcccacgtgctgagaagacccatcgtggtggtggccgacaccatgctgagagacagcggcggcgaggccttcgcccccatccccttcggcggcatctacctgcccctggaggtgcccgccagccagtgccacagaagccccctggtgctggcctacgaccaggcccacttcagcgccctggtgagcatggagcagaaggagaacaccaaggagcaggccgtgatccccctgaccgacagcgagtacaagctgctgcccctgcacttcgccgtggaccccggcaagggctgggagtggggcaaggacgacagcgacaacgtgagactggccagcgtgatcctgagcctggaggtgaagctgcacctgctgcacagctacatgaacgtgaagtggatccccctgagcagcgacgcccaggcccccctggcccagcccgagagccccaccgccagcgccggcgacgagcccagaagcacccccgagagcggcgacagcgacaaggagagcgtgggcagcagcagcaccagcaacgagggcggcagaagaaaggagaagagcaagagagacagagagaaggacaagaagagagccgacagcgtggccaacaagctgggcagcttcggcaagaccctgggcagcaagctgaagaagaacatgggcggcctgatgcacagcaagggcagcaagcccggcggcgtgggcaccggcctgggcggcagcagcggcaccgagaccctggagaagaagaagaagaacagcctgaagagctggaagggcggcaaggaggaggccgccggcgacggccccgtgagcgagaagccccccgccgagagcgtgggcaacggcggcagcaagtacagccaggaggtgatgcagagcctgagcatcctgagaaccgccatgcagggcgagggcaagttcatcttcgtgggcaccctgaagatgggccacagacaccagtaccaggaggagatgatccagagatacctgagcgacgccgaggagagattcctggccgagcagaagcagaaggaggccgagagaaagatcatgaacggcggcatcggcggcggccccccccccgccaagaagcccgagcccgacgccagagaggagcagcccaccggcccccccgccgagagcagagccatggccttcagcaccggctaccccggcgacttcaccatccccagacccagcggcggcggcgtgcactgccaggagcccagaagacagctggccggcggcccctgcgtgggcggcctgcccccctacgccaccttccccagacagtgcccccccggcagaccctacccccaccaggacagcatccccagcctggagcccggcagccacagcaaggacggcctgcacagaggcgccctgctgccccccccctacagagtggccgacagctacagcaacggctacagagagccccccgagcccgacggctgggccggcggcctgagaggcctgccccccacccagaccaagtgcaagcagcccgacggcgagctgctggtgcacagattctag

SEQ ID NO: 92111 - DNA, 927 bp, Artificial Sequence
  Description of Artificial Sequence: Synthetic coding sequence
atgtgcggcgtggagggctgctgccagggcggcgccaccagaagaggcagcctgcccggcggcagacagctggccaccagaaagagaagcgtggtgagaagatgcctgaagatggccgccgaggagccccagcagcagaagcaggagcccctgggcagcgacagcgagggcgtgaactgcctggcctacgacgaggccatcatggcccagcaggacagaatccagcaggagatcgccgtgcagaaccccctggtgagcgagagactggagctgagcgtgctgtacaaggagtacgccgaggacgacaacatctaccagcagaagatcaaggacctgcacaagaagtacagctacatcagaaagaccagacccgacggcaactgcttctacagagccttcggcttcagccacctggaggccctgctggacgacagcaaggagctgcagagattcaaggccgtgagcgccaagagcaaggaggacctggtgagccagggcttcaccgagttcaccatcgaggacttccacaacaccttcatggacctgatcgagcaggtggagaagcagaccagcgtggccgacctgctggccagcttcaacgaccagagcaccagcgactacctggtggtgtacctgagactgctgaccagcggctacctgcagagagagagcaagttcttcgagcacttcatcgagggcggcagaaccgtgaaggagttctgccagcaggaggtggagcccatgtgcaaggagagcgaccacatccacatcatcgccctggcccaggccctgagcgtgagcatccaggtggagtacatggacagaggcgagggcggcaccaccaacccccacatcttccccgagggcagcgagcccaaggtgtacctgctgtacagacccggccactacgacatcctgtacaagtag

SEQ ID NO: 92112 - DNA, 816 bp, Artificial Sequence
  Description of Artificial Sequence: Synthetic coding sequence
atggccgccgaggagccccagcagcagaagcaggagcccctgggcagcgacagcgagggcgtgaactgcctggcctacgacgaggccatcatggcccagcaggacagaatccagcaggagatcgccgtgcagaaccccctggtgagcgagagactggagctgagcgtgctgtacaaggagtacgccgaggacgacaacatctaccagcagaagatcaaggacctgcacaagaagtacagctacatcagaaagaccagacccgacggcaactgcttctacagagccttcggcttcagccacctggaggccctgctggacgacagcaaggagctgcagagattcaaggccgtgagcgccaagagcaaggaggacctggtgagccagggcttcaccgagttcaccatcgaggacttccacaacaccttcatggacctgatcgagcaggtggagaagcagaccagcgtggccgacctgctggccagcttcaacgaccagagcaccagcgactacctggtggtgtacctgagactgctgaccagcggctacctgcagagagagagcaagttcttcgagcacttcatcgagggcggcagaaccgtgaaggagttctgccagcaggaggtggagcccatgtgcaaggagagcgaccacatccacatcatcgccctggcccaggccctgagcgtgagcatccaggtggagtacatggacagaggcgagggcggcaccaccaacccccacatcttccccgagggcagcgagcccaaggtgtacctgctgtacagacccggccactacgacatcctgtacaagtag

SEQ ID NO: 92113 - DNA, 816 bp, Artificial Sequence; identical to SEQ ID NO: 92112
  Description of Artificial Sequence: Synthetic coding sequence

SEQ ID NO: 92114 - DNA, 843 bp, Artificial Sequence
  Description of Artificial Sequence: Synthetic coding sequence
atggccgccgaggagccccagcagcagaagcaggagcccctgggcagcgacagcgagggcgtgaactgcctggcctacgacgaggccatcatggcccagcaggacagaatccagcaggaggacatgaccgacccctgcctgctgcagatcgccgtgcagaaccccctggtgagcgagagactggagctgagcgtgctgtacaaggagtacgccgaggacgacaacatctaccagcagaagatcaaggacctgcacaagaagtacagctacatcagaaagaccagacccgacggcaactgcttctacagagccttcggcttcagccacctggaggccctgctggacgacagcaaggagctgcagagattcaaggccgtgagcgccaagagcaaggaggacctggtgagccagggcttcaccgagttcaccatcgaggacttccacaacaccttcatggacctgatcgagcaggtggagaagcagaccagcgtggccgacctgctggccagcttcaacgaccagagcaccagcgactacctggtggtgtacctgagactgctgaccagcggctacctgcagagagagagcaagttcttcgagcacttcatcgagggcggcagaaccgtgaaggagttctgccagcaggaggtggagcccatgtgcaaggagagcgaccacatccacatcatcgccctggcccaggccctgagcgtgagcatccaggtggagtacatggacagaggcgagggcggcaccaccaacccccacatcttccccgagggcagcgagcccaaggtgtacctgctgtacagacccggccactacgacatcctgtacaagtag

SEQ ID NO: 92115 - DNA, 705 bp, Artificial Sequence
  Description of Artificial Sequence: Synthetic coding sequence
atgagcgagaccagcttcaacctgatcagcgagaagtgcgacatcctgagcatcctgagagaccaccccgagaacagaatctacagaagaaagatcgaggagctgagcaagagattcaccgccatcagaaagaccaagggcgacggcaactgcttctacagagccctgggctacagctacctggagagcctgctgggcaagagcagagagatcttcaagttcaaggagagagtgctgcagacccccaacgacctgctggccgccggcttcgaggagcacaagttcagaaacttcttcaacgccttctacagcgtggtggagctggtggagaaggacggcagcgtgagcagcctgctgaaggtgttcaacgaccagagcgccagcgaccacatcgtgcagttcctgagactgctgaccagcgccttcatcagaaacagagccgacttcttcagacacttcatcgacgaggagatggacatcaaggacttctgcacccacgaggtggagcccatggccaccgagtgcgaccacatccagatcaccgccctgagccaggccctgagcatcgccctgcaggtggagtacgtggacgagatggacaccgccctgaaccaccacgtgttccccgaggccgccacccccagcgtgtacctgctgtacaagaccagccactacaacatcctgtacgccgccgacaagcactag

SEQ ID NO: 92116 - DNA, 222 bp, Artificial Sequence
  Description of Artificial Sequence: Synthetic coding sequence
atgagcgagaccagcttcaacctgatcagcgagaagtgcgacatcctgagcatcctgagagaccaccccgagaacagaatctacagaagaaagatcgaggagctgagcaagagattcaccgccatcagaaagaccaagggcgacggcaactgcttctacagagccctgggctacagctacctggagagcctgctgggcaagagcagagagatcttcaagtag

SEQ ID NO: 92117 - DNA, 753 bp, Artificial Sequence
  Description of Artificial Sequence: Synthetic coding sequence
atggccgccctgagctgcctgctggacagcgtgagaagagacatcaagaaggtggacagagagctgagacagctgagatgcatcgacgagttcagcaccagatgcctgtgcgacctgtacatgcacccctactgctgctgcgacctgcacccctacccctactgcctgtgctacagcaagagaagcagaagctgcggcctgtgcgacctgtacccctgctgcctgtgcgactacaagctgtactgcctgagacccagcctgagaagcctggagagaaaggccatcagagccatcgaggacgagaagagagagctggccaagctgagaagaaccaccaacagaatcctggccagcagctgctgcagcagcaacatcctgggcagcgtgaacgtgtgcggcttcgagcccgaccaggtgaaggtgagagtgaaggacggcaaggtgtgcgtgagcgccgagagagagaacagatacgactgcctgggcagcaagaagtacagctacatgaacatctgcaaggagttcagcctgcccccctgcgtggacgagaaggacgtgacctacagctacggcctgggcagctgcgtgaagatcgagagcccctgctacccctgcaccagcccctgcagcccctgcagcccctgcagcccctgcaacccctgcagcccctgcaacccctgcagcccctacgacccctgcaacccctgctacccctgcggcagcagattcagctgcagaaagatgatcctgtag

SEQ ID NO: 92118 - DNA, 2418 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagaatcgagcaccagggcgacaagctggagatggccagagagaagcaccaggccagccagaaggagaacaagcagctgagcctgaaggtggacgagctggagagaaagctggaggccaccagcgcccagaacatcgagttcctgcaggtgatcgccaagagagaggaggccatccaccagagccagctgagactggaggagaagaccagagagtgcggcaccctggccagacagctggagagcgccatcgaggacgccagaagacaggtggagcagaccaaggagcacgccctgagcaaggagagagccgcccagaacaagatcctggacctggagacccagctgagcagaaccaagaccgagctgagccagctgagaagaagcagagacgacgccgacagaagataccagagcagactgcaggacctgaaggacagactggagcagagcgagagcaccaacagaagcatgcagaactacgtgcagttcctgaagagcagctacgccaacgtgttcggcgacggcccctacagcaccttcctgaccagcagccccatcagaagcagaagcccccccgcctag

SEQ ID NO: 92119 - DNA, 2475 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaaggtgccctggatgccccccggcaagagcagcgccagacccgtgggctgcaagtgggagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagaatcgagcaccagggcgacaagctggagatggccagagagaagcaccaggccagccagaaggagaacaagcagctgagcctgaaggtggacgagctggagagaaagctggaggccaccagcgcccagaacatcgagttcctgcaggtgatcgccaagagagaggaggccatccaccagagccagctgagactggaggagaagaccagagagtgcggcaccctggccagacagctggagagcgccatcgaggacgccagaagacaggtggagcagaccaaggagcacgccctgagcaaggagagagccgcccagaacaagatcctggacctggagacccagctgagcagaaccaagaccgagctgagccagctgagaagaagcagagacgacgccgacagaagataccagagcagactgcaggacctgaaggacagactggagcagagcgagagcaccaacagaagcatgcagaactacgtgcagttcctgaagagcagctacgccaacgtgttcggcgacggcccctacagcaccttcctgaccagcagccccatcagaagcagaagcccccccgcctag

SEQ ID NO: 92120 - DNA, 1917 bp, Artificial Sequence
  Description of Artificial Sequence: Synthetic coding sequence
atgagcgccagcagcagcggcggcagccccagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagagtgagagactggcagaagggcagccacgagctgaccagagccggcgccagaatccccagatag

SEQ ID NO: 92121 - DNA, 2490 bp, Artificial Sequence
  Description of Artificial Sequence: Synthetic coding sequence
atgagcgccagcagcagcggcggcagccccagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaaggtgccctggatgccccccggcaagagcagcgccagacccgtgggctgcaagtgggagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagaatcgagcaccagggcgacaagctggagatggccagagagaagcaccaggccagccagaaggagaacaagcagctgagcctgaaggtggacgagctggagagaaagctggaggccaccagcgcccagaacatcgagttcctgcaggtgatcgccaagagagaggaggccatccaccagagccagctgagactggaggagaagaccagagagtgcggcaccctggccagacagctggagagcgccatcgaggacgccagaagacaggtggagcagaccaaggagcacgccctgagcaaggagagagccgcccagaacaagatcctggacctggagacccagctgagcagaaccaagaccgagctgagccagctgagaagaagcagagacgacgccgacagaagataccagagcagactgcaggacctgaaggacagactggagcagagcgagagcaccaacagaagcatgcagaactacgtgcagttcctgaagagcagctacgccaacgtgttcggcgacggcccctacagcaccttcctgaccagcagccccatcagaagcagaagcccccccgcctag

SEQ ID NO: 92122 - DNA, 2106 bp, Artificial Sequence
  Description of Artificial Sequence: Synthetic coding sequence
atgggcgagctgcccaccggctgcagaaagagaagaagaaagagaggcggcgccgccgccagagccagactgcacccccccagaagactgcacggcaccaccctggccagcgacttcaacgacttcatcagaagaagattctgggcccagccctgcagaagctggttccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaaggtgccctggatgccccccggcaagagcagcgccagacccgtgggctgcaagtgggagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagagtgagagactggcagaagggcagccacgagctgaccagagccggcgccagaatccccagatag

SEQ ID NO: 92123 - DNA, 1974 bp, Artificial Sequence
  Description of Artificial Sequence: Synthetic coding sequence
atggccgaccagcagggcccccaccagaacagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaaggtgccctggatgccccccggcaagagcagcgccagacccgtgggctgcaagtgggagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagagtgagagactggcagaagggcagccacgagctgaccagagccggcgccagaatccccagatag

SEQ ID NO: 92124 - DNA, 570 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgtag

SEQ ID NO: 92125 - DNA, 618 bp, Artificial Sequence
  Description of Artificial Sequence: Synthetic coding sequence
atgagcgccagcagcagcggcggcagccccagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggagtag

SEQ ID NO: 92126 - DNA, 543 bp, Artificial Sequence
  Description of Artificial Sequence: Synthetic coding sequence
atgagcgccagcagcagcggcggcagccccagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaaggtgccctggatgccccccggcaagagcagcgccagacccgtgggctgcaagtgggagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagatag

SEQ ID NO: 92127 - DNA, 648 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgtgggctag

SEQ ID NO: 92128 - DNA, 471 bp, Artificial Sequence
  Description of Artificial Sequence: Synthetic coding sequence
atgagcgccagcagcagcggcggcagccccagattccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagtag

SEQ ID NO: 92129 - DNA, 1731 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagagtgagagactggcagaagggcagccacgagctgaccagagccggcgccagaatccccagatag

SEQ ID NO: 92130 - DNA, 444 bp, Artificial Sequence
  Description of Artificial Sequence: Synthetic coding sequence
atgaaggacagaagcagcaccccccccctgcacgtgcacgtggacgagaacacccccgtgcacgtgcacatcaagaagctgcccaagcccagcgccaccagcagccagaagagccacaagagaggcatgaagggcgacaccgtgaacgtgagaagaagcgtgagagtgaagaccaaggtgccctggatgccccccggcaagagcagcgccagacccgtgggctgcaagtgggagaccagcgaggagacccccaccaccggcgagggcgtgccccacgtgcaggccggcggcggcggcaacggctggggctgcggctgccaggccggccacggcctggagggctaccacagagaggccgagaacagagagaccaacgacctgcacggccaccagcaccccgacaaggccgagggcaccagccccgccgaggccgagcacatctag

SEQ ID NO: 92131 - DNA, 1917 bp, Artificial Sequence
  Description of Artificial Sequence: Synthetic coding sequence
atgggcagaaacagatacccccccgcctgctggttccccagctgcggcaagaacggcgtgaccagcctgacccagaagaaggtgctgagagccccctgcggcgcccccagcgtgaccgtgaccaagagccacaagagaggcatgaagggcgacaccgtgaacgtgagaagaagcgtgagagtgaagaccaagaaccccccccactgcctggagatcaccccccccagcagcgagaagctggtgagcgtgatgagactgagcgacctgagcaccgaggacgacgacagcggccactgcaagatgaacagatacgacaagaagatcgacagcctgatgaacgccgtgggctgcctgaagagcgaggtgaagatgcagaagggcgagagacagatggccaagagattcctggaggagagaaaggaggagctggaggaggtggcccacgagctggccgagaccgagcacgagaacaccgtgctgagacacaacatcgagagaatgaaggaggagaaggacttcaccatcctgcagaagaagcacctgcagcaggagaaggagtgcctgatgagcaagctggtggaggccgagatggacggcgccgccgccgccaagcaggtgatggccctgaaggacaccatcggcaagctgaagaccgagaagcagatgacctgcaccgacatcaacaccctgaccagacagaaggagctgctgctgcagaagctgagcaccttcgaggagaccaacagaaccctgagagacctgctgagagagcagcactgcaaggaggacagcgagagactgatggagcagcagggcgccctgctgaagagactggccgaggccgacagcgagaaggccagactgctgctgctgctgcaggacaaggacaaggaggtggaggagctgctgcaggagatccagtgcgagaaggcccaggccaagaccgccagcgagctgagcaagagcatggagagcatgagaggccacctgcaggcccagctgagaagcaaggaggccgagaacagcagactgtgcatgcagatcaagaacctggagagaagcggcaaccagcacaaggccgaggtggaggccatcatggagcagctgaaggagctgaagcagaagggcgacagagacaaggagagcctgaagaaggccatcagagcccagaaggagagagccgagaagagcgaggagtacgccgagcagctgcacgtgcagctggccgacaaggacctgtacgtggccgaggccctgagcaccctggagagctggagaagcagatacaaccaggtggtgaaggagaagggcgacctggagctggagatcatcgtgctgaacgacagagtgaccgacctggtgaaccagcagcagaccctggaggagaagatgagagaggacagagacagcctggtggagagactgcacagacagaccgccgagtacagcgccttcaagctggagaacgagagactgaaggccagcttcgcccccatggaggacaagctgaaccaggcccacctggaggtgcagcagctgaaggccagcgtgaagaactacgagggcatgatcgacaactacaagagccaggtgatgaagaccagactggaggccgacgaggtggccgcccagctggagagatgcgacaaggagaacaagatcctgaaggacgagatgaacaaggagatcgaggccgccagaagacagttccagagccagctggccgacctgcagcagctgcccgacatcctgaagatcaccgaggccaagctggccgagtgccaggaccagctgcagggctacgagagaaagaacatcgacctgaccgccatcatcagcgacctgagaagcagagtgagagactggcagaagggcagccacgagctgaccagagccggcgccagaatccccagatag

SEQ ID NO: 92132 - DNA, 765 bp, Artificial Sequence
  Description of Artificial Sequence: Synthetic coding sequence
atgaccgaggaggtgtggatgggcacctggagaccccacagacccagaggccccatcatggccctgtacagcagccccggccccaagtacctgatcccccccaccaccggcttcatgaagcacacccccaccaagctgagagcccccgcctacagcttcagaggcgcccccatgctgctggccgagaactgcagccccggccccagatacaacgtgaaccccaagatcctgagaaccggcaaggacctgggccccgcctacagcatcctgggcagataccagaccaagaccatgctgacccccggccccggcgactacttccccgagaagagcaccaagtacgtgttcgacagcgcccccagccacagcatcagcgccagaaccaaggccttcagagtggacagcacccccggccccgccgcctacatgctgcccatggtgatgggccccaacaccgtgggcaaggccagccagcccagcttcagcatcaagggcagaagcaagctgggcggcttcagcgacgacctgcacaagacccccggccccgccgcctacagacagaccgacgtgagagtgaccaagttcaaggccccccagtacaccatggccgccagagtggagccccccggcgacaagaccctgaagcccggccccggcgcccacagccccgagaaggtgaccctgaccaagccctgcgcccccgtggtgaccttcggcatcaagcacagcgactacatgacccccctgctggtggacgtggagtag

SEQ ID NO: 92133 - DNA, 417 bp, Artificial Sequence
  Description of Artificial Sequence: Synthetic coding sequence
atgaccgaggaggtgtggatgggcacctggagaccccacagacccagaggccccatcatggccctgtacagcagccccggccccaagtacctgatcccccccaccaccggcttcatgaagcacacccccaccaagctgagagcccccgcctacagcttcagaggcgcccccatgctgctggccgagaactgcagccccggccccagatacaacgtgaaccccaagatcctgagaaccggcaaggacctgggccccgcctacagcatcctgggcagataccagaccaagaccatgctgacccccggccccgccctgaagagcgccttccccagctggaccccccccgaccccacctggagcccccccgtgctggagcccagaggccccacccccagaatgctgggcagccccccctag

SEQ ID NO: 92134 - DNA, 375 bp, Artificial Sequence
  Description of Artificial Sequence: Synthetic coding sequence
atgaccgaggaggtgtggatgggcacctggagaccccacagacccagaggccccatcatggccctgtacagcagccccggccccaagtacctgatcccccccaccaccggcttcatgaagcacacccccaccaagctgagagcccccgcctacagcttcagaggcgcccccatgctgctggccgagaactgcagcccccccaacaccgtgggcaaggccagccagcccagcttcagcatcaagggcagaagcaagctgggcggcttcagcgacgacctgcacaaggtgaccctgaccaagccctgcgcccccgtggtgaccttcggcatcaagcacagcgactacatgacccccctgctggtggacgtggagtag

SEQ ID NO: 92135 - DNA, 774 bp, Artificial Sequence
  Description of Artificial Sequence: Synthetic coding sequence
atggacgccgagtacagcggcaacgagttccccagaagcgagggcgagagagaccagcaccagagacccggcaaggagagaaagagcggcgaggccggctggggcaccggcgagctgggccaggacggcagactgctgagcagcaccctgagcctgagcagcaacagaagcctgggccagagacagaacagccccctgcccttccagtggagaatcacccacagcttcagatggatggcccaggtgctggccagcgagctgagcctggtggccttcatcctgctgctggtggtggccttcagcaagaagtggctggacctgagcagaagcctgttctaccagagatggcccgtggacgtgagcaacagaatccacaccagcgcccacgtgatgagcatgggcctgctgcacttctacaagagcagaagctgcagcgacctggagaacggcaaggtgaccttcatcttcagcaccctgatgctgttccccatcaacatctggatcttcgagctggagagaaacgtgagcatccccatcggctggagctacttcatcggctggctggtgctgatcctgtacttcacctgcgccatcctgtgctacttcaaccacaagagcttctggagcctgatcctgagccaccccagcggcgccgtgagctgcagcagcagcttcggcagcgtggaggagagccccagagcccagaccatcaccgacacccccatcacccaggagggcgtgctggaccccgagcagaaggacacccacgtgtag

SEQ ID NO: 92136 - DNA, 1488 bp, Artificial Sequence
  Description of Artificial Sequence: Synthetic coding sequence
atggtgacctggctgtacagattcctgcccaccagcaacatggccgccaagctgagaagcctgctgccccccgacctgagactgcagttctggctgcacgccagactgcagaagtgcttcctgagcagaggctgcggcagctactgcgccggcgccaaggccagccccctgcccggcaagatggccatgggcctgatgtgcggcagaagagagctgctgagactgctgcagagcggcagaagagtgcacagcgtggccggccccagccagtggctgggcaagcccctgaccaccagactgctgttccccgccgccccctgctgctgcagaccccactacctgttcctggccgccagcggccccagaagcctgagcaccagcgccatcagcttcgccgaggtgcaggtgcaggccccccccgtggtggccgccacccccagccccaccgccgtgcccgaggtggccagcggcgagaccgccgacgtggtgcagaccgccgccgagcagagcttcgccgagctgggcctgggcagctacacccccgtgggcctgatccagaacctgctggagttcatgcacgtggacctgggcctgccctggtggggcgccatcgccgcctgcaccgtgttcgccagatgcctgatcttccccctgatcgtgaccggccagagagaggccgccagaatccacaaccacctgcccgagatccagaagttcagcagcagaatcagagaggccaagctggccggcgaccacatcgagtactacaaggccagcagcgagatggccctgtaccagaagaagcacggcatcaagctgtacaagcccctgatcctgcccgtgacccaggcccccatcttcatcagcttcttcatcgccctgagagagatggccaacctgcccgtgcccagcctgcagaccggcggcctgtggtggttccaggacctgaccgtgagcgaccccatctacatcctgcccctggccgtgaccgccaccatgtgggccgtgctggagctgggcgccgagaccggcgtgcagagcagcgacctgcagtggatgagaaacgtgatcagaatgatgcccctgatcaccctgcccatcaccatgcacttccccaccgccgtgttcatgtactggctgagcagcaacctgttcagcctggtgcaggtgagctgcctgagaatccccgccgtgagaaccgtgctgaagatcccccagagagtggtgcacgacctggacaagctgccccccagagagggcttcctggagagcttcaagaagggctggaagaacgccgagatgaccagacagctgagagagagagagcagagaatgagaaaccagctggagctggccgccagaggccccctgagacagaccttcacccacaaccccctgctgcagcccggcaaggacaacccccccaacatccccagcagcagcagcaagcccaagagcaagtacccctggcacgacaccctgggctag

SEQ ID NO: 92137 - DNA, 1260 bp, Artificial Sequence
  Description of Artificial Sequence: Synthetic coding sequence
atgagaggcacccaggtgcacagcgtggccggccccagccagtggctgggcaagcccctgaccaccagactgctgttccccgccgccccctgctgctgcagaccccactacctgttcctggccgccagcggccccagaagcctgagcaccagcgccatcagcttcgccgaggtgcaggtgcaggccccccccgtggtggccgccacccccagccccaccgccgtgcccgaggtggccagcggcgagaccgccgacgtggtgcagaccgccgccgagcagagcttcgccgagctgggcctgggcagctacacccccgtgggcctgatccagaacctgctggagttcatgcacgtggacctgggcctgccctggtggggcgccatcgccgcctgcaccgtgttcgccagatgcctgatcttccccctgatcgtgaccggccagagagaggccgccagaatccacaaccacctgcccgagatccagaagttcagcagcagaatcagagaggccaagctggccggcgaccacatcgagtactacaaggccagcagcgagatggccctgtaccagaagaagcacggcatcaagctgtacaagcccctgatcctgcccgtgacccaggcccccatcttcatcagcttcttcatcgccctgagagagatggccaacctgcccgtgcccagcctgcagaccggcggcctgtggtggttccaggacctgaccgtgagcgaccccatctacatcctgcccctggccgtgaccgccaccatgtgggccgtgctggagctgggcgccgagaccggcgtgcagagcagcgacctgcagtggatgagaaacgtgatcagaatgatgcccctgatcaccctgcccatcaccatgcacttccccaccgccgtgttcatgtactggctgagcagcaacctgttcagcctggtgcaggtgagctgcctgagaatccccgccgtgagaaccgtgctgaagatcccccagagagtggtgcacgacctggacaagctgccccccagagagggcttcctggagagcttcaagaagggctggaagaacgccgagatgaccagacagctgagagagagagagcagagaatgagaaaccagctggagctggccgccagaggccccctgagacagaccttcacccacaaccccctgctgcagcccggcaaggacaacccccccaacatccccagcagcagcagcaagcccaagagcaagtacccctggcacgacaccctgggctag

SEQ ID NO: 92138 - DNA, 732 bp, Artificial Sequence
  Description of Artificial Sequence: Synthetic coding sequence
atgagcagactgtggtacggcaagaagggcagaagacaccagcccatcaaccacaagtacaccctggtggtgagcgtggccgagtaccacagaagaatcgacgccctgaacaccgaggagctgagaaccctgtgcagaagactgcagatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92139 - DNA, 2520 bp, Artificial Sequence
  Description of Artificial Sequence: Synthetic coding sequence
atggactacctgaccaccttcaccgagaagagcggcagactgctgagaggcaccgccaacagactgctgggcttcggcggcggcggcgaggccagacaggtgagattcgaggactacctgagagagcccgcccagggcgacctgggctgcggcagccccccccacagaccccccgcccccagcagccccgagggccccgacaccggccagaagaagaccctggacaagaaggacggcagaagaatgagcttccagaagcccaagggcaccatcgagtacaccgtggagagcagagacagcctgaacagcatcgccctgaagttcgacaccacccccaacgagctggtgcagctgaacaagctgttcagcagagccgtggtgaccggccaggtgctgtacgtgcccgaccccgagtacgtgagcagcgtggagagcagccccagcctgagccccgtgagccccctgagccccaccagcagcgaggccgagttcgacaagaccaccaaccccgacgtgcaccccaccgaggccacccccagcagcaccttcaccggcatcagacccgccagagtggtgagcagcaccagcgaggaggaggaggccttcaccgagaagttcctgaagatcaactgcaagtacatcaccagcggcaagggcaccgtgagcggcgtgctgctggtgacccccaacaacatcatgttcgacccccacaagaacgaccccctggtgcaggagaacggctgcgaggagtacggcatcatgtgccccatggaggaggtgatgagcgccgccatgtacaaggagatcctggacagcaagatcaaggagagcctgcccatcgacatcgaccagctgagcggcagagacttctgccacagcaagaagatgaccggcagcaacaccgaggagatcgacagcagaatcagagacgccggcaacgacagcgccagcaccgcccccagaagcaccgaggagagcctgagcgaggacgtgttcaccgagagcgagctgagccccatcagagaggagctggtgagcagcgacgagctgagacaggacaagagcagcggcgccagcagcgagagcgtgcagaccgtgaaccaggccgaggtggagagcctgaccgtgaagagcgagagcaccggcacccccggccacctgagaagcgacaccgagcacagcaccaacgaggtgggcaccctgtgccacaagaccgacctgaacaacctggagatggccatcaaggaggaccagatcgccgacaacttccagggcatcagcggccccaaggaggacagcaccagcatcaagggcaacagcgaccaggacagcttcctgcacgagaacagcctgcaccaggaggagagccagaaggagaacatgccctgcggcgagaccgccgagttcaagcagaagcagagcgtgaacaagggcaagcagggcaaggagcagaaccaggacagccagaccgaggccgaggagctgagaaagctgtggaagacccacaccatgcagcagaccaagcagcagagagagaacatccagcaggtgagccagaaggaggccaagcacaagatcaccagcgccgacggccacatcgagagcagcgccctgctgaaggagaagcagagacacagactgcacaagttcctgtgcctgagagtgggcaagcccatgagaaagaccttcgtgagccaggccagcgccaccatgcagcagtacgcccagagagacaagaagcacgagtactggttcgccgtgccccaggagagaaccgaccacctgtacgccttcttcatccagtggagccccgagatctacgccgaggacaccggcgagtacaccagagagcccggcttcatcgtggtgaagaagatcgaggagagcgagaccatcgaggacagcagcaaccaggccgccgccagagagtgggagatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92140 - DNA, 2625 bp, Artificial Sequence
  Description of Artificial Sequence: Synthetic coding sequence
atgaccaaggacaagaacagccccggcctgaagaagaagagccagagcgtggacatcaacgcccccggcttcaaccccctggccggcgccggcaagcagaccccccaggccagcaagccccccgcccccaagacccccatcatcgaggaggagcagaacaacgccgccaacacccagaagcaccccagcagaagaagcgagctgaagagattctacaccatcgacaccggccagaagaagaccctggacaagaaggacggcagaagaatgagcttccagaagcccaagggcaccatcgagtacaccgtggagagcagagacagcctgaacagcatcgccctgaagttcgacaccacccccaacgagctggtgcagctgaacaagctgttcagcagagccgtggtgaccggccaggtgctgtacgtgcccgaccccgagtacgtgagcagcgtggagagcagccccagcctgagccccgtgagccccctgagccccaccagcagcgaggccgagttcgacaagaccaccaaccccgacgtgcaccccaccgaggccacccccagcagcaccttcaccggcatcagacccgccagagtggtgagcagcaccagcgaggaggaggaggccttcaccgagaagttcctgaagatcaactgcaagtacatcaccagcggcaagggcaccgtgagcggcgtgctgctggtgacccccaacaacatcatgttcgacccccacaagaacgaccccctggtgcaggagaacggctgcgaggagtacggcatcatgtgccccatggaggaggtgatgagcgccgccatgtacaaggagatcctggacagcaagatcaaggagagcctgcccatcgacatcgaccagctgagcggcagagacttctgccacagcaagaagatgaccggcagcaacaccgaggagatcgacagcagaatcagagacgccggcaacgacagcgccagcaccgcccccagaagcaccgaggagagcctgagcgaggacgtgttcaccgagagcgagctgagccccatcagagaggagctggtgagcagcgacgagctgagacaggacaagagcagcggcgccagcagcgagagcgtgcagaccgtgaaccaggccgaggtggagagcctgaccgtgaagagcgagagcaccggcacccccggccacctgagaagcgacaccgagcacagcaccaacgaggtgggcaccctgtgccacaagaccgacctgaacaacctggagatggccatcaaggaggaccagatcgccgacaacttccagggcatcagcggccccaaggaggacagcaccagcatcaagggcaacagcgaccaggacagcttcctgcacgagaacagcctgcaccaggaggagagccagaaggagaacatgccctgcggcgagaccgccgagttcaagcagaagcagagcgtgaacaagggcaagcagggcaaggagcagaaccaggacagccagaccgaggccgaggagctgagaaagctgtggaagacccacaccatgcagcagaccaagcagcagagagagaacatccagcaggtgagccagaaggaggccaagcacaagatcaccagcgccgacggccacatcgagagcagcgccctgctgaaggagaagcagagacacagactgcacaagttcctgtgcctgagagtgggcaagcccatgagaaagaccttcgtgagccaggccagcgccaccatgcagcagtacgcccagagagacaagaagcacgagtactggttcgccgtgccccaggagagaaccgaccacctgtacgccttcttcatccagtggagccccgagatctacgccgaggacaccggcgagtacaccagagagcccggcttcatcgtggtgaagaagatcgaggagagcgagaccatcgaggacagcagcaaccaggccgccgccagagagtgggaggtggtgagcgtggccgagtaccacagaagaatcgacgccctgaacaccgaggagctgagaaccctgtgcagaagactgcagatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92141 - DNA, 2541 bp, Artificial Sequence
  Description of Artificial Sequence: Synthetic coding sequence
atgagcgtgagcaacctgagctggctgaagaagaagagccagagcgtggacatcaacgcccccggcttcaaccccctggccggcgccggcaagcagaccccccaggccagcaagccccccgcccccaagacccccatcatcgaggaggagcagaacaacgccgccaacacccagaagcaccccagcagaagaagcgagctgaagagattctacaccatcgacaccggccagaagaagaccctggacaagaaggacggcagaagaatgagcttccagaagcccaagggcaccatcgagtacaccgtggagagcagagacagcctgaacagcatcgccctgaagttcgacaccacccccaacgagctggtgcagctgaacaagctgttcagcagagccgtggtgaccggccaggtgctgtacgtgcccgaccccgagtacgtgagcagcgtggagagcagccccagcctgagccccgtgagccccctgagccccaccagcagcgaggccgagttcgacaagaccaccaaccccgacgtgcaccccaccgaggccacccccagcagcaccttcaccggcatcagacccgccagagtggtgagcagcaccagcgaggaggaggaggccttcaccgagaagttcctgaagatcaactgcaagtacatcaccagcggcaagggcaccgtgagcggcgtgctgctggtgacccccaacaacatcatgttcgacccccacaagaacgaccccctggtgcaggagaacggctgcgaggagtacggcatcatgtgccccatggaggaggtgatgagcgccgccatgtacaaggagatcctggacagcaagatcaaggagagcctgcccatcgacatcgaccagctgagcggcagagacttctgccacagcaagaagatgaccggcagcaacaccgaggagatcgacagcagaatcagagacgccggcaacgacagcgccagcaccgcccccagaagcaccgaggagagcctgagcgaggacgtgttcaccgagagcgagctgagccccatcagagaggagctggtgagcagcgacgagctgagacaggacaagagcagcggcgccagcagcgagagcgtgcagaccgtgaaccaggccgaggtggagagcctgaccgtgaagagcgagagcaccggcacccccggccacctgagaagcgacaccgagcacagcaccaacgaggtgggcaccctgtgccacaagaccgacctgaacaacctggagatggccatcaaggaggaccagatcgccgacaacttccagggcatcagcggccccaaggaggacagcaccagcatcaagggcaacagcgaccaggacagcttcctgcacgagaacagcctgcaccaggaggagagccagaaggagaacatgccctgcggcgagaccgccgagttcaagcagaagcagagcgtgaacaagggcaagcagggcaaggagcagaaccaggacagccagaccgaggccgaggagctgagaaagctgtggaagacccacaccatgcagcagaccaagcagcagagagagaacatccagcaggtgagccagaaggaggccaagcacaagatcaccagcgccgacggccacatcgagagcagcgccctgctgaaggagaagcagagacacagactgcacaagttcctgtgcctgagagtgggcaagcccatgagaaagaccttcgtgagccaggccagcgccaccatgcagcagtacgcccagagagacaagaagcacgagtactggttcgccgtgccccaggagagaaccgaccacctgtacgccttcttcatccagtggagccccgagatctacgccgaggacaccggcgagtacaccagagagcccggcttcatcgtggtgaagaagatcgaggagagcgagaccatcgaggacagcagcaaccaggccgccgccagagagtgggagatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92142 - DNA, 651 bp, Artificial Sequence
  Description of Artificial Sequence: Synthetic coding sequence
atgagcagactgtggtacggcaagaagggcagaagacaccagcccatcaaccacaagtacaccctgatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92143 - DNA, 885 bp, Artificial Sequence
  Description of Artificial Sequence: Synthetic coding sequence
atgcagcagaccaagcagcagagagagaacatccagcaggtgagccagaaggaggccaagcacaagatcaccagcgccgacggccacatcgagagcagcgccctgctgaaggagaagcagagacacagactgcacaagttcctgtgcctgagagtgggcaagcccatgagaaagaccttcgtgagccaggccagcgccaccatgcagcagtacgcccagagagacaagaagcacgagtactggttcgccgtgccccaggagagaaccgaccacctgtacgccttcttcatccagtggagccccgagatctacgccgaggacaccggcgagtacaccagagagcccggcttcatcgtggtgaagaagatcgaggagagcgagaccatcgaggacagcagcaaccaggccgccgccagagagtgggagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92144 - DNA, 1512 bp, Artificial Sequence
  Description of Artificial Sequence: Synthetic coding sequence
atgttctgccagagaaaggacaccggccagaagaagaccctggacaagaaggacggcagaagaatgagcttccagaagcccaagggcaccatcgagtacaccgtggagagcagagacagcctgaacagcatcgccctgaagttcgacaccacccccaacgagctggtgcagctgaacaagctgttcagcagagccgtggtgaccggccaggtgctgtacgtgcccgaccccgagtacgtgagcagcgtggagagcagccccagcctgagccccgtgagccccctgagccccaccagcagcgaggccgagttcgacaagaccaccaaccccgacgtgcaccccaccgaggccacccccagcagcaccttcaccggcatcagacccgccagagtggtgagcagcaccagcgaggaggaggaggccttcaccgagaagttcctgaagatcaactgcaagtacatcaccagcggcaagggcaccgtgagcggcgtgctgctggtgacccccaacaacatcatgttcgacccccacaagaacgaccccctggtgcaggagaacggctgcgaggagtacggcatcatgtgccccatggaggaggtgatgagcgccgccatgtacaaggagatcctggacagcaagatcaaggagagcctgcccatcgacatcgaccagctgagcggcagagacttctgccacagcaagaagatgaccggcagcaacaccgaggagatcgacagcagaatcagagacgccggcaacgacagcgccagcaccgcccccagaagcaccgaggagagcctgagcgaggacgtgttcaccgagagcgagctgagccccatcagagaggagctggtgagcagcgacgagctgagacaggacaagagcagcggcgccagcagcgagagcgtgcagaccgtgaaccaggccgaggtggagagcctgaccgtgaagagcgagagcaccggcacccccggccacctgagaagcgacaccgagcacagcaccaacgaggtgggcaccctgtgccacaagaccgacctgaacaacctggagatggccatcaaggaggaccagatcgccgacaacttccagggcatcagcggccccaaggaggacagcaccagcatcaagggcaacagcgaccaggacagcttcctgcacgagaacagcctgcaccaggaggagagccagaaggagaacatgccctgcggcgagaccgccgagttcaagcagaagcagagcgtgaacaagggcaagcagggcaaggagcagaaccaggacagccagaccgaggccgaggagctgagaaagctgtggaagacccacaccatgcagcagaccaagcagcagagagagaacatccagcaggtgagccagaaggaggccaagcacaagatcaccagcgccgacggccacatcgagagcaagtgctacagagtgaacgaggtgagcagcagcaactgcatggtgagccccagcttcctgaccgacagcaaggccgccgtgccctag

SEQ ID NO: 92145 - DNA, 2622 bp, Artificial Sequence
  Description of Artificial Sequence: Synthetic coding sequence
atgagcgtgagcaacctgagctggctgaagaagaagagccagagcgtggacatcaacgcccccggcttcaaccccctggccggcgccggcaagcagaccccccaggccagcaagccccccgcccccaagacccccatcatcgaggaggagcagaacaacgccgccaacacccagaagcaccccagcagaagaagcgagctgaagagattctacaccatcgacaccggccagaagaagaccctggacaagaaggacggcagaagaatgagcttccagaagcccaagggcaccatcgagtacaccgtggagagcagagacagcctgaacagcatcgccctgaagttcgacaccacccccaacgagctggtgcagctgaacaagctgttcagcagagccgtggtgaccggccaggtgctgtacgtgcccgaccccgagtacgtgagcagcgtggagagcagccccagcctgagccccgtgagccccctgagccccaccagcagcgaggccgagttcgacaagaccaccaaccccgacgtgcaccccaccgaggccacccccagcagcaccttcaccggcatcagacccgccagagtggtgagcagcaccagcgaggaggaggaggccttcaccgagaagttcctgaagatcaactgcaagtacatcaccagcggcaagggcaccgtgagcggcgtgctgctggtgacccccaacaacatcatgttcgacccccacaagaacgaccccctggtgcaggagaacggctgcgaggagtacggcatcatgtgccccatggaggaggtgatgagcgccgccatgtacaaggagatcctggacagcaagatcaaggagagcctgcccatcgacatcgaccagctgagcggcagagacttctgccacagcaagaagatgaccggcagcaacaccgaggagatcgacagcagaatcagagacgccggcaacgacagcgccagcaccgcccccagaagcaccgaggagagcctgagcgaggacgtgttcaccgagagcgagctgagccccatcagagaggagctggtgagcagcgacgagctgagacaggacaagagcagcggcgccagcagcgagagcgtgcagaccgtgaaccaggccgaggtggagagcctgaccgtgaagagcgagagcaccggcacccccggccacctgagaagcgacaccgagcacagcaccaacgaggtgggcaccctgtgccacaagaccgacctgaacaacctggagatggccatcaaggaggaccagatcgccgacaacttccagggcatcagcggccccaaggaggacagcaccagcatcaagggcaacagcgaccaggacagcttcctgcacgagaacagcctgcaccaggaggagagccagaaggagaacatgccctgcggcgagaccgccgagttcaagcagaagcagagcgtgaacaagggcaagcagggcaaggagcagaaccaggacagccagaccgaggccgaggagctgagaaagctgtggaagacccacaccatgcagcagaccaagcagcagagagagaacatccagcaggtgagccagaaggaggccaagcacaagatcaccagcgccgacggccacatcgagagcagcgccctgctgaaggagaagcagagacacagactgcacaagttcctgtgcctgagagtgggcaagcccatgagaaagaccttcgtgagccaggccagcgccaccatgcagcagtacgcccagagagacaagaagcacgagtactggttcgccgtgccccaggagagaaccgaccacctgtacgccttcttcatccagtggagccccgagatctacgccgaggacaccggcgagtacaccagagagcccggcttcatcgtggtgaagaagatcgaggagagcgagaccatcgaggacagcagcaaccaggccgccgccagagagtgggaggtggtgagcgtggccgagtaccacagaagaatcgacgccctgaacaccgaggagctgagaaccctgtgcagaagactgcagatcaccaccagagaggacatcaacagcaagcaggtggccaccgtgaaggccgacctggagagcgagagcttcagacccaacctgagcgaccccagcgagctgctgctgcccgaccagatcgagaagctgaccaagcacctgccccccagaaccatcggctacccctggaccctggtgtacggcaccggcaagcacggcaccagcctgaagaccctgtacagaaccatgaccggcctggacacccccgtgctgatggtgatcaaggacagcgacggccaggtgttcggcgccctggccagcgagcccctgaaggtgagcgacggcttctacggcaccggcgagaccttcgtgttcaccttctgccccgagttcgaggtgttcaagtggaccggcgacaacatgttcttcatcaagggcgacatggacagcctggccttcggcggcggcggcggcgagttcgccctgtggctggacggcgacctgtaccacggcagaagccacagctgcaagaccttcggcaacagaaccctgagcaagaaggaggacttcttcatccaggacatcgagatctgggccttcgagtag

SEQ ID NO: 92146 - DNA, 2541 bp, Artificial Sequence; identical to SEQ ID NO: 92141
  Description of Artificial Sequence: Synthetic coding sequence

SEQ ID NO: 92147 - DNA, 822 bp, Artificial Sequence
  Description of Artificial Sequence: Synthetic coding sequence
atgaccttcgacgacctgaagatccagaccgtgaaggaccagcccgacgagaagagcaacggcaagaaggccaagggcctgcagttcctgtacagcccctggtggtgcctggccgccgccaccctgggcgtgctgtgcctgggcctggtggtgaccatcatggtgctgggcatgcagctgagccaggtgagcgacctgctgacccaggagcaggccaacctgacccaccagaagaagaagctggagggccagatcagcgccagacagcaggccgaggaggccagccaggagagcgagaacgagctgaaggagatgatcgagaccctggccagaaagctgaacgagaagagcaaggagcagatggagctgcaccaccagaacctgaacctgcaggagaccctgaagagagtggccaactgcagcgccccctgcccccaggactggatctggcacggcgagaactgctacctgttcagcagcggcagcttcaactgggagaagagccaggagaagtgcctgagcctggacgccaagctgctgaagatcaacagcaccgccgacctggacttcatccagcaggccatcagctacagcagcttccccttctggatgggcctgagcagaagaaaccccagctacccctggctgtgggaggacggcagccccctgatgccccacctgttcagagtgagaggcgccgtgagccagacctaccccagcggcacctgcgcctacatccagagaggcgccgtgtacgccgagaactgcatcctggccgccttcagcatctgccagaagaaggccaacctgagagcccagtag

SEQ ID NO: 92148 - DNA, 546 bp, Artificial Sequence
  Description of Artificial Sequence: Synthetic coding sequence
atgaccttcgacgacctgaagatccagaccgtgaaggaccagcccgacgagaagagcaacggcaagaaggccaagggcctgcagttcctgtacagcccctggtggtgcctggccgccgccaccctgggcgtgctgtgcctgggcctggtggtgaccatcatggtgctgggcatgcagctgagccaggtgagcgacctgctgacccaggagcaggccaacctgacccaccagaagaagaagctggagggccagatcagcgccagacagcaggccgaggaggccagccaggagagcgagaacgagctgaaggagatgatcgagaccctggccagaaagctgaacgagaagagcaaggagcagatggagctgcaccaccagaacctgaacctgcaggagaccctgaagagagtggccaactgcagcggcctgcaccccgccagcaacttcctgttccagttcagcatcctggacggcgccgtgagcgaggagccccagctgcccatggccctgggcggcagattcagcttcgacgcccccctgatctag

SEQ ID NO: 92149 - DNA, 570 bp, Artificial Sequence
  Description of Artificial Sequence: Synthetic coding sequence
atgaccttcgacgacctgaagatccagaccgtgaaggaccagcccgacgagaagagcaacggcaagaaggccaagggcctgcagttcctgtacagcccctggtggtgcctggccgccgccaccctgggcgtgctgtgcctgggcctggtggtgaccatcatggtgctgggcatgcagctgagccaggtgagcgacctgctgacccaggagcaggccaacctgacccaccagaagaagaagctggagggccagatcagcgccagacagcaggccgaggaggccagccaggagagcgagaacgagctgaaggagatgatcgagaccctggccagaaagctgaacgagaagagcaaggagcagatggagctgcaccaccagaacctgaacctgcaggagaccctgaagagagtggccaactgcagcgccccctgcccccaggactggatctggcacggcgagaactgctacctgttcagcagcggcagcttcaactgggagaagagccaggagaagtgcctgagcctggacgccaagctgctgaagatcaacagcaccgccgacctgatctag

SEQ ID NO: 92150 - DNA, 1623 bp, Artificial Sequence; identical to SEQ ID NO: 88576
  Description of Artificial Sequence: Synthetic coding sequence

SEQ ID NO: 92151 - DNA, 636 bp, Artificial Sequence
  Description of Artificial Sequence: Synthetic coding sequence
atgttccacctgagaacctgcgccgccaagctgagacccctgaccgccagccagaccgtgaagaccttcagccagaacagacccgccgccgccagaaccttccagcagatcagatgctacagcgcccccgtggccgccgagcccttcctgagcggcaccagcagcaactacgtggaggagatgtactgcgcctggctggagaaccccaagagcgtgcacaagagctgggacatcttcttcagaaacaccaacgccggcgccccccccggcaccgcctaccagagccccctgcccctgagcagaggcagcctggccgccgtggcccacgcccagagcctggtggaggcccagcccaacgtggacaagctggtggaggaccacctggccgtgcagagcctgatcagagcctaccagatcagaggccaccacgtggcccagctggaccccctgggcatcctggacgccgacctggacagcagcgtgcccgccgacatcatcagcagcaccgacaagctgggcttctacggcctggacgagagcgacctggacaaggtgttccacctgcccaccaccaccttcatcggcggccaggagagcgccctgcccctgagagagatcatcagaagactggagtag

SEQ ID NO: 92152 - DNA, 1284 bp, Artificial Sequence
  Description of Artificial Sequence: Synthetic coding sequence
atgttccacctgagaacctgcgccgccaagctgagacccctgaccgccagccagaccgtgaagaccttcagccagaacagacccgccgccgccagaaccttccagcagatcagatgctacagcgcccccgtggccgccgagcccttcctgagcggcaccagcagcaactacgtggaggagatgtactgcgcctggctggagaaccccaagagcgtgcacaagagctgggacatcttcttcagaaacaccaacgccggcgccccccccggcaccgcctaccagagccccctgcccctgagcagaggcagcctggccgccgtggcccacgcccagagcctggtggaggcccagcccaacgtggacaagctggtggaggaccacctggccgtgcagagcctgatcagagcctaccagatcagaggccaccacgtggcccagctggaccccctgggcatcctggacgccgacctggacagcagcgtgcccgccgacatcatcagcagcaccgacaagctgggcttctacggcctggacgagagcgacctggacaaggtgttccacctgcccaccaccaccttcatcggcggccaggagagcgccctgcccctgagagagatcatcagaagactggagatggcctactgccagcacatcggcgtggagttcatgttcatcaacgacctggagcagtgccagtggatcagacagaagttcgagacccccggcatcatgcagttcaccaacgaggagaagagaaccctgctggccagactggtgagaagcaccagattcgaggagttcctgcagagaaagtggagcagcgagaagagattcggcctggagggctgcgaggtgctgatccccgccctgaagaccatcatcgacaagagcagcgagaacggcgtggactacgtgatcatgggcatgccccacagaggcagactgaacgtgctggccaacgtgatcagaaaggagctggagcagatcttctgccagttcgacagcaagctggaggccgccgacgagggcagcggcgacgtgaagtaccacctgggcatgtaccacagaagaatcaacagagtgaccgacagaaacatcaccctgagcctggtggccaaccccagccacctggaggccgccgaccccgtggtgatgggcaagaccaaggccgagcagttctactgcggcgacaccgagggcaagaaggtgagacccagagagagaagagccagacagatcgtgaaggccccctgcagcagcatggagttcagaagccccacctag

SEQ ID NO: 92153 - DNA, 2925 bp, Artificial Sequence
  Description of Artificial Sequence: Synthetic coding sequence
atgtactgcgcctggctggagaaccccaagagcgtgcacaagagctgggacatcttcttcagaaacaccaacgccggcgccccccccggcaccgcctaccagagccccctgcccctgagcagaggcagcctggccgccgtggcccacgcccagagcctggtggaggcccagcccaacgtggacaagctggtggaggaccacctggccgtgcagagcctgatcagagcctaccaggtgagaggccaccacatcgccaagctggaccccctgggcatcagctgcgtgaacttcgacgacgcccccgtgaccgtgagcagcaacgtggacctggccgtgttcaaggagagactgagaatgctgaccgtgggcggcttctacggcctggacgagagcgacctggacaaggtgttccacctgcccaccaccaccttcatcggcggccaggagagcgccctgcccctgagagagatcatcagaagactggagatggcctactgccagcacatcggcgtggagttcatgttcatcaacgacctggagcagtgccagtggatcagacagaagttcgagacccccggcatcatgcagttcaccaacgaggagaagagaaccctgctggccagactggtgagaagcaccagattcgaggagttcctgcagagaaagtggagcagcgagaagagattcggcctggagggctgcgaggtgctgatccccgccctgaagaccatcatcgacaagagcagcgagaacggcgtggactacgtgatcatgggcatgccccacagaggcagactgaacgtgctggccaacgtgatcagaaaggagctggagcagatcttctgccagttcgacagcaagctggaggccgccgacgagggcagcggcgacgtgaagtaccacctgggcatgtaccacagaagaatcaacagagtgaccgacagaaacatcaccctgagcctggtggccaaccccagccacctggaggccgccgaccccgtggtgatgggcaagaccaaggccgagcagttctactgcggcgacaccgagggcaagaaggtgatgagcatcctgctgcacggcgacgccgccttcgccggccagggcatcgtgtacgagaccttccacctgagcgacctgcccagctacaccacccacggcaccgtgcacgtggtggtgaacaaccagatcggcttcaccaccgaccccagaatggccagaagcagcccctaccccaccgacgtggccagagtggtgaacgcccccatcttccacgtgaacagcgacgaccccgaggccgtgatgtacgtgtgcaaggtggccgccgagtggagaagcaccttccacaaggacgtggtggtggacctggtgtgctacagaagaaacggccacaacgagatggacgagcccatgttcacccagcccctgatgtacaagcagatcagaaagcagaagcccgtgctgcagaagtacgccgagctgctggtgagccagggcgtggtgaaccagcccgagtacgaggaggagatcagcaagtacgacaagatctgcgaggaggccttcgccagaagcaaggacgagaagatcctgcacatcaagcactggctggacagcccctggcccggcttcttcaccctggacggccagcccagaagcatgagctgccccagcaccggcctgaccgaggacatcctgacccacatcggcaacgtggccagcagcgtgcccgtggagaacttcaccatccacggcggcctgagcagaatcctgaagaccagaggcgagatggtgaagaacagaaccgtggactgggccctggccgagtacatggccttcggcagcctgctgaaggagggcatccacatcagactgagcggccaggacgtggagagaggcaccttcagccacagacaccacgtgctgcacgaccagaacgtggacaagagaacctgcatccccatgaaccacctgtggcccaaccaggccccctacaccgtgtgcaacagcagcctgagcgagtacggcgtgctgggcttcgagctgggcttcgccatggccagccccaacgccctggtgctgtgggaggcccagttcggcgacttccacaacaccgcccagtgcatcatcgaccagttcatctgccccggccaggccaagtgggtgagacagaacggcatcgtgctgctgctgccccacggcatggagggcatgggccccgagcacagcagcgccagacccgagagattcctgcagatgtgcaacgacgaccccgacgtgctgcccgacctgaaggaggccaacttcgacatcaaccagctgtacgactgcaactgggtggtggtgaactgcagcacccccggcaacttcttccacgtgctgagaagacagatcctgctgcccttcagaaagcccctgatcatcttcacccccaagagcctgctgagacaccccgaggccagaagcagcttcgacgagatgctgcccggcacccacttccagagagtgatccccgaggacggccccgccgcccagaaccccgagaacgtgaagagactgctgttctgcaccggcaaggtgtactacgacctgaccagagagagaaaggccagagacatggtgggccaggtggccatcaccagaatcgagcagctgagccccttccccttcgacctgctgctgaaggaggtgcagaagtaccccaacgccgagctggcctggtgccaggaggagcacaagaaccagggctactacgactacgtgaagcccagactgagaaccaccatcagcagagccaagcccgtgtggtacgccggcagagaccccgccgccgcccccgccaccggcaacaagaagacccacctgaccgagctgcagagactgctggacaccgccttcgacctggacgtgttcaagaacttcagctag

SEQ ID NO: 92154 - DNA, 3060 bp, Artificial Sequence
  Description of Artificial Sequence: Synthetic coding sequence
atgttccacctgagaacctgcgccgccaagctgagacccctgaccgccagccagaccgtgaagaccttcagccagaacagacccgccgccgccagaaccttccagcagatcagatgctacagcgcccccgtggccgccgagcccttcctgagcggcaccagcagcaactacgtggaggagatgtactgcgcctggctggagaaccccaagagcgtgcacaagagctgggacatcttcttcagaaacaccaacgccggcgccccccccggcaccgcctaccagagccccctgcccctgagcagaggcagcctggccgccgtggcccacgcccagagcctggtggaggcccagcccaacgtggacaagctggtggaggaccacctggccgtgcagagcctgatcagagcctaccaggtgagaggccaccacatcgccaagctggaccccctgggcatcagctgcgtgaacttcgacgacgcccccgtgaccgtgagcagcaacgtgggcttctacggcctggacgagagcgacctggacaaggtgttccacctgcccaccaccaccttcatcggcggccaggagagcgccctgcccctgagagagatcatcagaagactggagatggcctactgccagcacatcggcgtggagttcatgttcatcaacgacctggagcagtgccagtggatcagacagaagttcgagacccccggcatcatgcagttcaccaacgaggagaagagaaccctgctggccagactggtgagaagcaccagattcgaggagttcctgcagagaaagtggagcagcgagaagagattcggcctggagggctgcgaggtgctgatccccgccctgaagaccatcatcgacaagagcagcgagaacggcgtggactacgtgatcatgggcatgccccacagaggcagactgaacgtgctggccaacgtgatcagaaaggagctggagcagatcttctgccagttcgacagcaagctggaggccgccgacgagggcagcggcgacgtgaagtaccacctgggcatgtaccacagaagaatcaacagagtgaccgacagaaacatcaccctgagcctggtggccaaccccagccacctggaggccgccgaccccgtggtgatgggcaagaccaaggccgagcagttctactgcggcgacaccgagggcaagaaggtgatgagcatcctgctgcacggcgacgccgccttcgccggccagggcatcgtgtacgagaccttccacctgagcgacctgcccagctacaccacccacggcaccgtgcacgtggtggtgaacaaccagatcggcttcaccaccgaccccagaatggccagaagcagcccctaccccaccgacgtggccagagtggtgaacgcccccatcttccacgtgaacagcgacgaccccgaggccgtgatgtacgtgtgcaaggtggccgccgagtggagaagcaccttccacaaggacgtggtggtggacctggtgtgctacagaagaaacggccacaacgagatggacgagcccatgttcacccagcccctgatgtacaagcagatcagaaagcagaagcccgtgctgcagaagtacgccgagctgctggtgagccagggcgtggtgaaccagcccgagtacgaggaggagatcagcaagtacgacaagatctgcgaggaggccttcgccagaagcaaggacgagaagatcctgcacatcaagcactggctggacagcccctggcccggcttcttcaccctggacggccagcccagaagcatgagctgccccagcaccggcctgaccgaggacatcctgacccacatcggcaacgtggccagcagcgtgcccgtggagaacttcaccatccacggcggcctgagcagaatcctgaagaccagaggcgagatggtgaagaacagaaccgtggactgggccctggccgagtacatggccttcggcagcctgctgaaggagggcatccacatcagactgagcggccaggacgtggagagaggcaccttcagccacagacaccacgtgctgcacgaccagaacgtggacaagagaacctgcatccccatgaaccacctgtggcccaaccaggccccctacaccgtgtgcaacagcagcctgagcgagtacggcgtgctgggcttcgagctgggcttcgccatggccagccccaacgccctggtgctgtgggaggcccagttcggcgacttccacaacaccgcccagtgcatcatcgaccagttcatctgccccggccaggccaagtgggtgagacagaacggcatcgtgctgctgctgccccacggcatggagggcatgggccccgagcacagcagcgccagacccgagagattcctgcagatgtgcaacgacgaccccgacgtgctgcccgacctgaaggaggccaacttcgacatcaaccagctgtacgactgcaactgggtggtggtgaactgcagcacccccggcaacttcttccacgtgctgagaagacagatcctgctgcccttcagaaagcccctgatcatcttcacccccaagagcctgctgagacaccccgaggccagaagcagcttcgacgagatgctgcccggcacccacttccagagagtgatccccgaggacggccccgccgcccagaaccccgagaacgtgaagagactgctgttctgcaccggcaaggtgtactacgacctgaccagagagagaaaggccagagacatggtgggccaggtggccatcaccagaatcgagcagctgagccccttccccttcgacctgctgctgaaggaggtgcagaagtaccccaacgccgagctggcctggtgccaggaggagcacaagaaccagggctactacgactacgtgaagcccagactgagaaccaccatcagcagagccaagcccgtgtggtacgccggcagagaccccgccgccgcccccgccaccggcaacaagaagacccacctgaccgagctgcagagactgctggacaccgccttcgacctggacgtgttcaagaacttcagctag

SEQ ID NO: 92155 - DNA, 2424 bp, Artificial Sequence
  Description of Artificial Sequence: Synthetic coding sequence
atggccgccaccgagctgagaggcgtggtgggccccggccccgccgccatcgccgccctgggcggcggcggcgccggcccccccgtggtgggcggcggcggcggcagaggcgacgccggccccggcagcggcgccgccagcggcaccgtggtggccgccgccgccggcggccccggccccggcgccggcggcgtggccgccgccggccccgcccccgccccccccaccggcggcagcggcggcagcggcgccggcggcagcggcagcgccagagagggctggctgttcaagtggaccaactacatcaagggctaccagagaagatggttcgtgctgagcaacggcctgctgagctactacagaagcaaggccgagatgagacacacctgcagaggcaccatcaacctggccaccgccaacatcaccgtggaggacagctgcaacttcatcatcagcaacggcggcgcccagacctaccacctgaaggccagcagcgaggtggagagacagagatgggtgaccgccctggagctggccaaggccaaggccgtgaagatgctggccgagagcgacgagagcggcgacgaggagagcgtgagccagaccgacaagaccgagctgcagaacaccctgagaaccctgagcagcaaggtggaggacctgagcacctgcaacgacctgatcgccaagcacggcaccgccctgcagagaagcctgagcgagctggagagcctgaagctgcccgccgagagcaacgagaagatcaagcaggtgaacgagagagccaccctgttcagaatcaccagcaacgccatgatcaacgcctgcagagacttcctgatgctggcccagacccacagcaagaagtggcagaagagcctgcagtacgagagagaccagagaatcagactggaggagaccctggagcagctggccaagcagcacaaccacctggagagagccttcagaggcgccaccgtgctgcccgccaacacccccggcaacgtgggcagcggcaaggaccagtgctgcagcggcaagggcgacatgagcgacgaggacgacgagaacgagttcttcgacgcccccgagatcatcaccatgcccgagaacctgggccacaagagaaccggcagcaacatcagcggcgccagcagcgacatcagcctggacgagcagtacaagcaccagctggaggagaccaagaaggagaagagaaccagaatcccctacaagcccaactacagcctgaacctgtggagcatcatgaagaactgcatcggcaaggagctgagcaagatccccatgcccgtgaacttcaacgagcccctgagcatgctgcagagactgaccgaggacctggagtaccacgagctgctggacagagccgccaagtgcgagaacagcctggagcagctgtgctacgtggccgccttcaccgtgagcagctacagcaccaccgtgttcagaaccagcaagcccttcaaccccctgctgggcgagaccttcgagctggacagactggaggagaacggctacagaagcctgtgcgagcaggtgagccaccacccccccgccgccgcccaccacgccgagagcaagaacggctggaccctgagacaggagatcaagatcaccagcaagttcagaggcaagtacctgagcatcatgcccctgggcaccatccactgcatcttccacgccaccggccaccactacacctggaagaaggtgaccaccaccgtgcacaacatcatcgtgggcaagctgtggatcgaccagagcggcgagatcgacatcgtgaaccacaagaccggcgacaagtgcaacctgaagttcgtgccctacagctacttcagcagagacgtggccagaaaggtgaccggcgaggtgaccgaccccagcggcaaggtgcacttcgccctgctgggcacctgggacgagaagatggagtgcttcaaggtgcagcccgtgatcggcgagaacggcggcgacgccagacagagaggccacgaggccgaggagagcagagtgatgctgtggaagagaaaccccctgcccaagaacgccgagaacatgtactacttcagcgagctggccctgaccctgaacgcctgggagagcggcaccgcccccaccgacagcagactgagacccgaccagagactgatggagaacggcagatgggacgaggccaacgccgagaagcagagactggaggagaagcagagactgagcagaaagaagagagaggccgaggccatgaaggccaccgaggacggcaccccctacgacccctacaaggccctgtggttcgagagaaagaaggaccccgtgaccaaggagctgacccacatctacagaggcgagtactgggagtgcaaggagaagcaggactggagcagctgccccgacatcttctag

SEQ ID NO: 92156 - DNA, 1224 bp, Artificial Sequence
  Description of Artificial Sequence: Synthetic coding sequence
atggccgccaccgagctgagaggcgtggtgggccccggccccgccgccatcgccgccctgggcggcggcggcgccggcccccccgtggtgggcggcggcggcggcagaggcgacgccggccccggcagcggcgccgccctgcagagactgaccgaggacctggagtaccacgagctgctggacagagccgccaagtgcgagaacagcctggagcagctgtgctacgtggccgccttcaccgtgagcagctacagcaccaccgtgttcagaaccagcaagcccttcaaccccctgctgggcgagaccttcgagctggacagactggaggagaacggctacagaagcctgtgcgagcaggtgagccaccacccccccgccgccgcccaccacgccgagagcaagaacggctggaccctgagacaggagatcaagatcaccagcaagttcagaggcaagtacctgagcatcatgcccctgggcaccatccactgcatcttccacgccaccggccaccactacacctggaagaaggtgaccaccaccgtgcacaacatcatcgtgggcaagctgtggatcgaccagagcggcgagatcgacatcgtgaaccacaagaccggcgacaagtgcaacctgaagttcgtgccctacagctacttcagcagagacgtggccagaaaggtgaccggcgaggtgaccgaccccagcggcaaggtgcacttcgccctgctgggcacctgggacgagaagatggagtgcttcaaggtgcagcccgtgatcggcgagaacggcggcgacgccagacagagaggccacgaggccgaggagagcagagtgatgctgtggaagagaaaccccctgcccaagaacgccgagaacatgtactacttcagcgagctggccctgaccctgaacgcctgggagagcggcaccgcccccaccgacagcagactgagacccgaccagagactgatggagaacggcagatgggacgaggccaacgccgagaagcagagactggaggagaagcagagactgagcagaaagaagagagaggccgaggccatgaaggccaccgaggacggcaccccctacgacccctacaaggccctgtggttcgagagaaagaaggaccccgtgaccaaggagctgacccacatctacagaggcgagtactgggagtgcaaggagaagcaggactggagcagctgccccgacatcttctag

SEQ ID NO: 92157 - DNA, 2751 bp, Artificial Sequence
  Description of Artificial Sequence: Synthetic coding sequence
atgggcaaggccgccgcccccagcagaggcggcggctgcggcggcagaagcagaggcctgagcagcctgttcaccgtggtgccctgcctgagctgccacaccgccgcccccggcatgagcgccagcaccagcggcagcggccccgagcccaagccccagccccagcccgtgcccgagcccgagagaggccccctgagcgagcaggtgagcgaggccgtgagcgaggccgtgcccagaagcgagcccgtgagcgagaccaccagcgagcccgagcccggcgccggccagcccagcgagctgctgcagggcagcagacccggcagcgagagcagcagcggcgtgggcgccggccccttcaccaaggccgccagcgagcccctgagcagagccgtgggcagcgccaccttcctgagacccgagagcggcagcctgcccgccctgaagcccctgcccctgctgagacccggccaggccaagacccccctgggcgtgcccatgagcggcaccggcaccaccagcagcgcccccctggccctgctgcccctggacagcttcgagggctggctgctgaagtggaccaactacctgaagggctaccagagaagatggttcgtgctgggcaacggcctgctgagctactacagaaaccagggcgagatggcccacacctgcagaggcaccatcaacctgagcaccgcccacatcgacaccgaggacagctgcggcatcctgctgaccagcggcgccagaagctaccacctgaaggccagcagcgaggtggacagacagcagtggatcaccgccctggagctggccaaggccaaggccgtgagagtgatgaacacccacagcgacgacagcggcgacgacgacgaggccaccacccccgccgacaagagcgagctgcaccacaccctgaagaacctgagcctgaagctggacgacctgagcacctgcaacgacctgatcgccaagcacggcgccgccctgcagagaagcctgaccgagctggacggcctgaagatccccagcgagagcggcgagaagctgaaggtggtgaacgagagagccaccctgttcagaatcaccagcaacgccatgatcaacgcctgcagagacttcctggagctggccgagatccacagcagaaagtggcagagagccctgcagtacgagcaggagcagagagtgcacctggaggagaccatcgagcagctggccaagcagcacaacagcctggagagagccttccacagcgcccccggcagacccgccaaccccagcaagagcttcatcgagggcagcctgctgacccccaagggcgaggacagcgaggaggacgaggacaccgagtacttcgacgccatggaggacagcaccagcttcatcaccgtgatcaccgaggccaaggaggacagcagaaaggccgagggcagcaccggcaccagcagcgtggactggagcagcgccgacaacgtgctggacggcgccagcctggtgcccaagggcagcagcaaggtgaagagaagagtgagaatccccaacaagcccaactacagcctgaacctgtggagcatcatgaagaactgcatcggcagagagctgagcagaatccccatgcccgtgaacttcaacgagcccctgagcatgctgcagagactgaccgaggacctggagtaccaccacctgctggacaaggccgtgcactgcaccagcagcgtggagcagatgtgcctggtggccgccttcagcgtgagcagctacagcaccaccgtgcacagaatcgccaagcccttcaaccccatgctgggcgagaccttcgagctggacagactggacgacatgggcctgagaagcctgtgcgagcaggtgagccaccacccccccagcgccgcccactacgtgttcagcaagcacggctggagcctgtggcaggagatcaccatcagcagcaagttcagaggcaagtacatcagcatcatgcccctgggcgccatccacctggagttccaggccagcggcaaccactacgtgtggagaaagagcaccagcaccgtgcacaacatcatcgtgggcaagctgtggatcgaccagagcggcgacatcgagatcgtgaaccacaagaccaacgacagatgccagctgaagttcctgccctacagctacttcagcaaggaggccgccagaaaggtgaccggcgtggtgagcgacagccagggcaaggcccactacgtgctgagcggcagctgggacgagcagatggagtgcagcaaggtgatgcacagcagccccagcagccccagcagcgacggcaagcagaagaccgtgtaccagaccctgagcgccaagctgctgtggaagaagtaccccctgcccgagaacgccgagaacatgtactacttcagcgagctggccctgaccctgaacgagcacgaggagggcgtggcccccaccgacagcagactgagacccgaccagagactgatggagaagggcagatgggacgaggccaacaccgagaagcagagactggaggagaagcagagactgagcagaagaagaagactggaggcctgcggccccggcagcagctgcagcagcgaggaggagaaggaggccgacgcctacacccccctgtggttcgagaagagactggaccccctgaccggcgagatggcctgcgtgtacaagggcggctactgggaggccaaggagaagcaggactggcacatgtgccccaacatcttctag

SEQ ID NO: 92158 - DNA, 2625 bp, Artificial Sequence
  Description of Artificial Sequence: Synthetic coding sequence
atgggcaaggccgccgcccccagcagaggcggcggctgcggcggcagaagcagaggcctgagcagcctgttcaccgtggtgccctgcctgagctgccacaccgccgcccccggcatgagcgccagcaccagcggcagcggccccgagcccaagccccagccccagcccgtgcccgagcccgagagaggccccctgagcgagcaggtgagcgaggccgtgagcgaggccgtgcccagaagcgagcccgtgagcgagaccaccagcgagcccgagcccggcgccggccagcccagcgagctgctgcagggcagcagacccggcagcgagagcagcagcggcgtgggcgccggccccttcaccaaggccgccagcgagcccctgagcagagccgtgggcagcgccaccttcctgagacccgagagcggcagcctgcccgccctgaagcccctgcccctgctgagacccggccaggccaagacccccctgggcgtgcccatgagcggcaccggcaccaccagcagcgcccccctggccctgctgcccctggacagcttcgagggctggctgctgaagtggaccaactacctgaagggctaccagagaagatggttcgtgctgggcaacggcctgctgagctactacagaaaccagggcgagatggcccacacctgcagaggcaccatcaacctgagcaccgcccacatcgacaccgaggacagctgcggcatcctgctgaccagcggcgccagaagctaccacctgaaggccagcagcgaggtggacagacagcagtggatcaccgccctggagctggccaaggccaaggccgtgagagtgatgaacacccacagcgacgacagcggcgacgacgacgaggccaccacccccgccgacaagagcgagctgcaccacaccctgaagaacctgagcctgaagctggacgacctgagcacctgcaacgacctgatcgccaagcacggcgccgccctgcagagaagcctgaccgagctggacggcctgaagatccccagcgagagcggcgagaagctgaaggtggtgaacgagagagccaccctgttcagaatcaccagcaacgccatgatcaacgcctgcagagacttcctggagctggccgagatccacagcagaaagtggcagagagccctgcagtacgagcaggagcagagagtgcacctggaggagaccatcgagcagctggccaagcagcacaacagcctggagagagccttccacagcgcccccggcagacccgccaaccccagcaagagcttcatcgagggcagcctgctgacccccaagggcgaggacagcgaggaggacgaggacaccgagtacttcgacgccatggaggacagcaccagcttcatcaccgtgatcaccgaggccaaggaggacagcagaaaggccgagggcagcaccggcaccagcagcgtggactggagcagcgccgacaacgtgaacttcaacgagcccctgagcatgctgcagagactgaccgaggacctggagtaccaccacctgctggacaaggccgtgcactgcaccagcagcgtggagcagatgtgcctggtggccgccttcagcgtgagcagctacagcaccaccgtgcacagaatcgccaagcccttcaaccccatgctgggcgagaccttcgagctggacagactggacgacatgggcctgagaagcctgtgcgagcaggtgagccaccacccccccagcgccgcccactacgtgttcagcaagcacggctggagcctgtggcaggagatcaccatcagcagcaagttcagaggcaagtacatcagcatcatgcccctgggcgccatccacctggagttccaggccagcggcaaccactacgtgtggagaaagagcaccagcaccgtgcacaacatcatcgtgggcaagctgtggatcgaccagagcggcgacatcgagatcgtgaaccacaagaccaacgacagatgccagctgaagttcctgccctacagctacttcagcaaggaggccgccagaaaggtgaccggcgtggtgagcgacagccagggcaaggcccactacgtgctgagcggcagctgggacgagcagatggagtgcagcaaggtgatgcacagcagccccagcagccccagcagcgacggcaagcagaagaccgtgtaccagaccctgagcgccaagctgctgtggaagaagtaccccctgcccgagaacgccgagaacatgtactacttcagcgagctggccctgaccctgaacgagcacgaggagggcgtggcccccaccgacagcagactgagacccgaccagagactgatggagaagggcagatgggacgaggccaacaccgagaagcagagactggaggagaagcagagactgagcagaagaagaagactggaggcctgcggccccggcagcagctgcagcagcgaggagggcgaggccggcagagagggcagacccggcggcgaggagagaggcgccagagtgggcgtgccccagggcagaatccccggcgagcaggccaccagcccccccaccagccccctgtgcctgcccagcagagagggcggcggctgcctgcacgccaccgtggtgtag

SEQ ID NO: 92159 - DNA, 2253 bp, Artificial Sequence
  Description of Artificial Sequence: Synthetic coding sequence
atgcacagacagagaaccagaaccatgagcagcctggccgccaagagactgggcatgaacagaagacccgccggcagcggcggcggcggcggcgaggccgccacctggggccacagattctggagaccccaggagagacccaccgacagaaaccagggcgagatggcccacacctgcagaggcaccatcaacctgagcaccgcccacatcgacaccgaggacagctgcggcatcctgctgaccagcggcgccagaagctaccacctgaaggccagcagcgaggtggacagacagcagtggatcaccgccctggagctggccaaggccaaggccgtgagagtgatgaacacccacagcgacgacagcggcgacgacgacgaggccaccacccccgccgacaagagcgagctgcaccacaccctgaagaacctgagcctgaagctggacgacctgagcacctgcaacgacctgatcgccaagcacggcgccgccctgcagagaagcctgaccgagctggacggcctgaagatccccagcgagagcggcgagaagctgaaggtggtgaacgagagagccaccctgttcagaatcaccagcaacgccatgatcaacgcctgcagagacttcctggagctggccgagatccacagcagaaagtggcagagagccctgcagtacgagcaggagcagagagtgcacctggaggagaccatcgagcagctggccaagcagcacaacagcctggagagagccttccacagcgcccccggcagacccgccaaccccagcaagagcttcatcgagggcagcctgctgacccccaagggcgaggacagcgaggaggacgaggacaccgagtacttcgacgccatggaggacagcaccagcttcatcaccgtgatcaccgaggccaaggaggacagaaaggccgagggcagcaccggcaccagcagcgtggactggagcagcgccgacaacgtgctggacggcgccagcctggtgcccaagggcagcagcaaggtgaagagaagagtgagaatccccaacaagcccaactacagcctgaacctgtggagcatcatgaagaactgcatcggcagagagctgagcagaatccccatgcccgtgaacttcaacgagcccctgagcatgctgcagagactgaccgaggacctggagtaccaccacctgctggacaaggccgtgcactgcaccagcagcgtggagcagatgtgcctggtggccgccttcagcgtgagcagctacagcaccaccgtgcacagaatcgccaagcccttcaaccccatgctgggcgagaccttcgagctggacagactggacgacatgggcctgagaagcctgtgcgagcaggtgagccaccacccccccagcgccgcccactacgtgttcagcaagcacggctggagcctgtggcaggagatcaccatcagcagcaagttcagaggcaagtacatcagcatcatgcccctgggcgccatccacctggagttccaggccagcggcaaccactacgtgtggagaaagagcaccagcaccgtgcacaacatcatcgtgggcaagctgtggatcgaccagagcggcgacatcgagatcgtgaaccacaagaccaacgacagatgccagctgaagttcctgccctacagctacttcagcaaggaggccgccagaaaggtgaccggcgtggtgagcgacagccagggcaaggcccactacgtgctgagcggcagctgggacgagcagatggagtgcagcaaggtgatgcacagcagccccagcagccccagcagcgacggcaagcagaagaccgtgtaccagaccctgagcgccaagctgctgtggaagaagtaccccctgcccgagaacgccgagaacatgtactacttcagcgagctggccctgaccctgaacgagcacgaggagggcgtggcccccaccgacagcagactgagacccgaccagagactgatggagaagggcagatgggacgaggccaacaccgagaagcagagactggaggagaagcagagactgagcagaagaagaagactggaggcctgcggccccggcagcagctgcagcagcgaggaggagaaggaggccgacgcctacacccccctgtggttcgagaagagactggaccccctgaccggcgagatggcctgcgtgtacaagggcggctactgggaggccaaggagaagcaggactggcacatgtgccccaacatcttctag

SEQ ID NO: 92160 - DNA, 1980 bp, Artificial Sequence
  Description of Artificial Sequence: Synthetic coding sequence
atgaagggcagaggctgctgggacaccgccagcgtgagaagcttctgcagcagcggctgcctgaacaagttcaagaaggacgacagcggcgacgacgacgaggccaccacccccgccgacaagagcgagctgcaccacaccctgaagaacctgagcctgaagctggacgacctgagcacctgcaacgacctgatcgccaagcacggcgccgccctgcagagaagcctgaccgagctggacggcctgaagatccccagcgagagcggcgagaagctgaaggtggtgaacgagagagccaccctgttcagaatcaccagcaacgccatgatcaacgcctgcagagacttcctggagctggccgagatccacagcagaaagtggcagagagccctgcagtacgagcaggagcagagagtgcacctggaggagaccatcgagcagctggccaagcagcacaacagcctggagagagccttccacagcgcccccggcagacccgccaaccccagcaagagcttcatcgagggcagcctgctgacccccaagggcgaggacagcgaggaggacgaggacaccgagtacttcgacgccatggaggacagcaccagcttcatcaccgtgatcaccgaggccaaggaggacagcagaaaggccgagggcagcaccggcaccagcagcgtggactggagcagcgccgacaacgtgctggacggcgccagcctggtgcccaagggcagcagcaaggtgaagagaagagtgagaatccccaacaagcccaactacagcctgaacctgtggagcatcatgaagaactgcatcggcagagagctgagcagaatccccatgcccgtgaacttcaacgagcccctgagcatgctgcagagactgaccgaggacctggagtaccaccacctgctggacaaggccgtgcactgcaccagcagcgtggagcagatgtgcctggtggccgccttcagcgtgagcagctacagcaccaccgtgcacagaatcgccaagcccttcaaccccatgctgggcgagaccttcgagctggacagactggacgacatgggcctgagaagcctgtgcgagcaggtgagccaccacccccccagcgccgcccactacgtgttcagcaagcacggctggagcctgtggcaggagatcaccatcagcagcaagttcagaggcaagtacatcagcatcatgcccctgggcgccatccacctggagttccaggccagcggcaaccactacgtgtggagaaagagcaccagcaccgtgcacaacatcatcgtgggcaagctgtggatcgaccagagcggcgacatcgagatcgtgaaccacaagaccaacgacagatgccagctgaagttcctgccctacagctacttcagcaaggaggccgccagaaaggtgaccggcgtggtgagcgacagccagggcaaggcccactacgtgctgagcggcagctgggacgagcagatggagtgcagcaaggtgatgcacagcagccccagcagccccagcagcgacggcaagcagaagaccgtgtaccagaccctgagcgccaagctgctgtggaagaagtaccccctgcccgagaacgccgagaacatgtactacttcagcgagctggccctgaccctgaacgagcacgaggagggcgtggcccccaccgacagcagactgagacccgaccagagactgatggagaagggcagatgggacgaggccaacaccgagaagcagagactggaggagaagcagagactgagcagaagaagaagactggaggcctgcggccccggcagcagctgcagcagcgaggaggccgagaaggaggccgacgcctacacccccctgtggttcgagaagagactggaccccctgaccggcgagatggcctgcgtgtacaagggcggctactgggaggccaaggagaagcaggactggcacatgtgccccaacatcttctag

SEQ ID NO: 92161 - DNA, 1383 bp, Artificial Sequence
  Description of Artificial Sequence: Synthetic coding sequence
atggaggacagcaccagcttcatcaccgtgatcaccgaggccaaggaggacagaaaggccgagggcagcaccggcaccagcagcgtggactggagcagcgccgacaacgtgctggacggcgccagcctggtgcccaagggcagcagcaaggtgaagagaagagtgagaatccccaacaagcccaactacagcctgaacctgtggagcatcatgaagaactgcatcggcagagagctgagcagaatccccatgcccgtgaacttcaacgagcccctgagcatgctgcagagactgaccgaggacctggagtaccaccacctgctggacaaggccgtgcactgcaccagcagcgtggagcagatgtgcctggtggccgccttcagcgtgagcagctacagcaccaccgtgcacagaatcgccaagcccttcaaccccatgctgggcgagaccttcgagctggacagactggacgacatgggcctgagaagcctgtgcgagcaggtgagccaccacccccccagcgccgcccactacgtgttcagcaagcacggctggagcctgtggcaggagatcaccatcagcagcaagttcagaggcaagtacatcagcatcatgcccctgggcgccatccacctggagttccaggccagcggcaaccactacgtgtggagaaagagcaccagcaccgtgcacaacatcatcgtgggcaagctgtggatcgaccagagcggcgacatcgagatcgtgaaccacaagaccaacgacagatgccagctgaagttcctgccctacagctacttcagcaaggaggccgccagaaaggtgaccggcgtggtgagcgacagccagggcaaggcccactacgtgctgagcggcagctgggacgagcagatggagtgcagcaaggtgatgcacagcagccccagcagccccagcagcgacggcaagcagaagaccgtgtaccagaccctgagcgccaagctgctgtggaagaagtaccccctgcccgagaacgccgagaacatgtactacttcagcgagctggccctgaccctgaacgagcacgaggagggcgtggcccccaccgacagcagactgagacccgaccagagactgatggagaagggcagatgggacgaggccaacaccgagaagcagagactggaggagaagcagagactgagcagaagaagaagactggaggcctgcggccccggcagcagctgcagcagcgaggaggagaaggaggccgacgcctacacccccctgtggttcgagaagagactggaccccctgaccggcgagatggcctgcgtgtacaagggcggctactgggaggccaaggagaagcaggactggcacatgtgccccaacatcttctag

SEQ ID NO: 92162 - DNA, 2295 bp, Artificial Sequence
  Description of Artificial Sequence: Synthetic coding sequence
atggagagagccgtgcagggcaccgacggcggcggcggcagcaacagcagcagcagaagcagcagcagagccaccagcgccggcagcagccccagctgcagcctggccggcagaggcgtgagcagcagaagcgccgccgccggcctgggcggcggcggcagcagaagcagccccggcagcgtggccgccagccccagcggcggcggcggcagaagaagagagcccgccctggagggcgtgctgagcaagtacaccaacctgctgcagggctggcagaacagatacttcgtgctggacttcgaggccggcatcctgcagtacttcgtgaacgagcagagcaagcaccagaagcccagaggcgtgctgagcctgagcggcgccatcgtgagcctgagcgacgaggccccccacatgctggtggtgtacagcgccaacggcgagatgttcaagctgagagccgccgacgccaaggagaagcagttctgggtgacccagctgagagcctgcgccaagtaccacatggagatgaacagcaagagcgcccccagcagcagaagcagaagcctgaccctgctgccccacggcacccccaacagcgccagcccctgcagccagagacacctgagcgtgggcgcccccggcgtggtgaccatcacccaccacaagagccccgccgccgccagaagagccaagagccagtacagcggccagctgcacgaggtgagagagatgatgaaccaggtggagggccagcagaagaacctggtgcacgccatcgagagcctgcccggcagcggccccctgaccgccctggaccaggacctgctgctgctgaaggccaccagcgccgccaccctgagctgcctgggcgagtgcctgaacctgctgcagcagagcgtgcaccaggccggccagcccagccagaagcccggcgccagcgagaacatcctgggctggcacggcagcaagagccacagcaccgagcagctgaagaacggcaccctgggcagcctgcccagcgccagcgccaacatcacctgggccatcctgcccaacagcgccgaggacgagcagaccagccagcccgagcccgagcccaacagcggcagcgagctggtgctgagcgaggacgagaagagcgacaacgaggacaaggaggagaccgagctgggcgtgatggaggaccagagaagcatcatcctgcacctgatcagccagctgaagctgggcatggacctgaccaaggtggtgctgcccaccttcatcctggagaagagaagcctgctggagatgtacgccgacttcatggcccaccccgacctgctgctggccatcaccgccggcgccacccccgaggagagagtgatctgcttcgtggagtactacctgaccgccttccacgagggcagaaagggcgccctggccaagaagccctacaaccccatcatcggcgagaccttccactgcagctgggaggtgcccaaggacagagtgaagcccaagagaaccgccagcagaagccccgccagctgccacgagcaccccatggccgacgaccccagcaagagctacaagctgagattcgtggccgagcaggtgagccaccacccccccatcagctgcttctactgcgagtgcgaggagaagagactgtgcgtgaacacccacgtgtggaccaagagcaagttcatgggcatgagcgtgggcgtgagcatgatcggcgagggcgtgctgagactgctggagcacggcgaggagtacgtgttcaccctgcccagcgcctacgccagaagcatcctgaccatcccctgggtggagctgggcggcaaggtgagcatcaactgcgccaagaccggctacagcgccaccgtgatcttccacaccaagcccttctacggcggcaaggtgcacagagtgaccgccgaggtgaagcacaaccccaccaacaccatcgtgtgcaaggcccacggcgagtggaacggcaccctggagttcacctacaacaacggcgagaccaaggtgatcgacaccaccaccctgcccgtgtaccccaagaagatcagacccctggagaagcagggccccatggagagcagaaacctgtggagagaggtgaccagatacctgagactgggcgacatcgacgccgccaccgagcagaagagacacctggaggagaagcagagagtggaggagagaaagagagagaacctgagaaccccctggaagcccaagtacttcatccaggagggcgacggctgggtgtacttcaaccccctgtggaaggcccactag

SEQ ID NO: 92163 - DNA, 2103 bp, Artificial Sequence
  Description of Artificial Sequence: Synthetic coding sequence
atggagagagccgtgcagggcaccgacggcggcggcggcagcaacagcagcagcagaagcagcagcagagccaccagcgccggcagcagccccagctgcagcctggccggcagaggcgtgagcagcagaagcgccgccgccggcctgggcggcggcggcagcagaagcagccccggcagcgtggccgccagccccagcggcggcggcggcagaagaagagagcccgccctggagggcgtgctgagcaagtacaccaacctgctgcagggctggcagaacagatacttcgtgctggacttcgaggccggcatcctgcagtacttcgtgaacgagcagagcaagcaccagaagcccagaggcgtgctgagcctgagcggcgccatcgtgagcctgagcgacgaggccccccacatgctggtggtgtacagcgccaacggcgagatgttcaagctgagagccgccgacgccaaggagaagcagttctgggtgacccagctgagagcctgcgccaagtaccacatggagatgaacagcaagatgatgaaccaggtggagggccagcagaagaacctggtgcacgccatcgagagcctgcccggcagcggccccctgaccgccctggaccaggacctgctgctgctgaaggccaccagcgccgccaccctgagctgcctgggcgagtgcctgaacctgctgcagcagagcgtgcaccaggccggccagcccagccagaagcccggcgccagcgagaacatcctgggctggcacggcagcaagagccacagcaccgagcagctgaagaacggcaccctgggcagcctgcccagcgccagcgccaacatcacctgggccatcctgcccaacagcgccgaggacgagcagaccagccagcccgagcccgagcccaacagcggcagcgagctggtgctgagcgaggacgagaagagcgacaacgaggacaaggaggagaccgagctgggcgtgatggaggaccagagaagcatcatcctgcacctgatcagccagctgaagctgggcatggacctgaccaaggtggtgctgcccaccttcatcctggagaagagaagcctgctggagatgtacgccgacttcatggcccaccccgacctgctgctggccatcaccgccggcgccacccccgaggagagagtgatctgcttcgtggagtactacctgaccgccttccacgagggcagaaagggcgccctggccaagaagccctacaaccccatcatcggcgagaccttccactgcagctgggaggtgcccaaggacagagtgaagcccaagagaaccgccagcagaagccccgccagctgccacgagcaccccatggccgacgaccccagcaagagctacaagctgagattcgtggccgagcaggtgagccaccacccccccatcagctgcttctactgcgagtgcgaggagaagagactgtgcgtgaacacccacgtgtggaccaagagcaagttcatgggcatgagcgtgggcgtgagcatgatcggcgagggcgtgctgagactgctggagcacggcgaggagtacgtgttcaccctgcccagcgcctacgccagaagcatcctgaccatcccctgggtggagctgggcggcaaggtgagcatcaactgcgccaagaccggctacagcgccaccgtgatcttccacaccaagcccttctacggcggcaaggtgcacagagtgaccgccgaggtgaagcacaaccccaccaacaccatcgtgtgcaaggcccacggcgagtggaacggcaccctggagttcacctacaacaacggcgagaccaaggtgatcgacaccaccaccctgcccgtgtaccccaagaagatcagacccctggagaagcagggccccatggagagcagaaacctgtggagagaggtgaccagatacctgagactgggcgacatcgacgccgccaccgagcagaagagacacctggaggagaagcagagagtggaggagagaaagagagagaacctgagaaccccctggaagcccaagtacttcatccaggagggcgacggctgggtgtacttcaaccccctgtggaaggcccactag

SEQ ID NO: 92164 - DNA, 2244 bp, Artificial Sequence
  Description of Artificial Sequence: Synthetic coding sequence
atgcagggcggcgagcccgtgagcaccatgaaggtgagcgagagcgagggcaagctggagggccaggccaccgccgtgacccccaacaagaacagcagctgcggcggcggcatcagcagcagcagcagcagcagaggcggcagcgccaagggctggcagtacagcgaccacatggagaacgtgtacggctacctgatgaagtacaccaacctggtgaccggctggcagtacagattcttcgtgctgaacaacgaggccggcctgctggagtacttcgtgaacgagcagagcagaaaccagaagcccagaggcaccctgcagctggccggcgccgtgatcagccccagcgacgaggacagccacaccttcaccgtgaacgccgccagcggcgagcagtacaagctgagagccaccgacgccaaggagagacagcactgggtgagcagactgcagatctgcacccagcaccacaccgaggccatcggcaagaacaacccccccctgaagagcagaagcttcagcctggccagcagcagcaacagccccatcagccagagaagacccagccagaacgccatcagcttcttcaacgtgggccacagcaagctgcagagcctgagcaagagaaccaacctgccccccgaccacctggtggaggtgagagagatgatgagccacgccgagggccagcagagagacctgatcagaagaatcgagtgcctgcccaccagcggccacctgagcagcctggaccaggacctgctgatgctgaaggccaccagcatggccaccatgaactgcctgaacgactgcttccacatcctgcagctgcagcacgccagccaccagaagggcagcctgcccagcggcaccaccatcgagtggctggagcccaagatcagcctgagcaaccactacaagaacggcgccgaccagcccttcgccaccgaccagagcaagcccgtggccgtgcccgaggagcagcccgtggccgagagcggcctgctggccagagagcccgaggagatcaacgccgacgacgagatcgaggacacctgcgaccacaaggaggacgacctgggcgccgtggaggagcagagaagcgtgatcctgcacctgctgagccagctgaagctgggcatggacctgaccagagtggtgctgcccaccttcatcctggagaagagaagcctgctggagatgtacgccgacttcatgagccaccccgacctgttcatcgccatcaccaacggcgccaccgccgaggacagaatgatcagattcgtggagtactacctgaccagcttccacgagggcagaaagggcgccatcgccaagaagccctacaaccccatcatcggcgagaccttccactgcagctggaagatgcccaagagcgaggtggccagcagcgtgttcagcagcagcagcacccagggcgtgaccaaccacgcccccctgagcggcgagagcctgacccaggtgggcagcgactgctacaccgtgagattcgtggccgagcaggtgagccaccacccccccgtgagcggcttctacgccgagtgcaccgagagaaagatgtgcgtgaacgcccacgtgtggaccaagagcaagttcctgggcatgagcatcggcgtgaccatggtgggcgagggcatcctgagcctgctggagcacggcgaggagtacaccttcagcctgccctgcgcctacgccagaagcatcctgaccgtgccctgggtggagctgggcggcaaggtgagcgtgaactgcgccaagaccggctacagcgccagcatcaccttccacaccaagcccttctacggcggcaagctgcacagagtgaccgccgaggtgaagcacaacatcaccaacaccgtggtgtgcagagtgcagggcgagtggaacagcgtgctggagttcacctacagcaacggcgagaccaagtacgtggacctgaccaagctggccgtgaccaagaagagagtgagacccctggagaagcaggaccccttcgagagcagaagactgtggaagaacgtgaccgacagcctgagagagagcgagatcgacaaggccaccgagcacaagcacaccctggaggagagacagagaaccgaggagagacacagaaccgagaccggcaccccctggaagaccaagtacttcatcaaggagggcgacggctgggtgtaccacaagcccctgtggaagatcatccccaccacccagcccgccgagtag

SEQ ID NO: 92165 - DNA, 2853 bp, Artificial Sequence
  Description of Artificial Sequence: Synthetic coding sequence
atgaacaccgaggccgagcagcagctgctgcaccacgccagaaacggcaacgccgaggaggtgagacagctgctggagaccatggccagaaacgaggtgatcgccgacatcaactgcaagggcagaagcaagagcaacctgggctggacccccctgcacctggcctgctacttcggccacagacaggtggtgcaggacctgctgaaggccggcgccgaggtgaacgtgctgaacgacatgggcgacacccccctgcacagagccgccttcaccggcagaaaggagctggtgatgctgctgctggagtacaacgccgacaccaccatcgtgaacggcagcggccagaccgccaaggaggtgacccacgccgaggagatcagaagcatgctggaggccgtggagagaacccagcagagaaagctggaggagctgctgctggccgccgccagagagggcaagaccaccgagctgaccgccctgctgaacagacccaacccccccgacgtgaactgcagcgaccagctgggcaacacccccctgcactgcgccgcctacagagcccacaagcagtgcgccctgaagctgctgagaagcggcgccgaccccaacctgaagaacaagaacgaccagaagcccctggacctggcccagggcgccgagatgaagcacatcctggtgggcaacaaggtgatctacaaggccctgaagagatacgagggccccctgtggaagagcagcagattcttcggctggagactgttctgggtggtgctggagcacggcgtgctgagctggtacagaaagcagcccgacgccgtgcacaacatctacagacagggctgcaagcacctgacccaggccgtgtgcaccgtgaagagcaccgacagctgcctgttcttcatcaagtgcttcgacgacaccatccacggcttcagagtgcccaagaacagcctgcagcagagcagagaggactggctggaggccatcgaggagcacagcgcctacagcacccactactgcagccaggaccagctgaccgacgaggaggaggaggacaccgtgagcgccgccgacctgaagaagagcctggagaaggcccagagctgccagcagagactggacagagagatcagcaacttcctgaagatgatcaaggagtgcgacatggccaaggagatgctgcccagcttcctgcagaaggtggaggtggtgagcgaggccagcagagagacctgcgtggccctgaccgactgcctgaacctgttcaccaagcaggagggcgtgagaaacttcaagctggagcaggagcaggagaagaacaagatcctgagcgaggccctggagaccctggccaccgagcaccacgagctggagcagagcctggtgaagggcagcccccccgccagcatcctgagcgaggacgagttctacgacgccctgagcgacagcgagagcgagagaagcctgagcagactggaggccgtgaccgccagaagcttcgaggaggagggcgagcacctgggcagcagaaagcacagaatgagcgaggagaaggactgcggcggcggcgacgccctgagcaacggcatcaagaagcacagaaccagcctgcccagccccatgttcagcagaaacgacttcagcatctggagcatcctgagaaagtgcatcggcatggagctgagcaagatcaccatgcccgtgatcttcaacgagcccctgagcttcctgcagagactgaccgagtacatggagcacacctacctgatccacaaggccagcagcctgagcgaccccgtggagagaatgcagtgcgtggccgccttcgccgtgagcgccgtggccagccagtgggagagaaccggcaagcccttcaaccccctgctgggcgagacctacgagctggtgagagacgacctgggcttcagactgatcagcgagcaggtgagccaccacccccccatcagcgccttccacgccgagggcctgaacaacgacttcatcttccacggcagcatctaccccaagctgaagttctggggcaagagcgtggaggccgagcccaagggcaccatcaccctggagctgctggagcacaacgaggcctacacctggaccaaccccacctgctgcgtgcacaacatcatcgtgggcaagctgtggatcgagcagtacggcaacgtggagatcatcaaccacaagaccggcgacaagtgcgtgctgaacttcaagccctgcggcctgttcggcaaggagctgcacaaggtggagggctacatccaggacaagagcaagaagaagctgtgcgccctgtacggcaagtggaccgagtgcctgtacagcgtggaccccgccaccttcgacgcctacaagaagaacgacaagaagaacaccgaggagaagaagaacagcaagcagatgagcaccagcgaggagctggacgagatgcccgtgcccgacagcgagagcgtgttcatcatccccggcagcgtgctgctgtggagaatcgcccccagaccccccaacagcgcccagatgtacaacttcaccagcttcgccatggtgctgaacgaggtggacaaggacatggagagcgtgatccccaagaccgactgcagactgagacccgacatcagagccatggagaacggcgagatcgaccaggccagcgaggagaagaagagactggaggagaagcagagagccgccagaaagaacagaagcaagagcgaggaggactggaagaccagatggttccaccagggccccaacccctacaacggcgcccaggactggatctacagcggcagctactgggacagaaactacttcaacctgcccgacatctactag

SEQ ID NO: 92166 - DNA, 1707 bp, Artificial Sequence
  Description of Artificial Sequence: Synthetic coding sequence
atgatcaaggagtgcgacatggccaaggagatgctgcccagcttcctgcagaaggtggaggtggtgagcgaggccagcagagagacctgcgtggccctgaccgactgcctgaacctgttcaccaagcaggagggcgtgagaaacttcaagctggagcaggagcaggagaagaacaagatcctgagcgaggccctggagaccctggccaccgagcaccacgagctggagcagagcctggtgaagggcagcccccccgccagcatcctgagcgaggacgagttctacgacgccctgagcgacagcgagagcgagagaagcctgagcagactggaggccgtgaccgccagaagcttcgaggaggagggcgagcacctgggcagcagaaagcacagaatgagcgaggagaaggactgcggcggcggcgacgccctgagcaacggcatcaagaagcacagaaccagcctgcccagccccatgttcagcagaaacgacttcagcatctggagcatcctgagaaagtgcatcggcatggagctgagcaagatcaccatgcccgtgatcttcaacgagcccctgagcttcctgcagagactgaccgagtacatggagcacacctacctgatccacaaggccagcagcctgagcgaccccgtggagagaatgcagtgcgtggccgccttcgccgtgagcgccgtggccagccagtgggagagaaccggcaagcccttcaaccccctgctgggcgagacctacgagctggtgagagacgacctgggcttcagactgatcagcgagcaggtgagccaccacccccccatcagcgccttccacgccgagggcctgaacaacgacttcatcttccacggcagcatctaccccaagctgaagttctggggcaagagcgtggaggccgagcccaagggcaccatcaccctggagctgctggagcacaacgaggcctacacctggaccaaccccacctgctgcgtgcacaacatcatcgtgggcaagctgtggatcgagcagtacggcaacgtggagatcatcaaccacaagaccggcgacaagtgcgtgctgaacttcaagccctgcggcctgttcggcaaggagctgcacaaggtggagggctacatccaggacaagagcaagaagaagctgtgcgccctgtacggcaagtggaccgagtgcctgtacagcgtggaccccgccaccttcgacgcctacaagaagaacgacaagaagaacaccgaggagaagaagaacagcaagcagatgagcaccagcgaggagctggacgagatgcccgtgcccgacagcgagagcgtgttcatcatccccggcagcgtgctgctgtggagaatcgcccccagaccccccaacagcgcccagatgtacaacttcaccagcttcgccatggtgctgaacgaggtggacaaggacatggagagcgtgatccccaagaccgactgcagactgagacccgacatcagagccatggagaacggcgagatcgaccaggccagcgaggagaagaagagactggaggagaagcagagagccgccagaaagaacagaagcaagagcgaggaggactggaagaccagatggttccaccagggccccaacccctacaacggcgcccaggactggatctacagcggcagctactgggacagaaactacttcaacctgcccgacatctactag

SEQ ID NO: 92167 - DNA, 303 bp, Artificial Sequence
  Description of Artificial Sequence: Synthetic coding sequence
atgaacaccgaggccgagcagcagctgctgcaccacgccagaaacggcaacgccgaggaggtgagacagctgctggagaccatggccagaaacgaggtgatcgccgacatcaactgcaagggcagaagcaagagcaacctgggctggacccccctgcacctggcctgctacttcggccacagacaggtggtgcaggacctgctgaaggccggcgccgaggtgaacgtgctgaacgacatgggcgacacccccctgcacagagccgccttcaccggcagaaagatctgcagccagggcagctag

SEQ ID NO: 92168 - DNA, 1314 bp, Artificial Sequence
  Description of Artificial Sequence: Synthetic coding sequence
atgagcgaggagaaggactgcggcggcggcgacgccctgagcaacggcatcaagaagcacagaaccagcctgcccagccccatgttcagcagaaacgacttcagcatctggagcatcctgagaaagtgcatcggcatggagctgagcaagatcaccatgcccgtgatcttcaacgagcccctgagcttcctgcagagactgaccgagtacatggagcacacctacctgatccacaaggccagcagcctgagcgaccccgtggagagaatgcagtgcgtggccgccttcgccgtgagcgccgtggccagccagtgggagagaaccggcaagcccttcaaccccctgctgggcgagacctacgagctggtgagagacgacctgggcttcagactgatcagcgagcaggtgagccaccacccccccatcagcgccttccacgccgagggcctgaacaacgacttcatcttccacggcagcatctaccccaagctgaagttctggggcaagagcgtggaggccgagcccaagggcaccatcaccctggagctgctggagcacaacgaggcctacacctggaccaaccccacctgctgcgtgcacaacatcatcgtgggcaagctgtggatcgagcagtacggcaacgtggagatcatcaaccacaagaccggcgacaagtgcgtgctgaacttcaagccctgcggcctgttcggcaaggagctgcacaaggtggagggctacatccaggacaagagcaagaagaagctgtgcgccctgtacggcaagtggaccgagtgcctgtacagcgtggaccccgccaccttcgacgcctacaagaagaacgacaagaagaacaccgaggagaagaagaacagcaagcagatgagcaccagcgaggagctggacgagatgcccgtgcccgacagcgagagcgtgttcatcatccccggcagcgtgctgctgtggagaatcgcccccagaccccccaacagcgcccagatgtacaacttcaccagcttcgccatggtgctgaacgaggtggacaaggacatggagagcgtgatccccaagaccgactgcagactgagacccgacatcagagccatggagaacggcgagatcgaccaggccagcgaggagaagaagagactggaggagaagcagagagccgccagaaagaacagaagcaagagcgaggaggactggaagaccagatggttccaccagggccccaacccctacaacggcgcccaggactggatctacagcggcagctactgggacagaaactacttcaacctgcccgacatctactag

SEQ ID NO: 92169 - DNA, 345 bp, Artificial Sequence
  Description of Artificial Sequence: Synthetic coding sequence
atgcagagcgtggccgccttcgccgtgagcgccgtggccagccagtgggagagaaccggcaagcccttcaaccccctgctgggcgagacctacgagctgatcagagaggacctgggcttcagattcatcagcgagcaggtgagccaccacccccccatcagcgccttccacagcgagggcctgaaccacgacttcctgttccacggcagcatctaccccaagctgaagttctggggcaagagcgtggaggccgagcccagaggcaccatcaccctggagctgctgaacgtgaaccagagacacctgagagccaagcacaagagccccaccaacgccggcagatag

SEQ ID NO: 92170 - DNA, 1443 bp, Artificial Sequence
  Description of Artificial Sequence: Synthetic coding sequence
atgaacggcgaggaggagttcttcgacgccgtgaccggcttcgacagcgacaacagcagcggcgagttcagcgaggccaaccagaaggtgaccggcatgatcgacctggacaccagcaagaacaacagaatcggcaagaccggcgagagacccagccaggagaacggcatccagaagcacagaaccagcctgcccgcccccatgttcagcagaagcgacttcagcgtgtggaccatcctgaagaagtgcgtgggcctggagctgagcaagatcaccatgcccatcgccttcaacgagcccctgagcttcctgcagagaatcaccgagtacatggagcacgtgtacctgatccacagagccagctgccagccccagcccctggagagaatgcagagcgtggccgccttcgccgtgagcgccgtggccagccagtgggagagaaccggcaagcccttcaaccccctgctgggcgagacctacgagctgatcagagaggacctgggcttcagattcatcagcgagcaggtgagccaccacccccccatcagcgccttccacagcgagggcctgaaccacgacttcctgttccacggcagcatctaccccaagctgaagttctggggcaagagcgtggaggccgagcccagaggcaccatcaccctggagctgctgaagcacaacgaggcctacacctggaccaaccccacctgctgcgtgcacaacgtgatcatcggcaagctgtggatcgagcagtacggcaccgtggagatcctgaaccacagaaccggccacaagtgcgtgctgcacttcaagccctgcggcctgttcggcaaggagctgcacaaggtggagggccacatccaggacaagaacaagaagaagctgttcatgatctacggcaagtggaccgagtgcctgtggggcatcgaccccgtgagctacgagagcttcaagaagcaggagagaagaggcgaccacctgagaaaggccaagctggacgaggacagcggcaaggccgacagcgacgtggccgacgacgtgcccgtggcccaggagaccgtgcaggtgatccccggcagcaagctgctgtggagaatcaacaccagaccccccaacagcgcccagatgtacaacttcaccagcttcaccgtgagcctgaacgagctggagaccggcatggagaagaccctgccccccaccgactgcagactgagacccgacatcagaggcatggagaacggcaacatggacctggccagccaggagaaggagagactggaggagaagcagagagaggccagaagagagagagccaaggaggaggccgagtggcagaccagatggttctaccccggcaacaacccctacaccggcacccccgactggctgtacgccggcgactacttcgagagaaacttcagcgactgccccgacatctactag

SEQ ID NO: 92171 - DNA, 1407 bp, Artificial Sequence
  Description of Artificial Sequence: Synthetic coding sequence
atgaacggcgaggaggagttcttcgacgccgtgaccgaggccaaccagaaggtgaccggcatgatcgacctggacaccagcaagaacaacagaatcggcaagaccggcgagagacccagccaggagaacggcatccagaagcacagaaccagcctgcccgcccccatgttcagcagaagcgacttcagcgtgtggaccatcctgaagaagtgcgtgggcctggagctgagcaagatcaccatgcccatcgccttcaacgagcccctgagcttcctgcagagaatcaccgagtacatggagcacgtgtacctgatccacagagccagctgccagccccagcccctggagagaatgcagagcgtggccgccttcgccgtgagcgccgtggccagccagtgggagagaaccggcaagcccttcaaccccctgctgggcgagacctacgagctgatcagagaggacctgggcttcagattcatcagcgagcaggtgagccaccacccccccatcagcgccttccacagcgagggcctgaaccacgacttcctgttccacggcagcatctaccccaagctgaagttctggggcaagagcgtggaggccgagcccagaggcaccatcaccctggagctgctgaagcacaacgaggcctacacctggaccaaccccacctgctgcgtgcacaacgtgatcatcggcaagctgtggatcgagcagtacggcaccgtggagatcctgaaccacagaaccggccacaagtgcgtgctgcacttcaagccctgcggcctgttcggcaaggagctgcacaaggtggagggccacatccaggacaagaacaagaagaagctgttcatgatctacggcaagtggaccgagtgcctgtggggcatcgaccccgtgagctacgagagcttcaagaagcaggagagaagaggcgaccacctgagaaaggccaagctggacgaggacagcggcaaggccgacagcgacgtggccgacgacgtgcccgtggcccaggagaccgtgcaggtgatccccggcagcaagctgctgtggagaatcaacaccagaccccccaacagcgcccagatgtacaacttcaccagcttcaccgtgagcctgaacgagctggagaccggcatggagaagaccctgccccccaccgactgcagactgagacccgacatcagaggcatggagaacggcaacatggacctggccagccaggagaaggagagactggaggagaagcagagagaggccagaagagagagagccaaggaggaggccgagtggcagaccagatggttctaccccggcaacaacccctacaccggcacccccgactggctgtacgccggcgactacttcgagagaaacttcagcgactgccccgacatctactag

SEQ ID NO: 92172 - DNA, 1113 bp, Artificial Sequence
  Description of Artificial Sequence: Synthetic coding sequence
atgcccatcgccttcaacgagcccctgagcttcctgcagagaatcaccgagtacatggagcacgtgtacctgatccacagagccagctgccagccccagcccctggagagaatgcagagcgtggccgccttcgccgtgagcgccgtggccagccagtgggagagaaccggcaagcccttcaaccccctgctgggcgagacctacgagctgatcagagaggacctgggcttcagattcatcagcgagcaggtgagccaccacccccccatcagcgccttccacagcgagggcctgaaccacgacttcctgttccacggcagcatctaccccaagctgaagttctggggcaagagcgtggaggccgagcccagaggcaccatcaccctggagctgctgaagcacaacgaggcctacacctggaccaaccccacctgctgcgtgcacaacgtgatcatcggcaagctgtggatcgagcagtacggcaccgtggagatcctgaaccacagaaccggccacaagtgcgtgctgcacttcaagccctgcggcctgttcggcaaggagctgcacaaggtggagggccacatccaggacaagaacaagaagaagctgttcatgatctacggcaagtggaccgagtgcctgtggggcatcgaccccgtgagctacgagagcttcaagaagcaggagagaagaggcgaccacctgagaaaggccaagctggacgaggacagcggcaaggccgacagcgacgtggccgacgacgtgcccgtggcccaggagaccgtgcaggtgatccccggcagcaagctgctgtggagaatcaacaccagaccccccaacagcgcccagatctggcccgccagaagaagaagcggctggagaagaagcagagagaagcacggcggcagcggccccagaagaagacagagcggcagaagaggcggcagcacccaggccatcacccccaccctgggcccccccaccggctgcatgcagggcatcaccctgagcggcatcagccccaccgcccagatcagcaccgagggcctggagggccccggcgccagagacagaagactgaccagactggacttcctggagtggcccctgtag

SEQ ID NO: 92173 - DNA, 339 bp, Artificial Sequence
  Description of Artificial Sequence: Synthetic coding sequence
agcgtggccgccttcgccgtgagcgccgtggccagccagtgggagagaaccggcaagcccttcaaccccctgctgggcgagacctacgagctgatcagagaggacctgggcttcagattcatcagcgagcaggtgagccaccacccccccatcagcgccttccacagcgagggcctgaaccacgacttcctgttccacggcagcatctaccccaagctgaagttctggggcaagagcgtggaggccgagcccagaggcaccatcaccctggagctgctgaacgtgaaccagagacacctgagagccaagcacaagagccccaccaacgccggcagatag

SEQ ID NO: 92174 - DNA, 2664 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgacatcgagagagagaagctgcacggctgcatcgacgtgggcctgagcgtgatgagcgtgaagaagagcagcaagtgcatcgacctggacaccgaggagcacatctaccacctgaaggtgaagagcgaggaggtgttcgacgagtgggtgagcaagctgagacaccacagaatgtacagacagaacgagatcgccatgttcccccacgaggtgaaccacttcttcagcggcagcaccatcaccgacagcagcagcggcgtgttcgacagcatcagcagcagaaagagaagcagcatcagcaagcagaacctgttccagaccggcagcaacgtgagcttcagctgcggcggcgagaccagagtgcccctgtggctgcagagcagcgaggacatggagaagtgcagcaaggacctggcccactgccacgcctacctggtggagatgagccagctgctgcagagcatggacgtgctgcacagaacctacagcgcccccgccatcaacgccatccagggcggcagcttcgagagccccaagaaggagaagagaagccacagaagatggagaagcagagccatcggcaaggacgccaagggcaccctgcaggtgcccaagcccttcagcggccccgtgagactgcacagcagcaaccccaacctgagcaccctggacttcggcgaggagaagaactacagcgacggcagcgagaccagcagcgagttcagcaagatgcaggaggacctgtgccacatcgcccacaaggtgtacttcaccctgagaagcgccttcaacatcatgagcgccgagagagagaagctgaagcagctgatggagcaggacgccagcagcagccccagcgcccaggtgatcggcctgaagaacgccctgagcagcgccctggcccagaacaccgacctgaaggagagactgagaagaatccacgccgagagcctgctgctggacagccccgccgtggccaagagcggcgacaacctggccgaggagaacagcagagacgagaacagagccctggtgcaccagctgagcaacgagagcagactgagcatcaccgacagcctgagcgagttcttcgacgcccaggaggtgctgctgagccccagcagcagcgagaacgagatcagcgacgacgacagctacgtgagcgacatcagcgacaacctgagcctggacaacctgagcaacgacctggacaacgagagacagaccctgggccccgtgctggacagcggcagagaggccaagagcagaagaagaacctgcctgcccgccccctgccccagcagcagcaacatcagcctgtggaacatcctgagaaacaacatcggcaaggacctgagcaaggtggccatgcccgtggagctgaacgagcccctgaacaccctgcagagactgtgcgaggagctggagtacagcgagctgctggacaaggccgcccagatccccagccccctggagagaatggtgtacgtggccgccttcgccatcagcgcctacgccagcagctactacagagccggcagcaagcccttcaaccccgtgctgggcgagacctacgagtgcatcagagaggacaagggcttccagttcttcagcgagcaggtgagccaccacccccccatcagcgcctgccacgccgagagcagaaacttcgtgttctggcaggacgtgagatggaagaacaagttctggggcaagagcatggagatcgtgcccatcggcaccacccacgtgaccctgcccgtgttcggcgaccacttcgagtggaacaaggtgaccagctgcatccacaacatcctgagcggccagagatggatcgagcactacggcgagatcgtgatcaagaacctgcacgacgacagctgctactgcaaggtgaacttcatcaaggccaagtactggagcaccaacgcccacgagatcgagggcaccgtgttcgacagaagcggcaaggccgtgcacagactgttcggcaagtggcacgagagcatctactgcggcggcggcagcagcagcgcctgcgtgtggagagccaaccccatgcccaagggctacgagcagtactacagcttcacccagttcgccctggagctgaacgagatggaccccagcagcaagagcctgctgccccccaccgacaccagattcagacccgaccagagattcctggaggagggcaacctggaggaggccgagatccagaagcagagaatcgagcagctgcagagagagagaagaagagtgctggaggagaaccacgtggagcaccagcccagattcttcagaaagagcgacgacgacagctgggtgagcaacggcacctacctggagctgagaaaggacctgggcttcagcaagctggaccaccccgtgctgtggtag

SEQ ID NO: 92175 - DNA, 2571 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgacatcgagagagagaagctgcacggctgcatcgacgtgggcctgagcgtgatgagcgtgaagaagagcagcaagtgcatcgacctggacaccgaggagcacatctaccacctgaaggtgaagagcgaggaggtgttcgacgagtgggtgagcaagctgagacaccacagaatgtacagacagaacgagatcgccatgttcccccacgaggtgaaccacttcttcagcggcagcaccatcaccgacagcagcagcggcgtgttcgacagcatcagcagcagaaagagaagcagcatcagcaagcagaacctgttccagaccggcagcaacgtgagcttcagctgcggcggcgagaccagagtgcccctgtggctgcagagcagcgaggacatggagaagtgcagcaaggacctggcccactgccacgcctacctggtggagatgagccagctgctgcagagcatggacgtgctgcacagaacctacagcgcccccgccatcaacgccatccaggtgcccaagcccttcagcggccccgtgagactgcacagcagcaaccccaacctgagcaccctggacttcggcgaggagaagaactacagcgacggcagcgagaccagcagcgagttcagcaagatgcaggaggacctgtgccacatcgcccacaaggtgtacttcaccctgagaagcgccttcaacatcatgagcgccgagagagagaagctgaagcagctgatggagcaggacgccagcagcagccccagcgcccaggtgatcggcctgaagaacgccctgagcagcgccctggcccagaacaccgacctgaaggagagactgagaagaatccacgccgagagcctgctgctggacagccccgccgtggccaagagcggcgacaacctggccgaggagaacagcagagacgagaacagagccctggtgcaccagctgagcaacgagagcagactgagcatcaccgacagcctgagcgagttcttcgacgcccaggaggtgctgctgagccccagcagcagcgagaacgagatcagcgacgacgacagctacgtgagcgacatcagcgacaacctgagcctggacaacctgagcaacgacctggacaacgagagacagaccctgggccccgtgctggacagcggcagagaggccaagagcagaagaagaacctgcctgcccgccccctgccccagcagcagcaacatcagcctgtggaacatcctgagaaacaacatcggcaaggacctgagcaaggtggccatgcccgtggagctgaacgagcccctgaacaccctgcagagactgtgcgaggagctggagtacagcgagctgctggacaaggccgcccagatccccagccccctggagagaatggtgtacgtggccgccttcgccatcagcgcctacgccagcagctactacagagccggcagcaagcccttcaaccccgtgctgggcgagacctacgagtgcatcagagaggacaagggcttccagttcttcagcgagcaggtgagccaccacccccccatcagcgcctgccacgccgagagcagaaacttcgtgttctggcaggacgtgagatggaagaacaagttctggggcaagagcatggagatcgtgcccatcggcaccacccacgtgaccctgcccgtgttcggcgaccacttcgagtggaacaaggtgaccagctgcatccacaacatcctgagcggccagagatggatcgagcactacggcgagatcgtgatcaagaacctgcacgacgacagctgctactgcaaggtgaacttcatcaaggccaagtactggagcaccaacgcccacgagatcgagggcaccgtgttcgacagaagcggcaaggccgtgcacagactgttcggcaagtggcacgagagcatctactgcggcggcggcagcagcagcgcctgcgtgtggagagccaaccccatgcccaagggctacgagcagtactacagcttcacccagttcgccctggagctgaacgagatggaccccagcagcaagagcctgctgccccccaccgacaccagattcagacccgaccagagattcctggaggagggcaacctggaggaggccgagatccagaagcagagaatcgagcagctgcagagagagagaagaagagtgctggaggagaaccacgtggagcaccagcccagattcttcagaaagagcgacgacgacagctgggtgagcaacggcacctacctggagctgagaaaggacctgggcttcagcaagctggaccaccccgtgctgtggtag

SEQ ID NO: 92176 - DNA, 2556 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgacatcgagagagagaagctgcacggctgcatcgacgtgggcctgagcgtgatgagcgtgaagaagagcagcaagtgcatcgacctggacaccgaggagcacatctaccacctgaaggtgaagagcgaggaggtgttcgacgagtgggtgagcaagctgagacaccacagaatgtacagacagaacgagatcgccatgttcccccacgaggtgaaccacttcttcagcggcagcaccatcaccgacagcagcagcggcgtgttcgacagcatcagcagcagaaagagaagcagcatcagcaagcagaacctgttccagaccggcagcaacgtgagcttcagctgcggcggcgagaccagagtgcccctgtggctgcagagcagcgaggacatggagaagtgcagcaaggacctggcccactgccacgcctacctggtggagatgagccagctgctgcagagcatggacgtgctgcacagaacctacagcgcccccgccatcaacgccatccagggcggcagcttcgagagccccaagaaggagaagagaagccacagaagatggagaagcagagccatcggcaaggacgccaagggcaccctgcaggtgcccaagcccttcagcggccccgtgagactgcacagcagcaaccccaacctgagcaccctggacttcggcgaggagaagaactacagcgacggcagcgagaccagcagcgagttcagcaagatgcaggaggacctgtgccacatcgcccacaaggtgtacttcaccctgagaagcgccttcaacatcatgagcgccgagagagagaagctgaagcagctgatggagcaggacgccagcagcagccccagcgcccaggtgatcggcctgaagaacgccctgagcagcgagaacagcagagacgagaacagagccctggtgcaccagctgagcaacgagagcagactgagcatcaccgacagcctgagcgagttcttcgacgcccaggaggtgctgctgagccccagcagcagcgagaacgagatcagcgacgacgacagctacgtgagcgacatcagcgacaacctgagcctggacaacctgagcaacgacctggacaacgagagacagaccctgggccccgtgctggacagcggcagagaggccaagagcagaagaagaacctgcctgcccgccccctgccccagcagcagcaacatcagcctgtggaacatcctgagaaacaacatcggcaaggacctgagcaaggtggccatgcccgtggagctgaacgagcccctgaacaccctgcagagactgtgcgaggagctggagtacagcgagctgctggacaaggccgcccagatccccagccccctggagagaatggtgtacgtggccgccttcgccatcagcgcctacgccagcagctactacagagccggcagcaagcccttcaaccccgtgctgggcgagacctacgagtgcatcagagaggacaagggcttccagttcttcagcgagcaggtgagccaccacccccccatcagcgcctgccacgccgagagcagaaacttcgtgttctggcaggacgtgagatggaagaacaagttctggggcaagagcatggagatcgtgcccatcggcaccacccacgtgaccctgcccgtgttcggcgaccacttcgagtggaacaaggtgaccagctgcatccacaacatcctgagcggccagagatggatcgagcactacggcgagatcgtgatcaagaacctgcacgacgacagctgctactgcaaggtgaacttcatcaaggccaagtactggagcaccaacgcccacgagatcgagggcaccgtgttcgacagaagcggcaaggccgtgcacagactgttcggcaagtggcacgagagcatctactgcggcggcggcagcagcagcgcctgcgtgtggagagccaaccccatgcccaagggctacgagcagtactacagcttcacccagttcgccctggagctgaacgagatggaccccagcagcaagagcctgctgccccccaccgacaccagattcagacccgaccagagattcctggaggagggcaacctggaggaggccgagatccagaagcagagaatcgagcagctgcagagagagagaagaagagtgctggaggagaaccacgtggagcaccagcccagattcttcagaaagagcgacgacgacagctgggtgagcaacggcacctacctggagctgagaaaggacctgggcttcagcaagctggaccaccccgtgctgtggtag

SEQ ID NO: 92177 - DNA, 2556 bp, Artificial Sequence; identical to SEQ ID NO: 92176
  Description of Artificial Sequence: Synthetic coding sequence

SEQ ID NO: 92178 - DNA, 2571 bp, Artificial Sequence; identical to SEQ ID NO: 92175
  Description of Artificial Sequence: Synthetic coding sequence

SEQ ID NO: 92179 - DNA, 2463 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgacatcgagagagagaagctgcacggctgcatcgacgtgggcctgagcgtgatgagcgtgaagaagagcagcaagtgcatcgacctggacaccgaggagcacatctaccacctgaaggtgaagagcgaggaggtgttcgacgagtgggtgagcaagctgagacaccacagaatgtacagacagaacgagatcgccatgttcccccacgaggtgaaccacttcttcagcggcagcaccatcaccgacagcagcagcggcgtgttcgacagcatcagcagcagaaagagaagcagcatcagcaagcagaacctgttccagaccggcagcaacgtgagcttcagctgcggcggcgagaccagagtgcccctgtggctgcagagcagcgaggacatggagaagtgcagcaaggacctggcccactgccacgcctacctggtggagatgagccagctgctgcagagcatggacgtgctgcacagaacctacagcgcccccgccatcaacgccatccaggtgcccaagcccttcagcggccccgtgagactgcacagcagcaaccccaacctgagcaccctggacttcggcgaggagaagaactacagcgacggcagcgagaccagcagcgagttcagcaagatgcaggaggacctgtgccacatcgcccacaaggtgtacttcaccctgagaagcgccttcaacatcatgagcgccgagagagagaagctgaagcagctgatggagcaggacgccagcagcagccccagcgcccaggtgatcggcctgaagaacgccctgagcagcgagaacagcagagacgagaacagagccctggtgcaccagctgagcaacgagagcagactgagcatcaccgacagcctgagcgagttcttcgacgcccaggaggtgctgctgagccccagcagcagcgagaacgagatcagcgacgacgacagctacgtgagcgacatcagcgacaacctgagcctggacaacctgagcaacgacctggacaacgagagacagaccctgggccccgtgctggacagcggcagagaggccaagagcagaagaagaacctgcctgcccgccccctgccccagcagcagcaacatcagcctgtggaacatcctgagaaacaacatcggcaaggacctgagcaaggtggccatgcccgtggagctgaacgagcccctgaacaccctgcagagactgtgcgaggagctggagtacagcgagctgctggacaaggccgcccagatccccagccccctggagagaatggtgtacgtggccgccttcgccatcagcgcctacgccagcagctactacagagccggcagcaagcccttcaaccccgtgctgggcgagacctacgagtgcatcagagaggacaagggcttccagttcttcagcgagcaggtgagccaccacccccccatcagcgcctgccacgccgagagcagaaacttcgtgttctggcaggacgtgagatggaagaacaagttctggggcaagagcatggagatcgtgcccatcggcaccacccacgtgaccctgcccgtgttcggcgaccacttcgagtggaacaaggtgaccagctgcatccacaacatcctgagcggccagagatggatcgagcactacggcgagatcgtgatcaagaacctgcacgacgacagctgctactgcaaggtgaacttcatcaaggccaagtactggagcaccaacgcccacgagatcgagggcaccgtgttcgacagaagcggcaaggccgtgcacagactgttcggcaagtggcacgagagcatctactgcggcggcggcagcagcagcgcctgcgtgtggagagccaaccccatgcccaagggctacgagcagtactacagcttcacccagttcgccctggagctgaacgagatggaccccagcagcaagagcctgctgccccccaccgacaccagattcagacccgaccagagattcctggaggagggcaacctggaggaggccgagatccagaagcagagaatcgagcagctgcagagagagagaagaagagtgctggaggagaaccacgtggagcaccagcccagattcttcagaaagagcgacgacgacagctgggtgagcaacggcacctacctggagctgagaaaggacctgggcttcagcaagctggaccaccccgtgctgtggtag

SEQ ID NO: 92180 - DNA, 339 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgacatcgagagagagaagctgcacggctgcatcgacgtgggcctgagcgtgatgagcgtgaagaagagcagctag

SEQ ID NO: 92181 - DNA, 186 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagtag

SEQ ID NO: 92182 - DNA, 2463 bp, Artificial Sequence; identical to SEQ ID NO: 92179
  Description of Artificial Sequence: Synthetic coding sequence

SEQ ID NO: 92183 - DNA, 270 bp, Artificial Sequence
  Description of Artificial Sequence: Synthetic coding sequence
atgatgagcgacgagaagaacctgggcgtgagccagaagctggtgagccccagcagaagcaccagcagctgcagcagcaagcagggcagcagacaggacagctgggaggtggtggagggcctgagaggcgagatgaactacacccaggagccccccgtgcagaagggcttcctgctgaagaagagaaagtggcccctgaagggctggcacaagagattcttctacctggacaagggcatcctgaagtacgccaagagccagaccgactag

SEQ ID NO: 92184 - DNA, 2640 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccaccgccagagtgaccaagaaggagaccctgaaggcccagaaggagaactacagacaggagaagaagagagccaccagacagctgctgagcgccctgaccgaccccagcgtggtgatcatggccgacagcctgaagatcagaggcaccctgaagagctggaccaagctgtggtgcgtgctgaagcccggcgtgctgctgatctacaagacccccaaggtgggccagtgggtgggcaccgtgctgctgcactgctgcgagctgatcgagagacccagcaagaaggacggcttctgcttcaagctgttccaccccctggaccagagcgtgtgggccgtgaagggccccaagggcgagagcgtgggcagcatcacccagcccctgcccagcagctacctgatcttcagagccgccagcgagagcgacggcagatgctggctggacgccctggagctggccctgagatgcagcagcctgctgagactgggcacctgcaagcccggcagagacggcgagcccggcaccagccccgacgccagccccagcagcctgtgcggcctgcccgccagcgccaccgtgcaccccgaccaggacctgttccccctgaacggcagcagcctggagaacgacgccttcagcgacaagagcgagagagagaaccccgaggagagcgacaccgagacccaggaccacagcagaaagaccgagagcggcagcgaccagagcgagacccccggcgcccccgtgagaagaggcaccacctacgtggagcaggtgcaggaggagctgggcgagctgggcgaggccagccaggtggagaccgtgagcgaggagaacaagagcctgatgtggaccctgctgaagcagctgagacccggcatggacctgagcagagtggtgctgcccaccttcgtgctggagcccagaagcttcctgaacaagctgagcgactactactaccacgccgacctgctgagcagagccgccgtggaggaggacgcctacagcagaatgaagctggtgctgagatggtacctgagcggcttctacaagaagcccaagggcatcaagaagccctacaaccccatcctgggcgagaccttcagatgctgctggttccacccccagaccgacagcagaaccttctacatcgccgagcaggtgagccaccacccccccgtgagcgccttccacgtgagcaacagaaaggacggcttctgcatcagcggcagcatcaccgccaagagcagattctacggcaacagcctgagcgccctgctggacggcaaggccaccctgaccttcctgaacagagccgaggactacaccctgaccatgccctacgcccactgcaagggcatcctgtacggcaccatgaccctggagctgggcggcaaggtgaccatcgagtgcgccaagaacaacttccaggcccagctggagttcaagctgaagcccttcttcggcggcagcaccagcatcaaccagatcagcggcaagatcaccagcggcgaggaggtgctggccagcctgagcggccactgggacagagacgtgttcatcaaggaggagggcagcggcagcagcgccctgttctggacccccagcggcgaggtgagaagacagagactgagacagcacaccgtgcccctggaggagcagaccgagctggagagcgagagactgtggcagcacgtgaccagagccatcagcaagggcgaccagcacagagccacccaggagaagttcgccctggaggaggcccagagacagagagccagagagagacaggagagcctgatgccctggaagccccagctgttccacctggaccccatcacccaggagtggcactacagatacgaggaccacagcccctgggaccccctgaaggacatcgcccagttcgagcaggacggcatcctgagaaccctgcagcaggaggccgtggccagacagaccaccttcctgggcagccccggccccagacacgagagaagcggccccgaccagagactgagaaaggccagcgaccagcccagcggccacagccaggccaccgagagcagcggcagcacccccgagagctgccccgagctgagcgacgaggagcaggacggcgacttcgtgcccggcggcgagagcccctgccccagatgcagaaaggaggccagaagactgcaggccctgcacgaggccatcctgagcatcagagaggcccagcaggagctgcacagacacctgagcgccatgctgagcagcaccgccagagccgcccaggcccccacccccggcctgctgcagagccccagaagctggttcctgctgtgcgtgttcctggcctgccagctgttcatcaaccacatcctgaagtag

SEQ ID NO: 92185 - DNA, 2436 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccaccgccagagtgaccaagaaggagaccctgaaggcccagaaggagaactacagacaggagaagaagagagccaccagacagctgctgagcgccctgaccgaccccagcgtggtgatcatggccgacagcctgaagggccccaagggcgagagcgtgggcagcatcacccagcccctgcccagcagctacctgatcttcagagccgccagcgagagcgacggcagatgctggctggacgccctggagctggccctgagatgcagcagcctgctgagactgggcacctgcaagcccggcagagacggcgagcccggcaccagccccgacgccagccccagcagcctgtgcggcctgcccgccagcgccaccgtgcaccccgaccaggacctgttccccctgaacggcagcagcctggagaacgacgccttcagcgacaagagcgagagagagaaccccgaggagagcgacaccgagacccaggaccacagcagaaagaccgagagcggcagcgaccagagcgagacccccggcgcccccgtgagaagaggcaccacctacgtggagcaggtgcaggaggagctgggcgagctgggcgaggccagccaggtggagaccgtgagcgaggagaacaagagcctgatgtggaccctgctgaagcagctgagacccggcatggacctgagcagagtggtgctgcccaccttcgtgctggagcccagaagcttcctgaacaagctgagcgactactactaccacgccgacctgctgagcagagccgccgtggaggaggacgcctacagcagaatgaagctggtgctgagatggtacctgagcggcttctacaagaagcccaagggcatcaagaagccctacaaccccatcctgggcgagaccttcagatgctgctggttccacccccagaccgacagcagaaccttctacatcgccgagcaggtgagccaccacccccccgtgagcgccttccacgtgagcaacagaaaggacggcttctgcatcagcggcagcatcaccgccaagagcagattctacggcaacagcctgagcgccctgctggacggcaaggccaccctgaccttcctgaacagagccgaggactacaccctgaccatgccctacgcccactgcaagggcatcctgtacggcaccatgaccctggagctgggcggcaaggtgaccatcgagtgcgccaagaacaacttccaggcccagctggagttcaagctgaagcccttcttcggcggcagcaccagcatcaaccagatcagcggcaagatcaccagcggcgaggaggtgctggccagcctgagcggccactgggacagagacgtgttcatcaaggaggagggcagcggcagcagcgccctgttctggacccccagcggcgaggtgagaagacagagactgagacagcacaccgtgcccctggaggagcagaccgagctggagagcgagagactgtggcagcacgtgaccagagccatcagcaagggcgaccagcacagagccacccaggagaagttcgccctggaggaggcccagagacagagagccagagagagacaggagagcctgatgccctggaagccccagctgttccacctggaccccatcacccaggagtggcactacagatacgaggaccacagcccctgggaccccctgaaggacatcgcccagttcgagcaggacggcatcctgagaaccctgcagcaggaggccgtggccagacagaccaccttcctgggcagccccggccccagacacgagagaagcggccccgaccagagactgagaaaggccagcgaccagcccagcggccacagccaggccaccgagagcagcggcagcacccccgagagctgccccgagctgagcgacgaggagcaggacggcgacttcgtgcccggcggcgagagcccctgccccagatgcagaaaggaggccagaagactgcaggccctgcacgaggccatcctgagcatcagagaggcccagcaggagctgcacagacacctgagcgccatgctgagcagcaccgccagagccgcccaggcccccacccccggcctgctgcagagccccagaagctggttcctgctgtgcgtgttcctggcctgccagctgttcatcaaccacatcctgaagtag

SEQ ID NO: 92186 - DNA, 1320 bp, Artificial Sequence
  Description of Artificial Sequence: Synthetic coding sequence
atggacctgagcagagtggtgctgcccaccttcgtgctggagcccagaagcttcctgaacaagctgagcgactactactaccacgccgacctgctgagcagagccgccgtggaggaggacgcctacagcagaatgaagctggtgctgagatggtacctgagcggcttctacaagaagcccaagggcatcaagaagccctacaaccccatcctgggcgagaccttcagatgctgctggttccacccccagaccgacagcagaaccttctacatcgccgagcaggtgagccaccacccccccgtgagcgccttccacgtgagcaacagaaaggacggcttctgcatcagcggcagcatcaccgccaagagcagattctacggcaacagcctgagcgccctgctggacggcaaggccaccctgaccttcctgaacagagccgaggactacaccctgaccatgccctacgcccactgcaagggcatcctgtacggcaccatgaccctggagctgggcggcaaggtgaccatcgagtgcgccaagaacaacttccaggcccagctggagttcaagctgaagcccttcttcggcggcagcaccagcatcaaccagatcagcggcaagatcaccagcggcgaggaggtgctggccagcctgagcggccactgggacagagacgtgttcatcaaggaggagggcagcggcagcagcgccctgttctggacccccagcggcgaggtgagaagacagagactgagacagcacaccgtgcccctggaggagcagaccgagctggagagcgagagactgtggcagcacgtgaccagagccatcagcaagggcgaccagcacagagccacccaggagaagttcgccctggaggaggcccagagacagagagccagagagagacaggagagcctgatgccctggaagccccagctgttccacctggaccccatcacccaggagtggcactacagatacgaggaccacagcccctgggaccccctgaaggacatcgcccagttcgagcaggacggcatcctgagaaccctgcagcaggaggccgtggccagacagaccaccttcctgggcagccccggccccagacacgagagaagcggccccgaccagagactgagaaaggccagcgaccagcccagcggccacagccaggccaccgagagcagcggcagcacccccgagagctgccccgagctgcacggcaccggcagcaccggcaccgaccccagaccccccgccgagccccccatcctggtgcccgccctgagagtgcccggcgtgagcgccgtgcactag

SEQ ID NO: 92187 - DNA, 2436 bp, Artificial Sequence; identical to SEQ ID NO: 92185
  Description of Artificial Sequence: Synthetic coding sequence

SEQ ID NO: 92188 - DNA, 375 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccaccgccagagtgaccaagaaggagaccctgaaggcccagaaggagaactacagacaggagaagaagagagccaccagacagctgctgagcgccctgaccgacccctag

SEQ ID NO: 92189 - DNA, 297 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccaccgccagagtgaccaagaaggagacctag

SEQ ID NO: 92190 - DNA, 420 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccaccgccagagtgaccaagaaggagaccctgaaggcccagaaggagaactacagacaggagaagaagagagccaccagacagctgctgagcgccctgaccgaccccagcgtggtgatcatggccgacagcctgaagatcagaggcaccctgtag

SEQ ID NO: 92191 - DNA, 273 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccaccaaggtgccccccgccgagtacagactgtgcaacggcagcgacaaggagtgcgtgagccccacctag

SEQ ID NO: 92192 - DNA, 210 bp, Artificial Sequence
  Description of Artificial Sequence: Synthetic coding sequence
atgaaggaggaggccttcctgagaagaagattcagcctgtgcccccccagcagcaccccccagaaggtggaccccagaaagctgaccagaaacctgctgctgagcggcgacaacgagctgtaccccctgagccccggcaaggacatggagcccaacggccccagcctgcccagagacgagggcccccccacccccagcagcgccacctag

SEQ ID NO: 92193 - DNA, 1299 bp, Artificial Sequence
  Description of Artificial Sequence: Synthetic coding sequence
tacaaccccatcctgggcgagaccttcagatgctgctggttccacccccagaccgacagcagaaccttctacatcgccgagcaggtgagccaccacccccccgtgagcgccttccacgtgagcaacagaaaggacggcttctgcatcagcggcagcatcaccgccaagagcagattctacggcaacagcctgagcgccctgctggacggcaaggccaccctgaccttcctgaacagagccgaggactacaccctgaccatgccctacgcccactgcaagggcatcctgtacggcaccatgaccctggagctgggcggcaaggtgaccatcgagtgcgccaagaacaacttccaggcccagctggagttcaagctgaagcccttcttcggcggcagcaccagcatcaaccagatcagcggcaagatcaccagcggcgaggaggtgctggccagcctgagcggccactgggacagagacgtgttcatcaaggaggagggcagcggcagcagcgccctgttctggacccccagcggcgaggtgagaagacagagactgagacagcacaccgtgcccctggaggagcagaccgagctggagagcgagagactgtggcagcacgtgaccagagccatcagcaagggcgaccagcacagagccacccaggagaagttcgccctggaggaggcccagagacagagagccagagagagacaggagagcctgatgccctggaagccccagctgttccacctggaccccatcacccaggagtggcactacagatacgaggaccacagcccctgggaccccctgaaggacatcgcccagttcgagcaggacggcatcctgagaaccctgcagcaggaggccgtggccagacagaccaccttcctgggcagccccggccccagacacgagagaagcggccccgaccagagactgagaaaggccagcgaccagcccagcggccacagccaggccaccgagagcagcggcagcacccccgagagctgccccgagctgagcgacgaggagcaggacggcgacttcgtgcccggcggcgagagcccctgccccagatgcagaaaggaggccagaagactgcaggccctgcacgaggccatcctgagcatcagagaggcccagcaggagctgcacagacacctgagcgccatgctgagcagcaccgccagagccgcccaggcccccacccccggcctgctgcagagccccagaagctggttcctgctgtgcgtgttcctggcctgccagctgttcatcaaccacatcctgaagtag

SEQ ID NO: 92194 - DNA, 1533 bp, Artificial Sequence
  Description of Artificial Sequence: Synthetic coding sequence
atgtgcgtgccccacagacagggccaccaggagggcgacagccagggcgccgagggcgagctgcccgccggcgaggagcccagaagcttcctgaacaagctgagcgactactactaccacgccgacctgctgagcagagccgccgtggaggaggacgcctacagcagaatgaagctggtgctgagatggtacctgagcggcttctacaagaagcccaagggcatcaagaagccctacaaccccatcctgggcgagaccttcagatgctgctggttccacccccagaccgacagcagaaccttctacatcgccgagcaggtgagccaccacccccccgtgagcgccttccacgtgagcaacagaaaggacggcttctgcatcagcggcagcatcaccgccaagagcagattctacggcaacagcctgagcgccctgctggacggcaaggccaccctgaccttcctgaacagagccgaggactacaccctgaccatgccctacgcccactgcaagggcatcctgtacggcaccatgaccctggagctgggcggcaaggtgaccatcgagtgcgccaagaacaacttccaggcccagctggagttcaagctgaagcccttcttcggcggcagcaccagcatcaaccagatcagcggcaagatcaccagcggcgaggaggtgctggccagcctgagcggccactgggacagagacgtgttcatcaaggaggagggcagcggcagcagcgccctgttctggacccccagcggcgaggtgagaagacagagactgagacagcacaccgtgcccctggaggagcagaccgagctggagagcgagagactgtggcagcacgtgaccagagccatcagcaagggcgaccagcacagagccacccaggagaagttcgccctggaggaggcccagagacagagagccagagagagacaggagagcctgatgccctggaagccccagctgttccacctggaccccatcacccaggagtggcactacagatacgaggaccacagcccctgggaccccctgaaggacatcgcccagttcgagcaggacggcatcctgagaaccctgcagcaggaggccgtggccagacagaccaccttcctgggcagccccggccccagacacgagagaagcggccccgaccagagactgagaaaggccagcgaccagcccagcggccacagccaggccaccgagagcagcggcagcacccccgagagctgccccgagctgagcgacgaggagcaggacggcgacttcgtgcccggcggcgagagcccctgccccagatgcagaaaggaggccagaagactgcaggccctgcacgaggccatcctgagcatcagagaggcccagcaggagctgcacagacacctgagcgccatgctgagcagcaccgccagagccgcccaggcccccacccccggcctgctgcagagccccagaagctggttcctgctgtgcgtgttcctggcctgccagctgttcatcaaccacatcctgaagtag

SEQ ID NO: 92195 - DNA, 2805 bp, Artificial Sequence
  Description of Artificial Sequence: Synthetic coding sequence
atgagcagcgacgagaagggcatcagccccgcccacaagaccagcacccccacccacagaagcgccagcagcagcaccagcagccagagagacagcagacagagcatccacatcctggagagaaccgccagcagcagcaccgagcccagcgtgagcagacagctgctggagcccgagcccgtgcccctgagcaaggaggccgacagctgggagatcatcgagggcctgaagatcggccagaccaacgtgcagaagcccgacaagcacgagggcttcatgctgaagaagagaaagtggcccctgaagggctggcacaagagattcttcgtgctggacaacggcatgctgaagtacagcaaggcccccctggacatccagaagggcaaggtgcacggcagcatcgacgtgggcctgagcgtgatgagcatcaagaagaaggccagaagaatcgacctggacaccgaggagcacatctaccacctgaaggtgaagagccaggactggttcgacgcctgggtgagcaagctgagacaccacagactgtacagacagaacgagatcgtgagaagccccagagacgccagcttccacatcttccccagcaccagcaccgccgagagcagccccgccgccaacgtgagcgtgatggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggccaactgcgtggacatcagcaagaaggacaagagagtgaccagaagatggagaaccaagagcgtgagcaaggacaccaagatccagctgcaggtgcccttcagcgccaccatgagccccgtgagactgcacagcagcaaccccaacctgtgcgccgacatcgagttccagaccccccccagccacctgaccgaccccctggagagcagcaccgactacaccaagctgcaggaggagttctgcctgatcgcccagaaggtgcacagcctgctgaagagcgccttcaacagcatcgccatcgagaaggagaagctgaagcagatggtgagcgagcaggaccacagcaagggccacagcacccagatggccagactgagacagagcctgagccaggccctgaaccagaacgccgagctgagaagcagactgaacagaatccacagcgagagcatcatctgcgaccaggtggtgagcgtgaacatcatccccagccccgacgaggccggcgagcagatccacgtgagcctgcccctgagccagcaggtggccaacgagagcagactgagcatgagcgagagcgtgagcgagttcttcgacgcccaggaggtgctgctgagcgccagcagcagcgagaacgaggccagcgacgacgagagctacatcagcgacgtgagcgacaacatcagcgaggacaacaccagcgtggccgacaacatcagcagacagatcctgaacggcgagctgaccggcggcgccttcagaaacggcagaagagcctgcctgcccgccccctgccccgacaccagcaacatcaacctgtggaacatcctgagaaacaacatcggcaaggacctgagcaaggtgagcatgcccgtggagctgaacgagcccctgaacaccctgcagcacctgtgcgaggagatggagtacagcgagctgctggacaaggccagcgagaccgacgacccctacgagagaatggtgctggtggccgccttcgccgtgagcggctactgcagcacctacttcagagccggcagcaagcccttcaaccccgtgctgggcgagacctacgagtgcatcagagaggacaagggcttcagattcttcagcgagcaggtgagccaccacccccccatcagcgcctgccactgcgagagcaagaacttcgtgttctggcaggacatcagatggaagaacaagttctggggcaagagcatggagatcctgcccgtgggcaccctgaacgtgatgctgcccaagtacggcgactactacgtgtggaacaaggtgaccacctgcatccacaacatcctgagcggcagaagatggatcgagcactacggcgaggtgaccatcagaaacaccaagagcagcgtgtgcatctgcaagctgaccttcgtgaaggtgaactactggaacagcaacatgaacgaggtgcagggcgtggtgatcgaccaggagggcaaggccgtgtacagactgttcggcaagtggcacgagggcctgtactgcggcgtggcccccagcgccaagtgcatctggagacccggcagcatgcccaccaactacgagctgtactacggcttcaccagattcgccatcgagctgaacgagctggaccccgtgctgaaggacctgctgccccccaccgacgccagattcagacccgaccagagattcctggaggagggcaacctggaggccgccgccagcgagaagcagagagtggaggagctgcagagaagcagaagaagatacatggaggagaacaacctggagcacatccccaagttcttcaagaaggtgatcgacgccaaccagagagaggcctgggtgagcaacgacacctactgggagctgagaaaggaccccggcttcagcaaggtggacagccccgtgctgtggtag

SEQ ID NO: 92196 - DNA, 2817 bp, Artificial Sequence
  Description of Artificial Sequence: Synthetic coding sequence
atgcaccagctgagcctgatcagaggcaacagaggcagaagcatccacatcctggagagaaccgccagcagcagcaccgagcccagcgtgagcagacagctgctggagcccgagcccgtgcccctgagcaaggaggccgacagctgggagatcatcgagggcctgaagatcggccagaccaacgtgcagaagcccgacaagcacgagggcttcatgctgaagaagagaaagtggcccctgaagggctggcacaagagattcttcgtgctggacaacggcatgctgaagtacagcaaggcccccctggacatccagaagggcaaggtgcacggcagcatcgacgtgggcctgagcgtgatgagcatcaagaagaaggccagaagaatcgacctggacaccgaggagcacatctaccacctgaaggtgaagagccaggactggttcgacgcctgggtgagcaagctgagacaccacagactgtacagacagaacgagatcgtgagaagccccagagacgccagcttccacatcttccccagcaccagcaccgccgagagcagccccgccgccaacgtgagcgtgatggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggccaactgcgtggacatcagcaagaaggacaagagagtgaccagaagatggagaaccaagagcgtgagcaaggacaccaagatccagctgcaggagggcccccccgccaagggccagttcagcaccaccagaagaagacagagactggccgccgccgtggccaccaccgtgcccttcagcgccaccatgagccccgtgagactgcacagcagcaaccccaacctgtgcgccgacatcgagttccagaccccccccagccacctgaccgaccccctggagagcagcaccgactacaccaagctgcaggaggagttctgcctgatcgcccagaaggtgcacagcctgctgaagagcgccttcaacagcatcgccatcgagaaggagaagctgaagcagatggtgagcgagcaggaccacagcaagggccacagcacccagatggccagactgagacagagcctgagccaggccctgaaccagaacgccgagctgagaagcagactgaacagaatccacagcgagagcatcatctgcgaccaggtggtgagcgtgaacatcatccccagccccgacgaggccggcgagcagatccacgtgagcctgcccctgagccagcaggtggccaacgagagcagactgagcatgagcgagagcgtgagcgagttcttcgacgcccaggaggtgctgctgagcgccagcagcagcgagaacgaggccagcgacgacgagagctacatcagcgacgtgagcgacaacatcagcgaggacaacaccagcgtggccgacaacatcagcagacagatcctgaacggcgagctgaccggcggcgccttcagaaacggcagaagagcctgcctgcccgccccctgccccgacaccagcaacatcaacctgtggaacatcctgagaaacaacatcggcaaggacctgagcaaggtgagcatgcccgtggagctgaacgagcccctgaacaccctgcagcacctgtgcgaggagatggagtacagcgagctgctggacaaggccagcgagaccgacgacccctacgagagaatggtgctggtggccgccttcgccgtgagcggctactgcagcacctacttcagagccggcagcaagcccttcaaccccgtgctgggcgagacctacgagtgcatcagagaggacaagggcttcagattcttcagcgagcaggtgagccaccacccccccatcagcgcctgccactgcgagagcaagaacttcgtgttctggcaggacatcagatggaagaacaagttctggggcaagagcatggagatcctgcccgtgggcaccctgaacgtgatgctgcccaagtacggcgactactacgtgtggaacaaggtgaccacctgcatccacaacatcctgagcggcagaagatggatcgagcactacggcgaggtgaccatcagaaacaccaagagcagcgtgtgcatctgcaagctgaccttcgtgaaggtgaactactggaacagcaacatgaacgaggtgcagggcgtggtgatcgaccaggagggcaaggccgtgtacagactgttcggcaagtggcacgagggcctgtactgcggcgtggcccccagcgccaagtgcatctggagacccggcagcatgcccaccaactacgagctgtactacggcttcaccagattcgccatcgagctgaacgagctggaccccgtgctgaaggacctgctgccccccaccgacgccagattcagacccgaccagagattcctggaggagggcaacctggaggccgccgccagcgagaagcagagagtggaggagctgcagagaagcagaagaagatacatggaggagaacaacctggagcacatccccaagttcttcaagaaggtgatcgacgccaaccagagagaggcctgggtgagcaacgacacctactgggagctgagaaaggaccccggcttcagcaaggtggacagccccgtgctgtggtag

SEQ ID NO: 92197 - DNA, 2697 bp, Artificial Sequence
  Description of Artificial Sequence: Synthetic coding sequence
atgagcagcgacgagaagggcatcagccccgcccacaagaccagcacccccacccacagaagcgccagcagcagcaccagcagccagagagacagcagacagagcatccacatcctggagagaaccgccagcagcagcaccgagcccagcgtgagcagacagctgctggagcccgagcccgtgcccctgagcaaggaggccgacagctgggagatcatcgagggcctgaagatcggccagaccaacgtgcagaagcccgacaagcacgagggcttcatgctgaagaagagaaagtggcccctgaagggctggcacaagagattcttcgtgctggacaacggcatgctgaagtacagcaaggcccccctggacatccagaagggcaaggtgcacggcagcatcgacgtgggcctgagcgtgatgagcatcaagaagaaggccagaagaatcgacctggacaccgaggagcacatctaccacctgaaggtgaagagccaggactggttcgacgcctgggtgagcaagctgagacaccacagactgtacagacagaacgagatcgtgagaagccccagagacgccagcttccacatcttccccagcaccagcaccgccgagagcagccccgccgccaacgtgagcgtgatggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggccaactgcgtggacatcagcaagaaggacaagagagtgaccagaagatggagaaccaagagcgtgagcaaggacaccaagatccagctgcaggtgcccttcagcgccaccatgagccccgtgagactgcacagcagcaaccccaacctgtgcgccgacatcgagttccagaccccccccagccacctgaccgaccccctggagagcagcaccgactacaccaagctgcaggaggagttctgcctgatcgcccagaaggtgcacagcctgctgaagagcgccttcaacagcatcgccatcgagaaggagaagctgaagcagatggtgagcgagcaggaccacagcaagggccacagcacccagatggccagactgagacagagcctgagccaggccggcgagcagatccacgtgagcctgcccctgagccagcaggtggccaacgagagcagactgagcatgagcgagagcgtgagcgagttcttcgacgcccaggaggtgctgctgagcgccagcagcagcgagaacgaggccagcgacgacgagagctacatcagcgacgtgagcgacaacatcagcgaggacaacaccagcgtggccgacaacatcagcagacagatcctgaacggcgagctgaccggcggcgccttcagaaacggcagaagagcctgcctgcccgccccctgccccgacaccagcaacatcaacctgtggaacatcctgagaaacaacatcggcaaggacctgagcaaggtgagcatgcccgtggagctgaacgagcccctgaacaccctgcagcacctgtgcgaggagatggagtacagcgagctgctggacaaggccagcgagaccgacgacccctacgagagaatggtgctggtggccgccttcgccgtgagcggctactgcagcacctacttcagagccggcagcaagcccttcaaccccgtgctgggcgagacctacgagtgcatcagagaggacaagggcttcagattcttcagcgagcaggtgagccaccacccccccatcagcgcctgccactgcgagagcaagaacttcgtgttctggcaggacatcagatggaagaacaagttctggggcaagagcatggagatcctgcccgtgggcaccctgaacgtgatgctgcccaagtacggcgactactacgtgtggaacaaggtgaccacctgcatccacaacatcctgagcggcagaagatggatcgagcactacggcgaggtgaccatcagaaacaccaagagcagcgtgtgcatctgcaagctgaccttcgtgaaggtgaactactggaacagcaacatgaacgaggtgcagggcgtggtgatcgaccaggagggcaaggccgtgtacagactgttcggcaagtggcacgagggcctgtactgcggcgtggcccccagcgccaagtgcatctggagacccggcagcatgcccaccaactacgagctgtactacggcttcaccagattcgccatcgagctgaacgagctggaccccgtgctgaaggacctgctgccccccaccgacgccagattcagacccgaccagagattcctggaggagggcaacctggaggccgccgccagcgagaagcagagagtggaggagctgcagagaagcagaagaagatacatggaggagaacaacctggagcacatccccaagttcttcaagaaggtgatcgacgccaaccagagagaggcctgggtgagcaacgacacctactgggagctgagaaaggaccccggcttcagcaaggtggacagccccgtgctgtggtag

SEQ ID NO: 92198 - DNA, 573 bp, Artificial Sequence
  Description of Artificial Sequence: Synthetic coding sequence
atggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggccaactgcgtggacatcagcaagaaggacaagagagtgaccagaagatggagaaccaagagcgtgagcaaggacaccaagatccagctgcaggtgcccttcagcgccaccatgagccccgtgagactgcacagcagcaaccccaacctgtgcgccgacatcgagttccagacccccccccccaaccacttcggcatcctgagcgtgctgctgcagccctacagcctgaagaagaagaagaagaagaagaagaagagcacccccagcctggagagcagaatcaagggcgccgagtacaagatccagagcctgaccagcctgtag

SEQ ID NO: 92199 - DNA, 2880 bp, Artificial Sequence
  Description of Artificial Sequence: Synthetic coding sequence
atgagcagcgacgagaagggcatcagccccgcccacaagaccagcacccccacccacagaagcgccagcagcagcaccagcagccagagagacagcagacagagcatccacatcctggagagaaccgccagcagcagcaccgagcccagcgtgagcagacagctgctggagcccgagcccgtgcccctgagcaaggaggccgacagctgggagatcatcgagggcctgaagatcggccagaccaacgtgcagaagcccgacaagcacgagggcttcatgctgaagaagagaaagtggcccctgaagggctggcacaagagattcttcgtgctggacaacggcatgctgaagtacagcaaggcccccctggacatccagaagggcaaggtgcacggcagcatcgacgtgggcctgagcgtgatgagcatcaagaagaaggccagaagaatcgacctggacaccgaggagcacatctaccacctgaaggtgaagagccaggactggttcgacgcctgggtgagcaagctgagacaccacagactgtacagacagaacgagatcgtgagaagccccagagacgccagcttccacatcttccccagcaccagcaccgccgagagcagccccgccgccaacgtgagcgtgatggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggccaactgcgtggacatcagcaagaaggacaagagagtgaccagaagatggagaaccaagagcgtgagcaaggacaccaagatccagctgcaggagggcccccccgccaagggccagttcagcaccaccagaagaagacagagactggccgccgccgtggccaccaccgtgcccttcagcgccaccatgagccccgtgagactgcacagcagcaaccccaacctgtgcgccgacatcgagttccagaccccccccagccacctgaccgaccccctggagagcagcaccgactacaccaagctgcaggaggagttctgcctgatcgcccagaaggtgcacagcctgctgaagagcgccttcaacagcatcgccatcgagaaggagaagctgaagcagatggtgagcgagcaggaccacagcaagggccacagcacccagatggccagactgagacagagcctgagccaggccctgaaccagaacgccgagctgagaagcagactgaacagaatccacagcgagagcatcatctgcgaccaggtggtgagcgtgaacatcatccccagccccgacgaggccggcgagcagatccacgtgagcctgcccctgagccagcaggtggccaacgagagcagactgagcatgagcgagagcgtgagcgagttcttcgacgcccaggaggtgctgctgagcgccagcagcagcgagaacgaggccagcgacgacgagagctacatcagcgacgtgagcgacaacatcagcgaggacaacaccagcgtggccgacaacatcagcagacagatcctgaacggcgagctgaccggcggcgccttcagaaacggcagaagagcctgcctgcccgccccctgccccgacaccagcaacatcaacctgtggaacatcctgagaaacaacatcggcaaggacctgagcaaggtgagcatgcccgtggagctgaacgagcccctgaacaccctgcagcacctgtgcgaggagatggagtacagcgagctgctggacaaggccagcgagaccgacgacccctacgagagaatggtgctggtggccgccttcgccgtgagcggctactgcagcacctacttcagagccggcagcaagcccttcaaccccgtgctgggcgagacctacgagtgcatcagagaggacaagggcttcagattcttcagcgagcaggtgagccaccacccccccatcagcgcctgccactgcgagagcaagaacttcgtgttctggcaggacatcagatggaagaacaagttctggggcaagagcatggagatcctgcccgtgggcaccctgaacgtgatgctgcccaagtacggcgactactacgtgtggaacaaggtgaccacctgcatccacaacatcctgagcggcagaagatggatcgagcactacggcgaggtgaccatcagaaacaccaagagcagcgtgtgcatctgcaagctgaccttcgtgaaggtgaactactggaacagcaacatgaacgaggtgcagggcgtggtgatcgaccaggagggcaaggccgtgtacagactgttcggcaagtggcacgagggcctgtactgcggcgtggcccccagcgccaagtgcatctggagacccggcagcatgcccaccaactacgagctgtactacggcttcaccagattcgccatcgagctgaacgagctggaccccgtgctgaaggacctgctgccccccaccgacgccagattcagacccgaccagagattcctggaggagggcaacctggaggccgccgccagcgagaagcagagagtggaggagctgcagagaagcagaagaagatacatggaggagaacaacctggagcacatccccaagttcttcaagaaggtgatcgacgccaaccagagagaggcctgggtgagcaacgacacctactgggagctgagaaaggaccccggcttcagcaaggtggacagccccgtgctgtggtag

SEQ ID NO: 92200 - DNA, 2712 bp, Artificial Sequence
  Description of Artificial Sequence: Synthetic coding sequence
atgagcagcgacgagaagggcatcagccccgcccacaagaccagcacccccacccacagaagcgccagcagcagcaccagcagccagagagacagcagacagagcatccacatcctggagagaaccgccagcagcagcaccgagcccagcgtgagcagacagctgctggagcccgagcccgtgcccctgagcaaggaggccgacagctgggagatcatcgagggcctgaagatcggccagaccaacgtgcagaagcccgacaagcacgagggcttcatgctgaagaagagaaagtggcccctgaagggctggcacaagagattcttcgtgctggacaacggcatgctgaagtacagcaaggcccccctggacatccagaagggcaaggtgcacggcagcatcgacgtgggcctgagcgtgatgagcatcaagaagaaggccagaagaatcgacctggacaccgaggagcacatctaccacctgaaggtgaagagccaggactggttcgacgcctgggtgagcaagctgagacaccacagactgtacagacagaacgagatcgtgagaagccccagagacgccagcttccacatcttccccagcaccagcaccgccgagagcagccccgccgccaacgtgagcgtgatggacggcaagatgcagcccaacagcttcccctggcagagccccctgccctgcagcaacagcctgcccgccacctgcaccaccggccagagcaaggtggccgcctggctgcaggacagcgaggagatggacagatgcgccgaggacctggcccactgccagagcaacctggtggagctgagcaagctgctgcagaacctggagatcctgcagagaacccagagcgcccccaacttcaccgacatgcaggtgcccttcagcgccaccatgagccccgtgagactgcacagcagcaaccccaacctgtgcgccgacatcgagttccagaccccccccagccacctgaccgaccccctggagagcagcaccgactacaccaagctgcaggaggagttctgcctgatcgcccagaaggtgcacagcctgctgaagagcgccttcaacagcatcgccatcgagaaggagaagctgaagcagatggtgagcgagcaggaccacagcaagggccacagcacccagatggccagactgagacagagcctgagccaggccctgaaccagaacgccgagctgagaagcagactgaacagaatccacagcgagagcatcatctgcgaccaggtggtgagcgtgaacatcatccccagccccgacgaggccggcgagcagatccacgtgagcctgcccctgagccagcaggtggccaacgagagcagactgagcatgagcgagagcgtgagcgagttcttcgacgcccaggaggtgctgctgagcgccagcagcagcgagaacgaggccagcgacgacgagagctacatcagcgacgtgagcgacaacatcagcgaggacaacaccagcgtggccgacaacatcagcagacagatcctgaacggcgagctgaccggcggcgccttcagaaacggcagaagagcctgcctgcccgccccctgccccgacaccagcaacatcaacctgtggaacatcctgagaaacaacatcggcaaggacctgagcaaggtgagcatgcccgtggagctgaacgagcccctgaacaccctgcagcacctgtgcgaggagatggagtacagcgagctgctggacaaggccagcgagaccgacgacccctacgagagaatggtgctggtggccgccttcgccgtgagcggctactgcagcacctacttcagagccggcagcaagcccttcaaccccgtgctgggcgagacctacgagtgcatcagagaggacaagggcttcagattcttcagcgagcaggtgagccaccacccccccatcagcgcctgccactgcgagagcaagaacttcgtgttctggcaggacatcagatggaagaacaagttctggggcaagagcatggagatcctgcccgtgggcaccctgaacgtgatgctgcccaagtacggcgactactacgtgtggaacaaggtgaccacctgcatccacaacatcctgagcggcagaagatggatcgagcactacggcgaggtgaccatcagaaacaccaagagcagcgtgtgcatctgcaagctgaccttcgtgaaggtgaactactggaacagcaacatgaacgaggtgcagggcgtggtgatcgaccaggagggcaaggccgtgtacagactgttcggcaagtggcacgagggcctgtactgcggcgtggcccccagcgccaagtgcatctggagacccggcagcatgcccaccaactacgagctgtactacggcttcaccagattcgccatcgagctgaacgagctggaccccgtgctgaaggacctgctgccccccaccgacgccagattcagacccgaccagagattcctggaggagggcaacctggaggccgccgccagcgagaagcagagagtggaggagctgcagagaagcagaagaagatacatggaggagaacaacctggagcacatccccaagttcttcaagaaggtgatcgacgccaaccagagagaggcctgggtgagcaacgacacctactgggagctgagaaaggaccccggcttcagcaaggtggacagccccgtgctgtggtag

SEQ ID NO: 92201 - DNA, 2529 bp, Artificial Sequence
  Description of Artificial Sequence: Synthetic coding sequence
atggacttccaggagagagacccccccttcctgcccgagagcgcccagagcagcaagcccagcagcgcccagcaggccagcgagctgtgggaggtggtggaggagcccagagtgagactgggcaccgagggcgtgatgcccgagagacaggagggccacctgctgaagaagagaaagtggcccctgaagggctggcacaagagatacttcgtgctggaggacggcatcctgcactacgccaccaccagacaggacatcaccaagggcaagctgcacggcagcatcgacgtgagactgagcgtgatgagcatcaacaagaaggcccagagaatcgacctggacaccgaggacaacatctaccacctgaagatcaagagccaggacctgttccagagctgggtggcccagctgagagcccacagactggcccacagactggacatgcccagaggcagcctgcccagcaccgcccacagaaaggtgcccggcgcccagctgcccaccgccgccaccgccagcgccctgcccggcctgggccccagagagaaggtgagcagctggctgagagacagcgacggcctggacagatgcagccacgagctgagcgagtgccagggcaagctgcaggagctgcacagactgctgcagagcctggagagcctgcacagaatccccagcgcccccgtgatccccacccaccaggccagcgtgaccaccgagagacccaagaagggcaagagaaccagcagaatgtggtgcacccagagcttcgccaaggacgacaccatcggcagagtgggcagactgcacggcagcgtgcccaacctgagcagatacctggagagcagagacagcagcggcaccagaggcctgccccccaccgactacgcccacctgcagagaagcttctgggccctggcccagaaggtgcacagcagcctgagcagcgtgctggccgccctgaccatggagagagaccagctgagagacatgcaccagggcagcgagctgagcagaatgggcgtgagcgaggccagcaccggccagagaagactgcacagcctgagcaccagcagcgacaccaccgccgacagcttcagcagcctgaaccccgaggagcaggaggccctgtacatgaagggcagagagctgaccccccagctgagccagaccagcatcctgagcctggccgacagccacaccgagttcttcgacgcctgcgaggtgctgctgagcgccagcagcagcgagaacgagggcagcgaggaggaggagagctgcaccagcgagatcaccaccagcctgagcgaggagatgctggacctgagaggcgccgagagatgccagaagggcggctgcgtgcccggcagacccatgggcccccccagaagaagatgcctgcccgccgccagcggccccggcgccgacgtgagcctgtggaacatcctgagaaacaacatcggcaaggacctgagcaaggtgagcatgcccgtgcagctgaacgagcccctgaacaccctgcagagactgtgcgaggagctggagtacagcagcctgctggaccaggccagcagaatcgccgacccctgcgagagaatggtgtacatcgccgccttcgccgtgagcgcctacagcagcacctaccacagagccggctgcaagcccttcaaccccgtgctgggcgagacctacgagtgcgagagacccgacagaggcttcagattcatcagcgagcaggtgagccaccacccccccatcagcgcctgccacgccgagagcgagaacttcgccttctggcaggacatgaagtggaagaacaagttctggggcaagagcctggagatcgtgcccgtgggcaccgtgaacgtgagcctgcccagattcggcgaccacttcgagtggaacaaggtgaccagctgcatccacaacgtgctgagcggccagagatggatcgagcactacggcgaggtgctgatcagaaacacccaggacagcagctgccactgcaagatcaccttctgcaaggccaagtactggagcagcaacgtgcacgaggtgcagggcgccgtgctgagcagaagcggcagagtgctgcacagactgttcggcaagtggcacgagggcctgtacagaggccccacccccggcggccagtgcatctggaagcccaacagcatgccccccgaccacgagagaaacttcggcttcacccagttcgccctggagctgaacgagctgaccgccgagctgaagagaagcctgcccagcaccgacaccagactgagacccgaccagagatacctggaggagggcaacatccaggccgccgaggcccagaagagaagaatcgagcagctgcagagagacagaagaaaggtgatggaggagaacaacatcgtgcaccaggccagattcttcagaagacagaccgacagcagcggcaaggagtggtgggtgaccaacaacacctactggagactgagagccgagcccggctacggcaacatggacggcgccgtgctgtggtag

SEQ ID NO: 92202 - DNA, 2529 bp, Artificial Sequence; identical to SEQ ID NO: 92201
  Description of Artificial Sequence: Synthetic coding sequence

SEQ ID NO: 92203 - DNA, 2670 bp, Artificial Sequence
  Description of Artificial Sequence: Synthetic coding sequence
atggagggcggcctggccgacggcgagcccgacagaaccagcctgctgggcgacagcaaggacgtgctgggccccagcaccgtggtggccaacagcgacgagagccagctgctgacccccggcaagatgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaaggagagcctgaaggtgcagaagaagaactacagagaggagaagaagagagccaccaaggagctgctgagcaccatcaccgaccccagcgtgatcgtgatggccgactggctgaagatcagaggcaccctgaagagctggaccaagctgtggtgcgtgctgaagcccggcgtgctgctgatctacaagacccagaagaacggccagtgggtgggcaccgtgctgctgaacgcctgcgagatcatcgagagacccagcaagaaggacggcttctgcttcaagctgttccaccccctggagcagagcatctgggccgtgaagggccccaagggcgaggccgtgggcagcatcacccagcccctgcccagcagctacctgatcatcagagccaccagcgagagcgacggcagatgctggatggacgccctggagctggccctgaagtgcagcagcctgctgaagagaaccatgatcagagagggcaaggagcacgacctgagcgtgagcagcgacagcacccacgtgaccttctacggcctgctgagagccaacaacctgcacagcggcgacaacttccagctgaacgacagcgagatcgagagacagcacttcaaggaccaggacatgtacagcgacaagagcgacaaggagaacgaccaggagcacgacgagagcgacaacgaggtgatgggcaagagcgaggagagcgacaccgacaccagcgagagacaggacgacagctacatcgagcccgagcccgtggagcccctgaaggagaccacctacaccgagcagagccacgaggagctgggcgaggccggcgaggccagccagaccgagaccgtgagcgaggagaacaagagcctgatctggaccctgctgaagcaggtgagacccggcatggacctgagcaaggtggtgctgcccaccttcatcctggagcccagaagcttcctggacaagctgagcgactactactaccacgccgacttcctgagcgaggccgccctggaggagaacccctacttcagactgaagaaggtggtgaagtggtacctgagcggcttctacaagaagcccaagggcctgaagaagccctacaaccccatcctgggcgagaccttcagatgcctgtggatccaccccagaaccaacagcaagaccttctacatcgccgagcaggtgagccaccacccccccatcagcgccttctacgtgagcaacagaaaggacggcttctgcctgagcggcagcatcctggccaagagcaagttctacggcaacagcctgagcgccatcctggagggcgaggccagactgaccttcctgaacagaggcgaggactacgtgatgaccatgccctacgcccactgcaagggcatcctgtacggcaccatgaccctggagctgggcggcaccgtgaacatcacctgccagaagaccggctacagcgccatcctggagttcaagctgaagcccttcctgggcagcagcgactgcgtgaaccagatcagcggcaagctgaagctgggcaaggaggtgctggccaccctggagggccactgggacagcgaggtgttcatcaccgacaagaagaccgacaacagcgaggtgttctggaaccccacccccgacatcaagcagtggagactgatcagacacaccgtgaagttcgaggagcagggcgacttcgagagcgagaagctgtggcagagagtgaccagagccatcaacgccaaggaccagaccgaggccacccaggagaagtacgtgctggaggaggcccagagacaggccgccagagacagaaagaccaagaacgaggagtggagctgcaagctgttcgagctggaccccctgaccggcgagtggcactacaagttcgccgacaccagaccctgggaccccctgaacgacatgatccagttcgagaaggacggcgtgatccagaccaaggtgaagcacagaacccccatggtgagcgtgcccaagatgaagcacaagcccaccagacagcagaagaaggtggccaagggctacagcagccccgagcccgacatccaggacagcagcggcagcgaggcccagagcgtgaagcccagcaccagaagaaagaagggcatcgagctgggcgacatccagagcagcatcgagagcatcaagcagacccaggaggagatcaagagaaacatcatggccctgagaaaccacctggtgagcagcacccccgccaccgactacttcctgcagcagaaggactacttcatcatcttcctgctgatcctgctgcaggtgatcatcaacttcatgttcaagtag

SEQ ID NO: 92204 - DNA, 2544 bp, Artificial Sequence
  Description of Artificial Sequence: Synthetic coding sequence
atgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaaggagagcctgaaggtgcagaagaagaactacagagaggagaagaagagagccaccaaggagctgctgagcaccatcaccgaccccagcgtgatcgtgatggccgactggctgaagatcagaggcaccctgaagagctggaccaagctgtggtgcgtgctgaagcccggcgtgctgctgatctacaagacccagaagaacggccagtgggtgggcaccgtgctgctgaacgcctgcgagatcatcgagagacccagcaagaaggacggcttctgcttcaagctgttccaccccctggagcagagcatctgggccgtgaagggccccaagggcgaggccgtgggcagcatcacccagcccctgcccagcagctacctgatcatcagagccaccagcgagagcgacggcagatgctggatggacgccctggagctggccctgaagtgcagcagcctgctgaagagaaccatgatcagagagggcaaggagcacgacctgagcgtgagcagcgacagcacccacgtgaccttctacggcctgctgagagccaacaacctgcacagcggcgacaacttccagctgaacgacagcgagatcgagagacagcacttcaaggaccaggacatgtacagcgacaagagcgacaaggagaacgaccaggagcacgacgagagcgacaacgaggtgatgggcaagagcgaggagagcgacaccgacaccagcgagagacaggacgacagctacatcgagcccgagcccgtggagcccctgaaggagaccacctacaccgagcagagccacgaggagctgggcgaggccggcgaggccagccagaccgagaccgtgagcgaggagaacaagagcctgatctggaccctgctgaagcaggtgagacccggcatggacctgagcaaggtggtgctgcccaccttcatcctggagcccagaagcttcctggacaagctgagcgactactactaccacgccgacttcctgagcgaggccgccctggaggagaacccctacttcagactgaagaaggtggtgaagtggtacctgagcggcttctacaagaagcccaagggcctgaagaagccctacaaccccatcctgggcgagaccttcagatgcctgtggatccaccccagaaccaacagcaagaccttctacatcgccgagcaggtgagccaccacccccccatcagcgccttctacgtgagcaacagaaaggacggcttctgcctgagcggcagcatcctggccaagagcaagttctacggcaacagcctgagcgccatcctggagggcgaggccagactgaccttcctgaacagaggcgaggactacgtgatgaccatgccctacgcccactgcaagggcatcctgtacggcaccatgaccctggagctgggcggcaccgtgaacatcacctgccagaagaccggctacagcgccatcctggagttcaagctgaagcccttcctgggcagcagcgactgcgtgaaccagatcagcggcaagctgaagctgggcaaggaggtgctggccaccctggagggccactgggacagcgaggtgttcatcaccgacaagaagaccgacaacagcgaggtgttctggaaccccacccccgacatcaagcagtggagactgatcagacacaccgtgaagttcgaggagcagggcgacttcgagagcgagaagctgtggcagagagtgaccagagccatcaacgccaaggaccagaccgaggccacccaggagaagtacgtgctggaggaggcccagagacaggccgccagagacagaaagaccaagaacgaggagtggagctgcaagctgttcgagctggaccccctgaccggcgagtggcactacaagttcgccgacaccagaccctgggaccccctgaacgacatgatccagttcgagaaggacggcgtgatccagaccaaggtgaagcacagaacccccatggtgagcgtgcccaagatgaagcacaagcccaccagacagcagaagaaggtggccaagggctacagcagccccgagcccgacatccaggacagcagcggcagcgaggcccagagcgtgaagcccagcaccagaagaaagaagggcatcgagctgggcgacatccagagcagcatcgagagcatcaagcagacccaggaggagatcaagagaaacatcatggccctgagaaaccacctggtgagcagcacccccgccaccgactacttcctgcagcagaaggactacttcatcatcttcctgctgatcctgctgcaggtgatcatcaacttcatgttcaagtag

SEQ ID NO: 92205 - DNA, 2544 bp, Artificial Sequence; identical to SEQ ID NO: 92204
  Description of Artificial Sequence: Synthetic coding sequence

SEQ ID NO: 92206 - DNA, 2187 bp, Artificial Sequence
  Description of Artificial Sequence: Synthetic coding sequence
atggagggcggcctggccgacggcgagcccgacagaaccagcctgctgggcgacagcaaggacgtgctgggccccagcaccgtggtggccaacagcgacgagagccagctgctgacccccggcaagatgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaaggagagcctgaaggtgcagaagaagaactacagagaggagaagaagagagccaccaaggagctgctgagcaccatcaccgaccccagcgtgatcgtgatggccgactggctgaagatcagaggcaccctgaagagctggaccaagctgtggtgcgtgctgaagcccggcgtgctgctgatctacaagacccagaagaacggccagtgggtgggcaccgtgctgctgaacgcctgcgagatcatcgagagacccagcaagaaggacggcttctgcttcaagctgttccaccccctggagcagagcatctgggccgtgaagggccccaagggcgaggccgtgggcagcatcacccagcccctgcccagcagctacctgatcatcagagccaccagcgagagcgacggcagatgctggatggacgccctggagctggccctgaagtgcagcagcctgctgaagagaaccatgatcagagagggcaaggagcacgacctgagcgtgagcagcgacagcacccacgtgaccttctacggcctgctgagagccaacaacctgcacagcggcgacaacttccagctgaacgacagcgagatcgagagacagcacttcaaggaccaggacatgtacagcgacaagagcgacaaggagaacgaccaggagcacgacgagagcgacaacgaggtgatgggcaagagcgaggagagcgacaccgacaccagcgagagacaggacgacagctacatcgagcccgagcccgtggagcccctgaaggagaccacctacaccgagcagagccacgaggagctgggcgaggccggcgaggccagccagaccgagaccgtgagcgaggagaacaagagcctgatctggaccctgctgaagcaggtgagacccggcatggacctgagcaaggtggtgctgcccaccttcatcctggagcccagaagcttcctggacaagctgagcgactactactaccacgccgacttcctgagcgaggccgccctggaggagaacccctacttcagactgaagaaggtggtgaagtggtacctgagcggcttctacaagaagcccaagggcctgaagaagccctacaaccccatcctgggcgagaccttcagatgcctgtggatccaccccagaaccaacagcaagaccttctacatcgccgagcaggtgagccaccacccccccatcagcgccttctacgtgagcaacagaaaggacggcttctgcctgagcggcagcatcctggccaagagcaagttctacggcaacagcctgagcgccatcctggagggcgaggccagactgaccttcctgaacagaggcgaggactacgtgatgaccatgccctacgcccactgcaagggcatcctgtacggcaccatgaccctggagctgggcggcaccgtgaacatcacctgccagaagaccggctacagcgccatcctggagttcaagctgaagcccttcctgggcagcagcgactgcgtgaaccagatcagcggcaagctgaagctgggcaaggaggtgctggccaccctggagggccactgggacagcgaggtgttcatcaccgacaagaagaccgacaacagcgaggtgttctggaaccccacccccgacatcaagcagtggagactgatcagacacaccgtgaagttcgaggagcagggcgacttcgagagcgagaagctgtggcagagagtgaccagagccatcaacgccaaggaccagaccgaggccacccaggagaagtacgtgctggaggaggcccagagacaggccgccagagacagaaagaccaagaacgagaagaagaagtag

SEQ ID NO: 92207 - DNA, 2625 bp, Artificial Sequence
  Description of Artificial Sequence: Synthetic coding sequence
atggagggcggcctggccgacggcgagcccgacagaaccagcgccaacagcgacgagagccagctgctgacccccggcaagatgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaaggagagcctgaaggtgcagaagaagaactacagagaggagaagaagagagccaccaaggagctgctgagcaccatcaccgaccccagcgtgatcgtgatggccgactggctgaagatcagaggcaccctgaagagctggaccaagctgtggtgcgtgctgaagcccggcgtgctgctgatctacaagacccagaagaacggccagtgggtgggcaccgtgctgctgaacgcctgcgagatcatcgagagacccagcaagaaggacggcttctgcttcaagctgttccaccccctggagcagagcatctgggccgtgaagggccccaagggcgaggccgtgggcagcatcacccagcccctgcccagcagctacctgatcatcagagccaccagcgagagcgacggcagatgctggatggacgccctggagctggccctgaagtgcagcagcctgctgaagagaaccatgatcagagagggcaaggagcacgacctgagcgtgagcagcgacagcacccacgtgaccttctacggcctgctgagagccaacaacctgcacagcggcgacaacttccagctgaacgacagcgagatcgagagacagcacttcaaggaccaggacatgtacagcgacaagagcgacaaggagaacgaccaggagcacgacgagagcgacaacgaggtgatgggcaagagcgaggagagcgacaccgacaccagcgagagacaggacgacagctacatcgagcccgagcccgtggagcccctgaaggagaccacctacaccgagcagagccacgaggagctgggcgaggccggcgaggccagccagaccgagaccgtgagcgaggagaacaagagcctgatctggaccctgctgaagcaggtgagacccggcatggacctgagcaaggtggtgctgcccaccttcatcctggagcccagaagcttcctggacaagctgagcgactactactaccacgccgacttcctgagcgaggccgccctggaggagaacccctacttcagactgaagaaggtggtgaagtggtacctgagcggcttctacaagaagcccaagggcctgaagaagccctacaaccccatcctgggcgagaccttcagatgcctgtggatccaccccagaaccaacagcaagaccttctacatcgccgagcaggtgagccaccacccccccatcagcgccttctacgtgagcaacagaaaggacggcttctgcctgagcggcagcatcctggccaagagcaagttctacggcaacagcctgagcgccatcctggagggcgaggccagactgaccttcctgaacagaggcgaggactacgtgatgaccatgccctacgcccactgcaagggcatcctgtacggcaccatgaccctggagctgggcggcaccgtgaacatcacctgccagaagaccggctacagcgccatcctggagttcaagctgaagcccttcctgggcagcagcgactgcgtgaaccagatcagcggcaagctgaagctgggcaaggaggtgctggccaccctggagggccactgggacagcgaggtgttcatcaccgacaagaagaccgacaacagcgaggtgttctggaaccccacccccgacatcaagcagtggagactgatcagacacaccgtgaagttcgaggagcagggcgacttcgagagcgagaagctgtggcagagagtgaccagagccatcaacgccaaggaccagaccgaggccacccaggagaagtacgtgctggaggaggcccagagacaggccgccagagacagaaagaccaagaacgaggagtggagctgcaagctgttcgagctggaccccctgaccggcgagtggcactacaagttcgccgacaccagaccctgggaccccctgaacgacatgatccagttcgagaaggacggcgtgatccagaccaaggtgaagcacagaacccccatggtgagcgtgcccaagatgaagcacaagcccaccagacagcagaagaaggtggccaagggctacagcagccccgagcccgacatccaggacagcagcggcagcgaggcccagagcgtgaagcccagcaccagaagaaagaagggcatcgagctgggcgacatccagagcagcatcgagagcatcaagcagacccaggaggagatcaagagaaacatcatggccctgagaaaccacctggtgagcagcacccccgccaccgactacttcctgcagcagaaggactacttcatcatcttcctgctgatcctgctgcaggtgatcatcaacttcatgttcaagtag

SEQ ID NO: 92208 - DNA, 162 bp, Artificial Sequence
  Description of Artificial Sequence: Synthetic coding sequence
atggagggcggcctggccgacggcgagcccgacagaaccagcctgctgggcgacagcaaggacgtgctgggccccagcaccaacagcgacgagagccagctgctgacccccggcaagatgagccagagacagggcaaggaggcctaccccacccccacctag

SEQ ID NO: 92209 - DNA, 231 bp, Artificial Sequence
  Description of Artificial Sequence: Synthetic coding sequence
atgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaagtag

SEQ ID NO: 92210 - DNA, 177 bp, Artificial Sequence
  Description of Artificial Sequence: Synthetic coding sequence
atggagggcggcctggccgacggcgagcccgacagaaccagcctgctgggcgacagcaaggacgtgctgggccccagcaccgtggtggccaacagcgacgagagccagctgctgacccccggcaagatgagccagagacagggcaaggaggcctaccccacccccaccaaggactag

SEQ ID NO: 92211 - DNA, 336 bp, Artificial Sequence
  Description of Artificial Sequence: Synthetic coding sequence
atgagccagagacagggcaaggaggcctaccccacccccaccaaggacctgcaccagcccagcctgagccccgccagcccccacagccagggcttcgagagaggcaaggaggacatcagccagaacaaggacgagagcagcctgagcatgagcaagagcaagagcgagagcaagctgtacaacggcagcgagaaggacagcagcaccagcagcaagctgaccaagaaggagagcctgaaggtgcagaagaagaactacagagaggagaagaagagagccaccaaggagctgctgagcaccatcaccgaccccagcgtgatcgtgatggccgactag

SEQ ID NO: 92212 - DNA, 2226 bp, Artificial Sequence
  Description of Artificial Sequence: Synthetic coding sequence
atgccctacagaagagtgaccagcggcagactgctgagcctggccgcccccaagatggccagcatcatggagggccccctgagcaagtggaccaacgtgatgaagggctggcagtacagatggttcgtgctggactacaacgccggcctgctgagctactacaccagcaaggacaagatgatgagaggcagcagaagaggctgcgtgagactgagaggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92213 - DNA, 1881 bp, Artificial Sequence
  Description of Artificial Sequence: Synthetic coding sequence
atggccttcctgctggccacctgcggcggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92214 - DNA, 2265 bp, Artificial Sequence
  Description of Artificial Sequence: Synthetic coding sequence
atgccctacagaagagtgaccagcggcagactgctgagcctggccgcccccaagatggccagcatcatggagggccccctgagcaagtggaccaacgtgatgaagggctggcagtacagatggttcgtgctggactacaacgccggcctgctgagctactacaccagcaaggacaagatgatgagaggcagcagaagaggctgcgtgagactgagaggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaaggaccagagcaacgccgagaagcacgccgacggcatgatcagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92215 - DNA, 2172 bp, Artificial Sequence
  Description of Artificial Sequence: Synthetic coding sequence
atggccagcatcatggagggccccctgagcaagtggaccaacgtgatgaagggctggcagtacagatggttcgtgctggactacaacgccggcctgctgagctactacaccagcaaggacaagatgatgagaggcagcagaagaggctgcgtgagactgagaggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92216 - DNA, 2211 bp, Artificial Sequence
  Description of Artificial Sequence: Synthetic coding sequence
atggccagcatcatggagggccccctgagcaagtggaccaacgtgatgaagggctggcagtacagatggttcgtgctggactacaacgccggcctgctgagctactacaccagcaaggacaagatgatgagaggcagcagaagaggctgcgtgagactgagaggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaaggaccagagcaacgccgagaagcacgccgacggcatgatcagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92217 - DNA, 1716 bp, Artificial Sequence
  Description of Artificial Sequence: Synthetic coding sequence
atggtggagagcatcaagcactgcatcgtgctgctgcagatcgccaaggaccagagcaacgccgagaagcacgccgacggcatgatcagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92218 - DNA, 2241 bp, Artificial Sequence
  Description of Artificial Sequence: Synthetic coding sequence
atggccagcatcatggagggccccctgagcaagtggaccaacgtgatgaagggctggcagtacagatggttcgtgctggactacaacgccggcctgctgagctactacaccagcaaggacaagatgatgagaggcagcagaagaggctgcgtgagactgagaggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagatcagcaccaccctggccttcttccagagcagcggcatcagccccgtgctggagttcagcaagatcatcggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92219 - DNA, 2160 bp, Artificial Sequence
  Description of Artificial Sequence: Synthetic coding sequence
atggccagcatcatggagggccccctgagcaagtggaccaacgtgatgaagggctggcagtacagatggttcgtgctggactacaacgccggcctgctgagctactacaccggcgccgtgatcggcatcgacgacgaggacgacagcaccttcaccatcaccgtggaccagaagaccttccacttccaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaaggaccagagcaacgccgagaagcacgccgacggcatgatcagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92220 - DNA, 1677 bp, Artificial Sequence
  Description of Artificial Sequence: Synthetic coding sequence
atggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92221 - DNA, 99 bp, Artificial Sequence
  Description of Artificial Sequence: Synthetic coding sequence
atggtggagagcatcaagcactgcatcgtgctgctgcagatcgccaaggaccagagcaacgccgagaagcacgccgacggcatgatcgtgagcctgtag

SEQ ID NO: 92222 - DNA, 1677 bp, Artificial Sequence; identical to SEQ ID NO: 92220
  Description of Artificial Sequence: Synthetic coding sequence

SEQ ID NO: 92223 - DNA, 1968 bp, Artificial Sequence
  Description of Artificial Sequence: Synthetic coding sequence
atgggctgctgctgctgctggctggtgttcaccgaggccagagacgccgacgagagagagaagtggatccacgccctggaggagaccatcctgagacacaccctgcagctgcagggcctggacagcggcttcgtgcccagcgtgcaggacttcgacaagaagctgaccgaggccgacgcctacctgcagatcctgatcgagcagctgaagctgttcgacgacaagctgcagaactgcaaggaggacgagcagagaaagaagatcgagaccctgaaggagaccaccaacagcatggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctacagcagcagcgaggacgagttctacgacgccgacgagttccaccagagcggcagcagccccaagagactgatcgacagcagcggcagcgccagcgtgctgacccacagcagcagcggcaacagcctgaagagacccgacaccaccgagagcctgaacagcagcctgagcaacggcaccagcgacgccgacctgttcgacagccacgacgacagagacgacgacgccgaggccggcagcgtggaggagcacaagagcgtgatcatgcacctgctgagccaggtgagactgggcatggacctgaccaaggtggtgctgcccaccttcatcctggagagaagaagcctgctggagatgtacgccgacttcttcgcccaccccgacctgttcgtgagcatcagcgaccagaaggaccccaaggacagaatggtgcaggtggtgaagtggtacctgagcgccttccacgccggcagaaagggcagcgtggccaagaagccctacaaccccatcctgggcgagatcttccagtgccactggaccctgcccaacgacaccgaggagaacaccgagctggtgagcgagggccccgtgccctgggtgagcaagaacagcgtgaccttcgtggccgagcaggtgagccaccacccccccatcagcgccttctacgccgagtgcttcaacaagaagatccagttcaacgcccacatctggaccaagagcaagttcctgggcatgagcatcggcgtgcacaacatcggccagggctgcgtgagctgcctggactacgacgagcactacatcctgaccttccccaacggctacggcagaagcatcctgaccgtgccctgggtggagctgggcggcgagtgcaacatcaactgcagcaagaccggctacagcgccaacatcatcttccacaccaagcccttctacggcggcaagaagcacagaatcaccgccgagatcttcagccccaacgacaagaagagcttctgcagcatcgagggcgagtggaacggcgtgatgtacgccaagtacgccaccggcgagaacaccgtgttcgtggacaccaagaagctgcccatcatcaagaagaaggtgagaaagctggaggaccagaacgagtacgagagcagaagcctgtggaaggacgtgaccttcaacctgaagatcagagacatcgacgccgccaccgaggccaagcacagactggaggagagacagagagccgaggccagagagagaaaggagaaggagatccagtgggagaccagactgttccacgaggacggcgagtgctgggtgtacgacgagcccctgctgaagagactgggcgccgccaagcactag

SEQ ID NO: 92224 - DNA, 330 bp, Artificial Sequence
  Description of Artificial Sequence: Synthetic coding sequence
atggtggagagcatcaagcactgcatcgtgctgctgcagatcgccaagagcaccatcaaccccgtggacgccatctaccagcccagccccctggagcccgtgatcagcaccatgcccagccagaccgtgctgccccccgagcccgtgcagctgtgcaagagcgagcagagacccagcagcctgcccgtgggccccgtgctggccaccctgggccaccaccagacccccacccccaacagcaccggcagcggccacagcccccccagcagcagcctgaccagccccagccacgtgaacctgagccccaacaccgtgcccgagttcagctag

SEQ ID NO: 92225 - DNA, 1170 bp, Artificial Sequence
  Description of Artificial Sequence: Synthetic coding sequence
atggagggcgccctggccgccaactggagcgccgaggccgccaacgccagcgccgccccccccggcgccgagggcaacagaaccgccggcccccccagaagaaacgaggccctggccagagtggaggtggccgtgctgtgcctgatcctgctgctggccctgagcggcaacgcctgcgtgctgctggccctgagaaccaccagacagaagcacagcagactgttcttcttcatgaagcacctgagcatcgccgacctggtggtggccgtgttccaggtgctgccccagctgctgtgggacatcaccttcagattctacggccccgacctgctgtgcagactggtgaagtacctgcaggtggtgggcatgttcgccagcacctacctgctgctgctgatgagcctggacagatgcctggccatctgccagcccctgagaagcctgagaagaagaaccgacagactggccgtgctggccacctggctgggctgcctggtggccagcgccccccaggtgcacatcttcagcctgagagaggtggccgacggcgtgttcgactgctgggccgtgttcatccagccctggggccccaaggcctacatcacctggatcaccctggccgtgtacatcgtgcccgtgatcgtgctggccgcctgctacggcctgatcagcttcaagatctggcagaacctgagactgaagaccgccgccgccgccgccgccgaggcccccgagggcgccgccgccggcgacggcggcagagtggccctggccagagtgagcagcgtgaagctgatcagcaaggccaagatcagaaccgtgaagatgaccttcatcatcgtgctggccttcatcgtgtgctggacccccttcttcttcgtgcagatgtggagcgtgtgggacgccaacgcccccaaggaggccagcgccttcatcatcgtgatgctgctggccagcctgaacagctgctgcaacccctggatctacatgctgttcaccggccacctgttccacgagctggtgcagagattcctgtgctgcagcgccagctacctgaagggcagaagactgggcgagaccagcgccagcaagaagagcaacagcagcagcttcgtgctgagccacagaagcagcagccagagaagctgcagccagcccagcaccgcctag

SEQ ID NO: 92226 - DNA, 132 bp, Artificial Sequence
  Description of Artificial Sequence: Synthetic coding sequence
atggagggcgccctggccgccaactggagcgccgaggccgccaacgccagcgccgccccccccggcgccgagggcaacagaaccgccggcccccccagaagaaacgaggccctggccagagtggaggtgtag

SEQ ID NO: 92227 - DNA, 279 bp, Artificial Sequence
  Description of Artificial Sequence: Synthetic coding sequence
atggagggcgccctggccgccaactggagcgccgaggccgccaacgccagcgccgccccccccggcgccgagggcaacagaaccgccggcccccccagaagaaacgaggccctggccagagtggaggtggccgtgctgtgcctgatcctgctgctggccctgagcggcaacgcctgcgtgctgctggccctgagaaccaccagacagaagcacagcagactgttcttcttcatgaagcacctgagcatcgccgacctggtggtggccgtgttccagtag

SEQ ID NO: 92228 - DNA, 1518 bp, Artificial Sequence
  Description of Artificial Sequence: Synthetic coding sequence
atggccagcggcagaagagcccccagaaccggcctgctggagctgagagccggcgccggcagcggcgccggcggcgagagatggcagagagtgctgctgagcctggccgaggacgtgctgaccgtgagccccgccgacggcgaccccggccccgagcccggcgcccccagagagcaggagcccgcccagctgaacggcgccgccgagcccggcgccggccccccccagctgcccgaggccctgctgctgcagagaagaagagtgaccgtgagaaaggccgacgccggcggcctgggcatcagcatcaagggcggcagagagaacaagatgcccatcctgatcagcaagatcttcaagggcctggccgccgaccagaccgaggccctgttcgtgggcgacgccatcctgagcgtgaacggcgaggacctgagcagcgccacccacgacgaggccgtgcaggtgctgaagaagaccggcaaggaggtggtgctggaggtgaagtacatgaaggacgtgagcccctacttcaagaacagcaccggcggcaccagcgtgggctgggacagcccccccgccagccccctgcagagacagcccagcagccccggccccacccccagaaacttcagcgaggccaagcacatgagcctgaagatggcctacgtgagcaagagatgcacccccaacgaccccgagcccagatacctggagatctgcagcgccgacggccaggacaccctgttcctgagagccaaggacgaggccagcgccagaagctgggccaccgccatccaggcccaggtgaacaccctgacccccagagtgaaggacgagctgcaggccctgctggccgccaccagcaccgccggcagccaggacatcaagcagatcggctggctgaccgagcagctgcccagcggcggcaccgcccccaccctggccctgctgaccgagaaggagctgctgctgtacctgagcctgcccgagaccagagaggccctgagcagacccgccagaaccgcccccctgatcgccaccagactggtgcacagcggccccagcaagggcagcgtgccctacgacgccgagctgagcttcgccctgagaaccggcaccagacacggcgtggacacccacctgttcagcgtggagagcccccaggagctggccgcctggaccagacagctggtggacggctgccacagagccgccgagggcgtgcaggaggtgagcaccgcctgcacctggaacggcagaccctgcagcctgagcgtgcacatcgacaagggcttcaccctgtgggccgccgagcccggcgccgccagagccgtgctgctgagacagcccttcgagaagctgcagatgagcagcgacgacggcgccagcctgctgttcctggacttcggcggcgccgagggcgagatccagctggacctgcacagctgccccaagaccatcgtgttcatcatccacagcttcctgagcgccaaggtgaccagactgggcctgctggcctag

SEQ ID NO: 92229 - DNA, 441 bp, Artificial Sequence
  Description of Artificial Sequence: Synthetic coding sequence
atgggcttcctgagaagactgatctacagaagaagacccatgatctacgtggagagcagcgaggagagcagcgacgagcagcccgacgaggtggagagccccacccagagccaggacagcacccccgccgaggagagagaggacgagggcgccagcgccgcccagggccaggagcccgaggccgacagccaggagctggtgcagcccaagaccggctgcgagctgggcgacggccccgacaccaagagagtgtgcctgagaaacgaggagcagatgaagctgcccgccgagggccccgagcccgaggccgacagccaggagcaggtgcaccccaagaccggctgcgagagaggcgacggccccgacgtgcaggagctgggcctgcccaaccccgaggaggtgaagacccccgaggaggacgagggccagagccagccctag

SEQ ID NO: 92230 - DNA, 336 bp, Artificial Sequence
  Description of Artificial Sequence: Synthetic coding sequence
atgagcgagctgctgagagccagaagccagagcagcgagagaggcaacgaccaggagagcagccagcccgtgggcagcgtgatcgtgcaggagcccaccgaggagaagagacaggaggaggagccccccaccgacaaccagggcatcgcccccagcggcgagatcgagaaccaggccgtgcccgccttccagggccccgacatggaggccttccagcaggagctggccctgctgaagatcgaggacgagcccggcgacggccccgacgtgagagagggcatcatgcccaccttcgacctgaccaaggtgctggaggccggcgacgcccagccctag

SEQ ID NO: 92231 - DNA, 195 bp, Artificial Sequence
  Description of Artificial Sequence: Synthetic coding sequence
atgagcgagctgctgagagccagaagccagagcagcgagagaggcaacgaccaggagagcagccagcccgtgggcagcgtgatcgtgcaggagcccaccgaggagaagagacaggaggaggagccccccaccgacaaccagggcatcgcccccagcggcgagatcgagaaccaggccgtgcccgccttccagtag

SEQ ID NO: 92232 - DNA, 342 bp, Artificial Sequence
  Description of Artificial Sequence: Synthetic coding sequence
atgagcggccaccagagaaccagaagcagaagcagagagagaagagacgaccaggacagcaaccaccccgtgggcgccgtggtggcccaggagctgcccagcaacgaccagctgcagcaggaggagccccccatcgagagccaggactacacccccggccaggagagagacgagggcgccctggacttccaggtgctgggcctggccgcctacctgtgggagctgaccagaagcaagaccggcggcgagagaggcgacggccccaacgtgaagggcgagttcctgcccaacctggagcccgtgaagatccccgaggccggcgagggccagcccagcgtgtag

SEQ ID NO: 92233 - DNA, 342 bp, Artificial Sequence; identical to SEQ ID NO: 92232
  Description of Artificial Sequence: Synthetic coding sequence

SEQ ID NO: 92234 - DNA, 1458 bp, Artificial Sequence
  Description of Artificial Sequence: Synthetic coding sequence
atggccgccgtgtggcagcaggtgctggccgtggacgccagatacaacgcctacagaacccccaccttcccccagttcagaacccagtacatcagaagaagaagccagctgctgagagagaacgccaaggccggccacccccccgccctgagaagacagtacctgagactgagaggccagctgctgggccagagatacggccccctgagcgagcccggcagcgccagagcctacagcaacagcatcgtgagaagcagcagaaccaccctggacagaatggaggacttcgaggacgaccccagagccctgggcgccagaggccacagaagaagcgtgagcagaggcagctaccagctgcaggcccagatgaacagagccgtgtacgaggacagaccccccggcagcgtggtgcccaccagcgccgccgaggccagcagagccatggccggcgacaccagcctgagcgagaactacgccttcgccggcatgtaccacgtgttcgaccagcacgtggacgaggccgtgcccagagtgagattcgccaacgacgacagacacagactggcctgctgcagcctggacggcagcatcagcctgtgccagctggtgcccgccccccccaccgtgctgagagtgctgagaggccacaccagaggcgtgagcgacttcgcctggagcctgagcaacgacatcctggtgagcaccagcctggacgccaccatgagaatctgggccagcgaggacggcagatgcatcagagagatccccgaccccgacagcgccgagctgctgtgctgcaccttccagcccgtgaacaacaacctgaccgtggtgggcaacgccaagcacaacgtgcacgtgatgaacatcagcaccggcaagaaggtgaagggcggcagcagcaagctgaccggcagagtgctggccctgagcttcgacgcccccggcagactgctgtgggccggcgacgaccacggcagcgtgttcagcttcctgttcgacatggccaccggcaagctgaccaaggccaagagactggtggtgcacgagggcagccccgtgaccagcatcagcgccagaagctgggtgagcagagaggccagagaccccagcctgctgatcaacgcctgcctgaacaagctgctgctgtacagagtggtggacaacgagggcaccctgcagctgaagagaagcttccccatcgagcagagcagccaccccgtgagaagcatcttctgccccctgatgagcttcagacagggcgcctgcgtggtgaccggcagcgaggacatgtgcgtgcacttcttcgacgtggagagagccgccaaggccgccgtgaacaagctgcagggccacagcgcccccgtgctggacgtgagcttcaactgcgacgagagcctgctggccagcagcgacgccagcggcatggtgatcgtgtggagaagagagcagaagtag

SEQ ID NO: 92235 - DNA, 309 bp, Artificial Sequence; identical to SEQ ID NO: 83394
  Description of Artificial Sequence: Synthetic coding sequence

SEQ ID NO: 92236 - DNA, 1575 bp, Artificial Sequence
  Description of Artificial Sequence: Synthetic coding sequence
atgagcgacaacggcgagctggaggacaagccccccgccccccccgtgagaatgagcagcaccatcttcagcaccggcggcaaggaccccctgagcgccaaccacagcctgaagcccctgcccagcgtgcccgaggagaagaagcccagacacaagatcatcagcatcttcagcggcaccgagaagggcagcaagaagaaggagaaggagagacccgagatcagcccccccagcgacttcgagcacaccatccacgtgggcttcgacgccgtgaccggcgagttcaccggcatgcccgagcagtgggccagactgctgcagaccagcaacatcaccaagctggagcagaagaagaacccccaggccgtgctggacgtgctgaagttctacgacagcaacaccgtgaagcagaagtacctgagcttcaccccccccgagaaggacggcttccccagcggcacccccgccctgaacgccaagggcaccgaggcccccgccgtggtgaccgaggaggaggacgacgacgaggagaccgccccccccgtgatcgcccccagacccgaccacaccaagagcatctacaccagaagcgtgatcgaccccgtgcccgcccccgtgggcgacagccacgtggacggcgccgccaagagcctggacaagcagaagaagaagaccaagatgaccgacgaggagatcatggagaagctgagaaccatcgtgagcatcggcgaccccaagaagaagtacaccagatacgagaagatcggccagggcgccagcggcaccgtgttcaccgccaccgacgtggccctgggccaggaggtggccatcaagcagatcaacctgcagaagcagcccaagaaggagctgatcatcaacgagatcctggtgatgaaggagctgaagaaccccaacatcgtgaacttcctggacagctacctggtgggcgacgagctgttcgtggtgatggagtacctggccggcggcagcctgaccgacgtggtgaccgagacctgcatggacgaggcccagatcgccgccgtgtgcagagagtgcctgcaggccctggagttcctgcacgccaaccaggtgatccacagagacatcaagagcgacaacgtgctgctgggcatggagggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatggtggagggcgagcccccctacctgaacgagaaccccctgagagccctgtacctgatcgccaccaacggcacccccgagctgcagaaccccgagaagctgagccccatcttcagagacttcctgaacagatgcctggagatggacgtggagaagagaggcagcgccaaggagctgctgcagcaccccttcctgaagctggccaagcccctgagcagcctgacccccctgatcatggccgccaaggaggccatgaagagcaacagatag

SEQ ID NO: 92237 - DNA, 1680 bp, Artificial Sequence
  Description of Artificial Sequence: Synthetic coding sequence
atgagcgacggcctggacaacgaggagaagccccccgccccccccctgagaatgaacagcaacaacagagacagcagcgccctgaaccacagcagcaagcccctgcccatggcccccgaggagaagaacaagaaggccagactgagaagcatcttccccggcggcggcgacaagaccaacaagaagaaggagaaggagagacccgagatcagcctgcccagcgacttcgagcacaccatccacgtgggcttcgacgccgtgaccggcgagttcacccccgacctgtacggcagccagatgtgccccggcaagctgcccgagggcatccccgagcagtgggccagactgctgcagaccagcaacatcaccaagctggagcagaagaagaacccccaggccgtgctggacgtgctgaagttctacgacagcaaggagaccgtgaacaaccagaagtacatgagcttcaccagcggcgacaagagcgcccacggctacatcgccgcccaccccagcagcaccaagaccgccagcgagccccccctggccccccccgtgagcgaggaggaggacgaggaggaggaggaggaggaggacgagaacgagcccccccccgtgatcgcccccagacccgagcacaccaagagcatctacaccagaagcgtggtggagagcatcgccagccccgccgtgcccaacaaggaggtgaccccccccagcgccgagaacgccaacagcagcaccctgtacagaaacaccgacagacagagaaagaagagcaagatgaccgacgaggagatcctggagaagctgagaagcatcgtgagcgtgggcgaccccaagaagaagtacaccagattcgagaagatcggccagggcgccagcggcaccgtgtacaccgccctggacatcgccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggacttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatggtggagggcgagcccccctacctgaacgagaaccccctgagagccctgtacctgatcgccaccaacggcacccccgagctgcagaaccccgagagactgagcgccgtgttcagagacttcctgaacagatgcctggagatggacgtggacagaagaggcagcgccaaggagctgctgcagcaccccttcctgaagctggccaagcccctgagcagcctgacccccctgatcatcgccgccaaggaggccatcaagaacagcagcagatag

SEQ ID NO: 92238 - DNA, 1743 bp, Artificial Sequence
  Description of Artificial Sequence: Synthetic coding sequence
atgagcgacggcctggacaacgaggagaagccccccgccccccccctgagaatgaacagcaacaacagagacagcagcgccctgaaccacagcagcaagcccctgcccatggcccccgaggagaagaacaagaaggccagactgagaagcatcttccccggcggcggcgacaagaccaacaagaagaaggagaaggagagacccgagatcagcctgcccagcgacttcgagcacaccatccacgtgggcttcgacgccgtgaccggcgagttcaccaacagccccttccagaccagcagacccgtgaccgtggccagcagccagagcgagggcaagatgcccgacctgtacggcagccagatgtgccccggcaagctgcccgagggcatccccgagcagtgggccagactgctgcagaccagcaacatcaccaagctggagcagaagaagaacccccaggccgtgctggacgtgctgaagttctacgacagcaaggagaccgtgaacaaccagaagtacatgagcttcaccagcggcgacaagagcgcccacggctacatcgccgcccaccccagcagcaccaagaccgccagcgagccccccctggccccccccgtgagcgaggaggaggacgaggaggaggaggaggaggaggacgagaacgagcccccccccgtgatcgcccccagacccgagcacaccaagagcatctacaccagaagcgtggtggagagcatcgccagccccgccgtgcccaacaaggaggtgaccccccccagcgccgagaacgccaacagcagcaccctgtacagaaacaccgacagacagagaaagaagagcaagatgaccgacgaggagatcctggagaagctgagaagcatcgtgagcgtgggcgaccccaagaagaagtacaccagattcgagaagatcggccagggcgccagcggcaccgtgtacaccgccctggacatcgccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggacttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatggtggagggcgagcccccctacctgaacgagaaccccctgagagccctgtacctgatcgccaccaacggcacccccgagctgcagaaccccgagagactgagcgccgtgttcagagacttcctgaacagatgcctggagatggacgtggacagaagaggcagcgccaaggagctgctgcagcaccccttcctgaagctggccaagcccctgagcagcctgacccccctgatcatcgccgccaaggaggccatcaagaacagcagcagatag

SEQ ID NO: 92239 - DNA, 1635 bp, Artificial Sequence
  Description of Artificial Sequence: Synthetic coding sequence
atgagcgacggcctggacaacgaggagaagccccccgccccccccctgagaatgaacagcaacaacagagacagcagcgccctgaaccacagcagcaagcccctgcccatggcccccgaggagaagaacaagaaggccagactgagaagcatcttccccggcggcggcgacaagaccaacaagaagaaggagaaggagagacccgagatcagcctgcccagcgacttcgagcacaccatccacgtgggcttcgacgccgtgaccggcgagttcaccggcatccccgagcagtgggccagactgctgcagaccagcaacatcaccaagctggagcagaagaagaacccccaggccgtgctggacgtgctgaagttctacgacagcaaggagaccgtgaacaaccagaagtacatgagcttcaccagcggcgacaagagcgcccacggctacatcgccgcccaccccagcagcaccaagaccgccagcgagccccccctggccccccccgtgagcgaggaggaggacgaggaggaggaggaggaggaggacgagaacgagcccccccccgtgatcgcccccagacccgagcacaccaagagcatctacaccagaagcgtggtggagagcatcgccagccccgccgtgcccaacaaggaggtgaccccccccagcgccgagaacgccaacagcagcaccctgtacagaaacaccgacagacagagaaagaagagcaagatgaccgacgaggagatcctggagaagctgagaagcatcgtgagcgtgggcgaccccaagaagaagtacaccagattcgagaagatcggccagggcgccagcggcaccgtgtacaccgccctggacatcgccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggacttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatggtggagggcgagcccccctacctgaacgagaaccccctgagagccctgtacctgatcgccaccaacggcacccccgagctgcagaaccccgagagactgagcgccgtgttcagagacttcctgaacagatgcctggagatggacgtggacagaagaggcagcgccaaggagctgctgcagcaccccttcctgaagctggccaagcccctgagcagcctgacccccctgatcatcgccgccaaggaggccatcaagaacagcagcagatag

SEQ ID NO: 92240 - DNA, 1680 bp, Artificial Sequence; identical to SEQ ID NO: 92237
  Description of Artificial Sequence: Synthetic coding sequence

SEQ ID NO: 92241 - DNA, 1698 bp, Artificial Sequence
  Description of Artificial Sequence: Synthetic coding sequence
atgagcgacggcctggacaacgaggagaagccccccgccccccccctgagaatgaacagcaacaacagagacagcagcgccctgaaccacagcagcaagcccctgcccatggcccccgaggagaagaacaagaaggccagactgagaagcatcttccccggcggcggcgacaagaccaacaagaagaaggagaaggagagacccgagatcagcctgcccagcgacttcgagcacaccatccacgtgggcttcgacgccgtgaccggcgagttcaccaacagccccttccagaccagcagacccgtgaccgtggccagcagccagagcgagggcaagatgggcatccccgagcagtgggccagactgctgcagaccagcaacatcaccaagctggagcagaagaagaacccccaggccgtgctggacgtgctgaagttctacgacagcaaggagaccgtgaacaaccagaagtacatgagcttcaccagcggcgacaagagcgcccacggctacatcgccgcccaccccagcagcaccaagaccgccagcgagccccccctggccccccccgtgagcgaggaggaggacgaggaggaggaggaggaggaggacgagaacgagcccccccccgtgatcgcccccagacccgagcacaccaagagcatctacaccagaagcgtggtggagagcatcgccagccccgccgtgcccaacaaggaggtgaccccccccagcgccgagaacgccaacagcagcaccctgtacagaaacaccgacagacagagaaagaagagcaagatgaccgacgaggagatcctggagaagctgagaagcatcgtgagcgtgggcgaccccaagaagaagtacaccagattcgagaagatcggccagggcgccagcggcaccgtgtacaccgccctggacatcgccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggacttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatggtggagggcgagcccccctacctgaacgagaaccccctgagagccctgtacctgatcgccaccaacggcacccccgagctgcagaaccccgagagactgagcgccgtgttcagagacttcctgaacagatgcctggagatggacgtggacagaagaggcagcgccaaggagctgctgcagcaccccttcctgaagctggccaagcccctgagcagcctgacccccctgatcatcgccgccaaggaggccatcaagaacagcagcagatag

SEQ ID NO: 92242 - DNA, 1635 bp, Artificial Sequence; identical to SEQ ID NO: 92239
  Description of Artificial Sequence: Synthetic coding sequence

SEQ ID NO: 92243 - DNA, 546 bp, Artificial Sequence
  Description of Artificial Sequence: Synthetic coding sequence
atgagcgacggcctggacaacgaggagaagccccccgccccccccctgagaatgaacagcaacaacagagacagcagcgccctgaaccacagcagcaagcccctgcccatggcccccgaggagaagaacaagaaggccagactgagaagcatcttccccggcggcggcgacaagaccaacaagaagaaggagaaggagagacccgagatcagcctgcccagcgacttcgagcacaccatccacgtgggcttcgacgccgtgaccggcgagttcaccaacagccccttccagaccagcagacccgtgaccgtggccagcagccagagcgagggcaagatgcccgacctgtacggcagccagatgtgccccggcaagctgcccgagggcatccccgagcagtgggccagactgctgcagaccagcaacatcaccaagctggagcagaagaagaacccccaggccgtgctggacgtgctgaagttctacgacagcaaggagaccgtgaacaaccagaagtacatgagcttcaccagcggcgacaagtag

SEQ ID NO: 92244 - DNA, 1635 bp, Artificial Sequence; identical to SEQ ID NO: 92239
  Description of Artificial Sequence: Synthetic coding sequence

SEQ ID NO: 92245 - DNA, 1743 bp, Artificial Sequence; identical to SEQ ID NO: 92238
  Description of Artificial Sequence: Synthetic coding sequence

SEQ ID NO: 92246 - DNA, 1698 bp, Artificial Sequence; identical to SEQ ID NO: 92241
  Description of Artificial Sequence: Synthetic coding sequence

SEQ ID NO: 92247 - DNA, 2046 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagaagagcccagagcctgggcctgctgggcgacgagcactgggccaccgaccccgacatgtacctgcagagcccccagagcgagagaaccgacccccacggcctgtacctgagctgcaacggcggcacccccgccggccacaagcagatgccctggcccgagccccagagccccagagtgctgcccaacggcctggccgccaaggcccagagcctgggccccgccgagttccagggcgccagccagagatgcctgcagctgggcgcctgcctgcagagcagcccccccggcgccagcccccccaccggcaccaacagacacggcatgaaggccgccaagcacggcagcgaggaggccagaccccagagctgcctggtgggcagcgccaccggcagacccggcggcgagggcagccccagccccaagaccagagagagcagcctgaagagaagactgttcagaagcatgttcctgagcaccgccgccaccgccccccccagcagcagcaagcccggcccccccccccagagcaagcccaacagcagcttcagacccccccagaaggacaacccccccagcctggtggccaaggcccagagcctgcccagcgaccagcccgtgggcaccttcagccccctgaccaccagcgacaccagcagcccccagaagagcctgagaaccgcccccgccaccggccagctgcccggcagaagcagccccgccggcagccccagaacctggcacgcccagatcagcaccagcaacctgtacctgccccaggaccccaccgtggccaagggcgccctggccggcgaggacaccggcgtggtgacccacgagcagttcaaggccgccctgagaatggtggtggaccagggcgaccccagactgctgctggacagctacgtgaagatcggcgagggcagcaccggcatcgtgtgcctggccagagagaagcacagcggcagacaggtggccgtgaagatgatggacctgagaaagcagcagagaagagagctgctgttcaacgaggtggtgatcatgagagactaccagcacttcaacgtggtggagatgtacaagagctacctggtgggcgaggagctgtgggtgctgatggagttcctgcagggcggcgccctgaccgacatcgtgagccaggtgagactgaacgaggagcagatcgccaccgtgtgcgaggccgtgctgcaggccctggcctacctgcacgcccagggcgtgatccacagagacatcaagagcgacagcatcctgctgaccctggacggcagagtgaagctgagcgacttcggcttctgcgcccagatcagcaaggacgtgcccaagagaaagagcctggtgggcaccccctactggatggcccccgaggtgatcagcagaagcctgtacgccaccgaggtggacatctggagcctgggcatcatggtgatcgagatggtggacggcgagcccccctacttcagcgacagccccgtgcaggccatgaagagactgagagacagccccccccccaagctgaagaacagccacaaggtgagccccgtgctgagagacttcctggagagaatgctggtgagagacccccaggagagagccaccgcccaggagctgctggaccaccccttcctgctgcagaccggcctgcccgagtgcctggtgcccctgatccagctgtacagaaagcagaccagcacctgctag

SEQ ID NO: 92248 - DNA, 2046 bp, Artificial Sequence; identical to SEQ ID NO: 92247
  Description of Artificial Sequence: Synthetic coding sequence

SEQ ID NO: 92249 - DNA, 2046 bp, Artificial Sequence; identical to SEQ ID NO: 92247
  Description of Artificial Sequence: Synthetic coding sequence

SEQ ID NO: 92250 - DNA, 369 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagaagagcccagagcctgggcctgctgggcgacgagcactggtag

SEQ ID NO: 92251 - DNA, 372 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagaagagcccagagcctgggcctgctgggcgacgagcactgggcctag

SEQ ID NO: 92252 - DNA, 330 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagatag

SEQ ID NO: 92253 - DNA, 339 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagaagagcccagtag

SEQ ID NO: 92254 - DNA, 2046 bp, Artificial Sequence; identical to SEQ ID NO: 92247
  Description of Artificial Sequence: Synthetic coding sequence

SEQ ID NO: 92255 - DNA, 855 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagccccaccagcagaagaagagcccagagcctgggcctgctgggcgacgagcactgggccaccgaccccgacatgtacctgcagagcccccagagcgagagaaccgacccccacggcctgtacctgagctgcaacggcggcacccccgccggccacaagcagatgccctggcccgagccccagagccccagagtgctgcccaacggcctggccgccaaggcccagagcctgggccccgccgagttccagggcgccagccagagatgcctgcagctgggcgcctgcctgcagagcagcccccccggcgccagcccccccaccggcaccaacagacacggcatgaaggccgccaagcacggcagcgaggaggccagaccccagagctgcctggtgggcagcgccaccggcagacccggcggcgagggcagccccagccccaagaccagagagagcagcctgaagagaagactgttcagaagcatgttcctgagcaccgccgccaccgccccccccagcagcagcaagcccggcccccccccccagtag

SEQ ID NO: 92256 - DNA, 318 bp, Artificial Sequence
  Description of Artificial Sequence: Synthetic coding sequence
atgttcagaaagaagaagaagaagagacccgagatcagcgccccccagaacttccagcacagagtgcacaccagcttcgaccccaaggagggcaagttcgtgggcctgcccccccagtggcagaacatcctggacaccctgagaagacccaagcccgtggtggaccccagcagaatcaccagagtgcagctgcagcccatgaagaccgtggtgagaggcagcgccatgcccgtggacggctacatcagcggcctgctgaacgacatccagaagctgagcgtgatcagcagcaacaccctgagaggcagaagcccctag

SEQ ID NO: 92257 - DNA, 441 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatggccacctacggcgagggctag

SEQ ID NO: 92258 - DNA, 519 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatggccacctacggcgagggcgaccccaccgacaacgcccaggacttctacgactggctgcaggagaccgacgtggacctgagcggcgtgaagttcgcctag

SEQ ID NO: 92259 - DNA, 189 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagacctag

SEQ ID NO: 92260 - DNA, 1107 bp, Artificial Sequence
  Description of Artificial Sequence: Synthetic coding sequence
atgggcaagtacgtggacaagagactggagcagctgggcgcccagagaatcttcgagctgggcctgggcgacgacgacggcaacctggaggaggacttcatcacctggagagagcagttctggcccgccgtgtgcgagcacttcggcgtggaggccaccggcgaggagagcagcatcagacagtacgagctggtggtgcacaccgacatcgacgccgccaaggtgtacatgggcgagatgggcagactgaagagctacgagaaccagaagccccccttcgacgccaagaaccccttcctggccgccgtgaccaccaacagaaagctgaaccagggcaccgagagacacctgatgcacctggagctggacatcagcgacagcaagatcagatacgagagcggcgaccacgtggccgtgtaccccgccaacgacagcgccctggtgaaccagctgggcaagatcctgggcgccgacctggacgtggtgatgagcctgaacaacctggacgaggagagcaacaagaagcaccccttcccctgccccaccagctacagaaccgccctgacctactacctggacatcaccaacccccccagaaccaacgtgctgtacgagctggcccagtacgccagcgagcccagcgagcaggagctgctgagaaagatggccagcagcagcggcgagggcaaggagctgtacctgagctgggtggtggaggccagaagacacatcctggccatcctgcaggactgccccagcctgagaccccccatcgaccacctgtgcgagctgctgcccagactgcaggccagatactacagcatcgccagcagcagcaaggtgcaccccaacagcgtgcacatctgcgccgtggtggtggagtacgagaccaaggccggcagaatcaacaagggcgtggccaccaactggctgagagccaaggagcccgccggcgagaacggcggcagagccctggccgtgcccaccagcaccagcgtgggcatgcacggcacctggcccggcatgtgcagaacccccagcaccaccagctggctgagcagcggcccctggagcaccagaagaagatggaccaccagcagaaactag

SEQ ID NO: 92261 - DNA, 120 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggctag

SEQ ID NO: 92262 - DNA, 501 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatggccacctacggcgagggcgaccccaccgacaacgcccaggacttctacgactggctgcaggagaccgacgtggacctgtag

SEQ ID NO: 92263 - DNA, 567 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatggccacctacggcgagggcgaccccaccgacaacgcccaggacttctacgactggctgcaggagaccgacgtggacctgagcggcgtgaagttcgccgtgttcggcctgggcaacaagacctacgagcacttcaacgccatgggctag

SEQ ID NO: 92264 - DNA, 189 bp, Artificial Sequence; identical to SEQ ID NO: 92259
  Description of Artificial Sequence: Synthetic coding sequence

SEQ ID NO: 92265 - DNA, 1722 bp, Artificial Sequence
  Description of Artificial Sequence: Synthetic coding sequence
atgggcagcagatggcccgccgtgcccccctggggcctgcagatccacgtgagcgagagacagcccagcagaccccccccctgcccccagcagcccggccaggccacctgcgagaccctgagcagcgcccccgaccccagcaccaccagaatgagccccccctgcccccagccccagagcgcccccggcggcatcggctgctggagactgaaggtgttcggcctgggcaacaagacctacgagcacttcaacgccatgggcaagtacgtggacaagagactggagcagctgggcgcccagagaatcttcgagctgggcctgggcgacgacgacggcaacctggaggaggacttcatcacctggagagagcagttctggcccgccgtgtgcgagcacttcggcgtggaggccaccggcgaggagagcagcatcagacagtacgagctggtggtgcacaccgacatcgacgccgccaaggtgtacatgggcgagatgggcagactgaagagctacgagaaccagaagccccccttcgacgccaagaaccccttcctggccgccgtgaccaccaacagaaagctgaaccagggcaccgagagacacctgatgcacctggagctggacatcagcgacagcaagatcagatacgagagcggcgaccacgtggccgtgtaccccgccaacgacagcgccctggtgaaccagctgggcaagatcctgggcgccgacctggacgtggtgatgagcctgaacaacctggacgaggagagcaacaagaagcaccccttcccctgccccaccagctacagaaccgccctgacctactacctggacatcaccaacccccccagaaccaacgtgctgtacgagctggcccagtacgccagcgagcccagcgagcaggagctgctgagaaagatggccagcagcagcggcgagggcaaggagctgtacctgagctgggtggtggaggccagaagacacatcctggccatcctgcaggactgccccagcctgagaccccccatcgaccacctgtgcgagctgctgcccagactgcaggccagatactacagcatcgccagcagcagcaaggtgcaccccaacagcgtgcacatctgcgccgtggtggtggagtacgagaccaaggccggcagaatcaacaagggcgtggccaccaactggctgagagccaaggagcccgccggcgagaacggcggcagagccctggtgcccatgttcgtgagaaagagccagttcagactgcccttcaaggccaccacccccgtgatcatggtgggccccggcaccggcgtggcccccttcatcggcttcatccaggagagagcctggctgagacagcagggcaaggaggtgggcgagaccctgctgtactacggctgcagaagaagcgacgaggactacctgtacagagaggagctggcccagttccacagagacggcgccctgacccagctgaacgtggccttcagcagagagcagagccacaaggtgtacgtgcagcacctgctgaagcaggacagagagcacctgtggaagctgatcgagggcggcgcccacatctacgtgtgcggcacccccagcagctgccccggcatgcacggcacctggcccggcatgtgcagaacccccagcaccaccagctggctgagcagcggcccctggagcaccagaagaagatggaccaccagcagaaactag

SEQ ID NO: 92266 - DNA, 423 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatgtag

SEQ ID NO: 92267 - DNA, 2043 bp, Artificial Sequence
  Description of Artificial Sequence: Synthetic coding sequence
atgatcaacatgggcgacagccacgtggacaccagcagcaccgtgagcgaggccgtggccgaggaggtgagcctgttcagcatgaccgacatgatcctgttcagcctgatcgtgggcctgctgacctactggttcctgttcagaaagaagaaggaggaggtgcccgagttcaccaagatccagaccctgaccagcagcgtgagagagagcagcttcgtggagaagatgaagaagaccggcagaaacatcatcgtgttctacggcagccagaccggcaccgccgaggagttcgccaacagactgagcaaggacgcccacagatacggcatgagaggcatgagcgccgaccccgaggagtacgacctggccgacctgagcagcctgcccgagatcgacaacgccctggtggtgttctgcatggccacctacggcgagggcgaccccaccgacaacgcccaggacttctacgactggctgcaggagaccgacgtggacctgagcggcgtgaagttcgccgtgttcggcctgggcaacaagacctacgagcacttcaacgccatgggcaagtacgtggacaagagactggagcagctgggcgcccagagaatcttcgagctgggcctgggcgacgacgacggcaacctggaggaggacttcatcacctggagagagcagttctggcccgccgtgtgcgagcacttcggcgtggaggccaccggcgaggagagcagcatcagacagtacgagctggtggtgcacaccgacatcgacgccgccaaggtgtacatgggcgagatgggcagactgaagagctacgagaaccagaagccccccttcgacgccaagaaccccttcctggccgccgtgaccaccaacagaaagctgaaccagggcaccgagagacacctgatgcacctggagctggacatcagcgacagcaagatcagatacgagagcggcgaccacgtggccgtgtaccccgccaacgacagcgccctggtgaaccagctgggcaagatcctgggcgccgacctggacgtggtgatgagcctgaacaacctggacgaggagagcaacaagaagcaccccttcccctgccccaccagctacagaaccgccctgacctactacctggacatcaccaacccccccagaaccaacgtgctgtacgagctggcccagtacgccagcgagcccagcgagcaggagctgctgagaaagatggccagcagcagcggcgagggcaaggagctgtacctgagctgggtggtggaggccagaagacacatcctggccatcctgcaggactgccccagcctgagaccccccatcgaccacctgtgcgagctgctgcccagactgcaggccagatactacagcatcgccagcagcagcaaggtgcaccccaacagcgtgcacatctgcgccgtggtggtggagtacgagaccaaggccggcagaatcaacaagggcgtggccaccaactggctgagagccaaggagcccgccggcgagaacggcggcagagccctggtgcccatgttcgtgagaaagagccagttcagactgcccttcaaggccaccacccccgtgatcatggtgggccccggcaccggcgtggcccccttcatcggcttcatccaggagagagcctggctgagacagcagggcaaggaggtgggcgagaccctgctgtactacggctgcagaagaagcgacgaggactacctgtacagagaggagctggcccagttccacagagacggcgccctgacccagctgaacgtggccttcagcagagagcagagccacaaggtgtacgtgcagcacctgctgaagcaggacagagagcacctgtggaagctgatcgagggcggcgcccacatctacgtgtgcggcgacgccagaaacatggccagagacgtgcagaacaccttctacgacatcgtggccgagctgggcgccatggagcacgcccaggccgtggactacatcaagaagctgatgaccaagggcagatacagcctggacgtgtggagctag

SEQ ID NO: 92268 - DNA, 1467 bp, Artificial Sequence
  Description of Artificial Sequence: Synthetic coding sequence
atgcccagaaccagcaccaccggctgcagaagacagacctggatcagcctgggcagcagcagcagactggaggaggacttcatcacctggagagagcagttctggcccgccgtgtgcgagcacttcggcgtggaggccaccggcgaggagagcagcatcagacagtacgagctggtggtgcacaccgacatcgacgccgccaaggtgtacatgggcgagatgggcagactgaagagctacgagaaccagaagccccccttcgacgccaagaaccccttcctggccgccgtgaccaccaacagaaagctgaaccagggcaccgagagacacctgatgcacctggagctggacatcagcgacagcaagatcagatacgagagcggcgaccacgtggccgtgtaccccgccaacgacagcgccctggtgaaccagctgggcaagatcctgggcgccgacctggacgtggtgatgagcctgaacaacctggacgaggagagcaacaagaagcaccccttcccctgccccaccagctacagaaccgccctgacctactacctggacatcaccaacccccccagaaccaacgtgctgtacgagctggcccagtacgccagcgagcccagcgagcaggagctgctgagaaagatggccagcagcagcggcgagggcaaggagctgtacctgagctgggtggtggaggccagaagacacatcctggccatcctgcaggactgccccagcctgagaccccccatcgaccacctgtgcgagctgctgcccagactgcaggccagatactacagcatcgccagcagcagcaaggtgcaccccaacagcgtgcacatctgcgccgtggtggtggagtacgagaccaaggccggcagaatcaacaagggcgtggccaccaactggctgagagccaaggagcccgccggcgagaacggcggcagagccctggtgcccatgttcgtgagaaagagccagttcagactgcccttcaaggccaccacccccgtgatcatggtgggccccggcaccggcgtggcccccttcatcggcttcatccaggagagagcctggctgagacagcagggcaaggaggtgggcgagaccctgctgtactacggctgcagaagaagcgacgaggactacctgtacagagaggagctggcccagttccacagagacggcgccctgacccagctgaacgtggccttcagcagagagcagagccacaaggtgtacgtgcagcacctgctgaagcaggacagagagcacctgtggaagctgatcgagggcggcgcccacatctacgtgtgcggcgacgccagaaacatggccagagacgtgcagaacaccttctacgacatcgtggccgagctgggcgccatggagcacgcccaggccgtggactacatcaagaagctgatgaccaagggcagatacagcctggacgtgtggagctag

SEQ ID NO: 92269 - DNA, 402 bp, Artificial Sequence
  Description of Artificial Sequence: Synthetic coding sequence
atgctgagccccgaggccgagagagtgctgagatacctggtggaggtggaggagctggccgaggaggtgctggccgacaagagacagatcgtggacctggacaccaagagaaaccagaacagagagggcctgagagccctgcagaaggacctgagcctgagcgaggacgtgatggtgtgcttcggcaacatgttcatcaagatgccccaccccgagaccaaggagatgatcgagaaggaccaggaccacctggacaaggagatcgagaagctgagaaagcagctgaaggtgaaggtgaacagactgttcgaggcccagggcaagcccgagctgaagggcttcaacctgaaccccctgaaccaggacgagctgaaggccctgaaggtgatcctgaagggctag

SEQ ID NO: 92270 - DNA, 1605 bp, Artificial Sequence
  Description of Artificial Sequence: Synthetic coding sequence
atgaagttcaccctgggcctgggcagcagagcctggagagtgagctgggagggcgccgccgccgccgccgccggccccggcgccggcggcagcgccctgagatgcagagcccagagagtgagcagccccagactgggcagaagaggcagcagactgagcggcgccctgcccctgtgcctgagcagaggcggcggcggcgcccaggccctgcccgactgcgccggccccagccccggccaccccggccaccccggcgccagacagctggccggccccctggccatggagcagacctacggcgaggtgaaccagctgggcggcgtgttcgtgaacggcagacccctgcccaacgccatcagactgagaatcgtggagctggcccagctgggcatcagaccctgcgacatcagcagacagctgagagtgagccacggctgcgtgagcaagatcctggccagatacaacgagaccggcagcatcctgcccggcgccatcggcggcagcaagcccagagtgaccacccccaacgtggtgaagcacatcagagactacaagcagggcgaccccggcatcttcgcctgggagatcagagacagactgctggccgacggcgtgtgcgacaagtacaacgtgcccagcgtgagcagcatcagcagaatcctgagaaacaagatcggcagcctggcccagcccggcccctacgaggccagcaagcagccccccagccagcccaccctgccctacaaccacatctaccagtacccctaccccagccccgtgagccccaccggcgccaagatgggcagccaccccggcgtgcccggcaccgccggccacgtgagcatccccagaagctggcccagcgcccacagcgtgagcaacatcctgggcatcagaaccttcatggagcagaccggcgccctggccggcagcgagggcaccgcctacagccccaagatggaggactgggccggcgtgaacagaaccgccttccccgccacccccgccgtgaacggcctggagaagcccgccctggaggccgacatcaagtacacccagagcgccagcaccctgagcgccgtgggcggcttcctgcccgcctgcgcctaccccgccagcaaccagcacggcgtgtacagcgcccccggcggcggctacctggcccccggccccccctggccccccgcccagggcccccccctggccccccccggcgccggcgtggccgtgcacggcggcgagctggccgccgccatgaccttcaagcaccccagcagagagggcagcctgcccgcccccgccgccagacccagaacccccagcgtggcctacaccgactgccccagcagacccagaccccccagaggcagcagccccagaaccagagccagaagagagagacaggccgaccccggcgcccaggtgtgcgccgccgcccccgccatcggcaccggcagaatcggcggcctggccgaggaggaggccagcgccggccccagaggcgccagacccgccagcccccaggcccagccctgcctgtggcccgaccccccccacttcctgtactggagcggcttcctgggcttcagcgagctgggcttctag

SEQ ID NO: 92271 - DNA, 1185 bp, Artificial Sequence
  Description of Artificial Sequence: Synthetic coding sequence
atggacatgcactgcaaggccgaccccttcagcgccatgcaccccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggacaagatcgccgagtacaagagacagaaccccaccatgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggacgtgagcgagggcagcgtgcccaacggcgacagccagagcggcgtggacagcctgagaaagcacctgagagccgacaccttcacccagcagcagctggaggccctggacagagtgttcgagagacccagctaccccgacgtgttccaggccagcgagcacatcaagagcgagcagggcaacgagtacagcctgcccgccctgacccccggcctggacgaggtgaagagcagcctgagcgccagcaccaaccccgagctgggcagcaacgtgagcggcacccagacctaccccgtggtgaccggcagagacatggccagcaccaccctgcccggctaccccccccacgtgccccccaccggccagggcagctaccccaccagcaccctggccggcatggtgcccggcagcgagttcagcggcaacccctacagccacccccagtacaccgcctacaacgaggcctggagattcagcaaccccgccctgctgagcagcccctactactacagcgccgcccccagaggcagcgcccccgccgccgccgccgccgcctacgacagacactag

SEQ ID NO: 92272 - DNA, 1191 bp, Artificial Sequence
  Description of Artificial Sequence: Synthetic coding sequence
atggacatgcactgcaaggccgaccccttcagcgccatgcaccccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggacaagatcgccgagtacaagagacagaaccccaccatgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggacgtgagcgagggcagcgtgcccaacggcgacagccagagcggcgtggacagcctgagaaagcacctgagagccgacaccttcacccagcagcagctggaggccctggacagagtgttcgagagacccagctaccccgacgtgttccaggccagcgagcacatcaagagcgagcagggcaacgagtacagcctgcccgccctgacccccggcctggacgaggtgaagagcagcctgagcgccagcaccaaccccgagctgggcagcaacgtgagcggcacccagacctaccccgtggtgaccggcagagacatggccagcaccaccctgcccggctaccccccccacgtgccccccaccggccagggcagctaccccaccagcaccctggccggcatggtgcccgaggccgccgtgggccccagcagcagcctgatgagcaagcccggcagaaagctggccgaggtgcccccctgcgtgcagcccaccggcgccagcagccccgccaccagaaccgccacccccagcaccagacccaccaccagactgggcgacagcgccacccccccctactag

SEQ ID NO: 92273 - DNA, 990 bp, Artificial Sequence
  Description of Artificial Sequence: Synthetic coding sequence
atgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggtggaggtgtacaccgaccccgcccacatcagaggcggcggcggcctgcacctggtgtggaccctgagagacgtgagcgagggcagcgtgcccaacggcgacagccagagcggcgtggacagcctgagaaagcacctgagagccgacaccttcacccagcagcagctggaggccctggacagagtgttcgagagacccagctaccccgacgtgttccaggccagcgagcacatcaagagcgagcagggcaacgagtacagcctgcccgccctgacccccggcctggacgaggtgaagagcagcctgagcgccagcaccaaccccgagctgggcagcaacgtgagcggcacccagacctaccccgtggtgaccggcagagacatggccagcaccaccctgcccggctaccccccccacgtgccccccaccggccagggcagctaccccaccagcaccctggccggcatggtgcccggcagcgagttcagcggcaacccctacagccacccccagtacaccgcctacaacgaggcctggagattcagcaaccccgccctgctgagcagcccctactactacagcgccgcccccagaggcagcctgcccctgctgcccctgcccatgaccgccaccagctacagaggcgaccacatcaagctgcaggccgacagcttcggcctgcacatcgtgcccgtgtag

SEQ ID NO: 92274 - DNA, 1260 bp, Artificial Sequence
  Description of Artificial Sequence: Synthetic coding sequence
atggacatgcactgcaaggccgaccccttcagcgccatgcaccccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggacaagatcgccgagtacaagagacagaaccccaccatgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggtggaggtgtacaccgaccccgcccacatcagaggcggcggcggcctgcacctggtgtggaccctgagagacgtgagcgagggcagcgtgcccaacggcgacagccagagcggcgtggacagcctgagaaagcacctgagagccgacaccttcacccagcagcagctggaggccctggacagagtgttcgagagacccagctaccccgacgtgttccaggccagcgagcacatcaagagcgagcagggcaacgagtacagcctgcccgccctgacccccggcctggacgaggtgaagagcagcctgagcgccagcaccaaccccgagctgggcagcaacgtgagcggcacccagacctaccccgtggtgaccggcagagacatggccagcaccaccctgcccggctaccccccccacgtgccccccaccggccagggcagctaccccaccagcaccctggccggcatggtgcccgaggccgccgtgggccccagcagcagcctgatgagcaagcccggcagaaagctggccgaggtgcccccctgcgtgcagcccaccggcgccagcagccccgccaccagaaccgccacccccagcaccagacccaccaccagactgggcgacagcgccacccccccctactag

SEQ ID NO: 92275 - DNA, 645 bp, Artificial Sequence
  Description of Artificial Sequence: Synthetic coding sequence
atggacatgcactgcaaggccgaccccttcagcgccatgcaccccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggacaagatcgccgagtacaagagacagaaccccaccatgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggtggaggtgtacaccgaccccgcccactag

SEQ ID NO: 92276 - DNA, 1254 bp, Artificial Sequence
  Description of Artificial Sequence: Synthetic coding sequence
atggacatgcactgcaaggccgaccccttcagcgccatgcaccccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggacaagatcgccgagtacaagagacagaaccccaccatgttcgcctgggagatcagagacagactgctggccgagggcatctgcgacaacgacaccgtgcccagcgtgagcagcatcaacagaatcatcagaaccaaggtgcagcagcccttccaccccacccccgacggcgccggcaccggcgtgaccgcccccggccacaccatcgtgcccagcaccgccagcccccccgtgagcagcgccagcaacgaccccgtgggcagctacagcatcaacggcatcctgggcatccccagaagcaacggcgagaagagaaagagagacgaggtggaggtgtacaccgaccccgcccacatcagaggcggcggcggcctgcacctggtgtggaccctgagagacgtgagcgagggcagcgtgcccaacggcgacagccagagcggcgtggacagcctgagaaagcacctgagagccgacaccttcacccagcagcagctggaggccctggacagagtgttcgagagacccagctaccccgacgtgttccaggccagcgagcacatcaagagcgagcagggcaacgagtacagcctgcccgccctgacccccggcctggacgaggtgaagagcagcctgagcgccagcaccaaccccgagctgggcagcaacgtgagcggcacccagacctaccccgtggtgaccggcagagacatggccagcaccaccctgcccggctaccccccccacgtgccccccaccggccagggcagctaccccaccagcaccctggccggcatggtgcccggcagcgagttcagcggcaacccctacagccacccccagtacaccgcctacaacgaggcctggagattcagcaaccccgccctgctgagcagcccctactactacagcgccgcccccagaggcagcgcccccgccgccgccgccgccgcctacgacagacactag

SEQ ID NO: 92277 - DNA, 621 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagaggcaaggccctggtgagcggcgtgagcagccactag

SEQ ID NO: 92278 - DNA, 1224 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgcccttcatcatcagcagccagatcagcctgggcttcaagagcttctag

SEQ ID NO: 92279 - DNA, 1212 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgcccttcatcatcagcagccagatcagcagaaagtag

SEQ ID NO: 92280 - DNA, 1440 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgatgggcctgctgaccaaccacggcggcgtgccccaccagccccagaccgactacgccctgagccccctgaccggcggcctggagcccaccaccaccgtgagcgccagctgcagccagagactggaccacatgaagagcctggacagcctgcccaccagccagagctactgcccccccacctacagcaccaccggctacagcatggaccccgtgaccggctaccagtacggccagtacggccagagcaagccctggaccttctag

SEQ ID NO: 92281 - DNA, 1518 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgatgggcctgctgaccaaccacggcggcgtgccccaccagccccagaccgactacgccctgagccccctgaccggcggcctggagcccaccaccaccgtgagcgccagctgcagccagagactggaccacatgaagagcctggacagcctgcccaccagccagagctactgcccccccacctacagcaccaccggctacagcatggaccccgtgaccggctaccagtacggccagtacggccagagcgccttccactacctgaagcccgacatcgcctggttccagatcctgctgaacaccttcgacaagagcagcggcgaggaggaggacctggagcagtag

SEQ ID NO: 92282 - DNA, 1455 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgatgggcctgctgaccaaccacggcggcgtgccccaccagccccagaccgactacgccctgagccccctgaccggcggcctggagcccaccaccaccgtgagcgccagctgcagccagagactggaccacatgaagagcctggacagcctgcccaccagccagagctactgcccccccacctacagcaccaccggctacagcatggaccccgtgaccggctaccagtacggccagtacggccagagcgccttccactacctgaagcccgacatcgcctag

SEQ ID NO: 92283 - DNA, 1452 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagagccagcgccccccagagcgacgagggcagcgacatcgacagcgagcccgacctgcccctgaagagaaagcagagaagaagcagaaccaccttcaccgccgagcagctggaggagctggagagagccttcgagagaacccactaccccgacatctacaccagagaggagctggcccagagagccaagctgaccgaggccagagtgcaggtgtggttcagcaacagaagagccagatggagaaagcaggccggcgccaaccagctgatggccttcaaccacctgatccccggcggcttcccccccaccgccatgcccaccctgcccacctaccagctgagcgagaccagctaccagcccaccagcatcccccaggccgtgagcgaccccagcagcaccgtgcacagaccccagcccctgccccccagcaccgtgcaccagagcaccatccccagcaaccccgacagcagcagcgcctactgcctgcccagcaccagacacggcttcagcagctacaccgacagcttcgtgccccccagcggccccagcaaccccatgaaccccaccatcggcaacggcctgagcccccaggtgatgggcctgctgaccaaccacggcggcgtgccccaccagccccagaccgactacgccctgagccccctgaccggcggcctggagcccaccaccaccgtgagcgccagctgcagccagagactggaccacatgaagagcctggacagcctgcccaccagccagagctactgcccccccacctacagcaccaccggctacagcatggaccccgtgaccggctaccagtacggccagtacggccagagcgccttccactacctgaagcccgacatcgcctag

SEQ ID NO: 92284 - DNA, 648 bp, Artificial Sequence
  Description of Artificial Sequence: Synthetic coding sequence
atgaccaccctggccggcgccgtgcccagaatgatgagacccggccccggccagaactaccccagaagcggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccaagcaggtgaccacccccgacgtggagaagaagatcgaggagtacaagagagagaaccccggcatgttcagctgggagatcagagacaagctgctgaaggacgccgtgtgcgacagaaacaccgtgcccagcgtgagcagcatcagcagaatcctgagaagcaagttcggcaagggcgaggaggaggaggccgacctggagagaaaggaggccgaggagagcgagaagaaggccaagcacagcatcgacggcatcctgagcgagagaggcaagagatggagactgggcagaagaacctgctgggtgacctggagagccagcgccagctag

SEQ ID NO: 92285 - DNA, 822 bp, Artificial Sequence
  Description of Artificial Sequence: Synthetic coding sequence
atgcaccaggacggcatcagcagcatgaaccagctgggcggcctgttcgtgaacggcagacccctgcccctggacaccagacagcagatcgtgagactggccgtgagcggcatgagaccctgcgacatcagcagaatcctgaaggtgagcaacggctgcgtgagcaagatcctgggcagatactacagaaccggcgtgctggagcccaagggcatcggcggcagcaagcccagactggccaccccccccgtggtggccagaatcgcccagctgaagggcgagtgccccgccctgttcgcctgggagatccagagacagctgtgcgccgagggcctgtgcacccaggacaagacccccagcgtgagcagcatcaacagagtgctgagagccctgcaggaggaccagggcctgccctgcaccagactgagaagccccgccgtgctggcccccgccgtgctgaccccccacagcggcagcgagacccccagaggcacccaccccggcaccggccacagaaacagaaccatcttcagccccagccaggccgaggccctggagaaggagttccagagaggccagtaccccgacagcgtggccagaggcaagctggccaccgccaccagcctgcccgaggacaccgtgagagtgtggttcagcaacagaagagccaagtggagaagacaggagaagctgaagtgggagatgcagctgcccgccgtgccctggcagtgcgcccacagcagccccgcctgccccggcaccaccggcagcctgctgctgagcgccgtgctgggcaacagcaccagaaaggtgagcgagtag

SEQ ID NO: 92286 - DNA, 1032 bp, Artificial Sequence
  Description of Artificial Sequence: Synthetic coding sequence
atgaaccagctgggcggcctgttcgtgaacggcagacccctgcccctggacaccagacagcagatcgtgagactggccgtgagcggcatgagaccctgcgacatcagcagaatcctgaaggtgagcaacggctgcgtgagcaagatcctgggcagatactacagaaccggcgtgctggagcccaagggcatcggcggcagcaagcccagactggccaccccccccgtggtggccagaatcgcccagctgaagggcgagtgccccgccctgttcgcctgggagatccagagacagctgtgcgccgagggcctgtgcacccaggacaagacccccagcgtgagcagcatcaacagagtgctgagagccctgcaggaggaccagggcctgccctgcaccagactgagaagccccgccgtgctggcccccgccgtgctgaccccccacagcggcagcgagacccccagaggcacccaccccggcaccggccacagaaacagaaccatcttcagccccagccaggccgaggccctggagaaggagttccagagaggccagtaccccgacagcgtggccagaggcaagctggccaccgccaccagcctgcccgaggacaccgtgagagtgtggttcagcaacagaagagccaagtggagaagacaggagaagctgaagtgggagatgcagctgcccggcgccagccagggcctgaccgtgcccagagtggcccccggcatcatcagcgcccagcagagccccggcagcgtgcccaccgccgccctgcccgccctggagcccctgggccccagctgctaccagctgtgctgggccaccgcccccgagagatgcctgagcgacaccccccccaaggcctgcctgaagccctgctggggccacctgcccccccagcccaacagcctggacagcggcctgctgtgcctgccctgccccagcagccactgccacctggccagcctgagcggcagccaggccctgctgtggcccggctgccccctgctgtacggcctggagtag

SEQ ID NO: 92287 - DNA, 1047 bp, Artificial Sequence
  Description of Artificial Sequence: Synthetic coding sequence
atgcaccaggacggcatcagcagcatgaaccagctgggcggcctgttcgtgaacggcagacccctgcccctggacaccagacagcagatcgtgagactggccgtgagcggcatgagaccctgcgacatcagcagaatcctgaaggtgagcaacggctgcgtgagcaagatcctgggcagatactacagaaccggcgtgctggagcccaagggcatcggcggcagcaagcccagactggccaccccccccgtggtggccagaatcgcccagctgaagggcgagtgccccgccctgttcgcctgggagatccagagacagctgtgcgccgagggcctgtgcacccaggacaagacccccagcgtgagcagcatcaacagagtgctgagagccctgcaggaggaccagggcctgccctgcaccagactgagaagccccgccgtgctggcccccgccgtgctgaccccccacagcggcagcgagacccccagaggcacccaccccggcaccggccacagaaacagaaccatcttcagccccagccaggccgaggccctggagaaggagttccagagaggccagtaccccgacagcgtggccagaggcaagctggccaccgccaccagcctgcccgaggacaccgtgagagtgtggttcagcaacagaagagccaagtggagaagacaggagaagctgaagtgggagatgcagctgcccggcgccagccagggcctgaccgtgcccagagtggcccccggcatcatcagcgcccagcagagccccggcagcgtgcccaccgccgccctgcccgccctggagcccctgggccccagctgctaccagctgtgctgggccaccgcccccgagagatgcctgagcgacaccccccccaaggcctgcctgaagccctgctgggactgcggcagcttcctgctgcccgtgatcgcccccagctgcgtggacgtggcctggccctgcctggacgccagcctggcccaccacctgatcggcggcgccggcaaggccacccccacccacttcagccactag

SEQ ID NO: 92288 - DNA, 1563 bp, Artificial Sequence
  Description of Artificial Sequence: Synthetic coding sequence
atggccgccctgcccggcaccgtgcccagaatgatgagacccgcccccggccagaactaccccagaaccggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccagacaggtggccacccccgacgtggagaagaagatcgaggagtacaagagagagaaccccggcatgttcagctgggagatcagagacagactgctgaaggacggccactgcgacagaagcaccgtgcccagcggcctggtgagcagcatcagcagagtgctgagaatcaagttcggcaagaaggaggaggaggacgaggccgacaagaaggaggacgacggcgagaagaaggccaagcacagcatcgacggcatcctgggcgacaagggcaacagactggacgagggcagcgacgtggagagcgagcccgacctgcccctgaagagaaagcagagaagaagcagaaccaccttcaccgccgagcagctggaggagctggagaaggccttcgagagaacccactaccccgacatctacaccagagaggagctggcccagagaaccaagctgaccgaggccagagtgcaggtgtggttcagcaacagaagagccagatggagaaagcaggccggcgccaaccagctggccgccttcaaccacctgctgcccggcggcttcccccccaccggcatgcccaccctgcccccctaccagctgcccgacagcacctaccccaccaccaccatcagccaggacggcggcagcaccgtgcacagaccccagcccctgccccccagcaccatgcaccagggcggcctggccgccgccgccgccgccgccgacaccagcagcgcctacggcgccagacacagcttcagcagctacagcgacagcttcatgaaccccgccgcccccagcaaccacatgaaccccgtgagcaacggcctgagcccccaggtgatgagcatcctgggcaaccccagcgccgtgcccccccagccccaggccgacttcagcatcagccccctgcacggcggcctggacagcgccaccagcatcagcgccagctgcagccagagagccgacagcatcaagcccggcgacagcctgcccaccagccaggcctactgcccccccacctacagcaccaccggctacagcgtggaccccgtggccggctaccagtacggccagtacggccagagcgagtgcctggtgccctgggccagccccgtgcccatccccagccccacccccagagccagctgcctgttcatggagagctacaaggtggtgagcggctggggcatgagcatcagccagatggagaagctgaagagcagccagatggagcagttcacctag

SEQ ID NO: 92289 - DNA, 1557 bp, Artificial Sequence
  Description of Artificial Sequence: Synthetic coding sequence
atggccgccctgcccggcaccgtgcccagaatgatgagacccgcccccggccagaactaccccagaaccggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccagacaggtggccacccccgacgtggagaagaagatcgaggagtacaagagagagaaccccggcatgttcagctgggagatcagagacagactgctgaaggacggccactgcgacagaagcaccgtgcccagcgtgagcagcatcagcagagtgctgagaatcaagttcggcaagaaggaggaggaggacgaggccgacaagaaggaggacgacggcgagaagaaggccaagcacagcatcgacggcatcctgggcgacaagggcaacagactggacgagggcagcgacgtggagagcgagcccgacctgcccctgaagagaaagcagagaagaagcagaaccaccttcaccgccgagcagctggaggagctggagaaggccttcgagagaacccactaccccgacatctacaccagagaggagctggcccagagaaccaagctgaccgaggccagagtgcaggtgtggttcagcaacagaagagccagatggagaaagcaggccggcgccaaccagctggccgccttcaaccacctgctgcccggcggcttcccccccaccggcatgcccaccctgcccccctaccagctgcccgacagcacctaccccaccaccaccatcagccaggacggcggcagcaccgtgcacagaccccagcccctgccccccagcaccatgcaccagggcggcctggccgccgccgccgccgccgccgacaccagcagcgcctacggcgccagacacagcttcagcagctacagcgacagcttcatgaaccccgccgcccccagcaaccacatgaaccccgtgagcaacggcctgagcccccaggtgatgagcatcctgggcaaccccagcgccgtgcccccccagccccaggccgacttcagcatcagccccctgcacggcggcctggacagcgccaccagcatcagcgccagctgcagccagagagccgacagcatcaagcccggcgacagcctgcccaccagccaggcctactgcccccccacctacagcaccaccggctacagcgtggaccccgtggccggctaccagtacggccagtacggccagagcgagtgcctggtgccctgggccagccccgtgcccatccccagccccacccccagagccagctgcctgttcatggagagctacaaggtggtgagcggctggggcatgagcatcagccagatggagaagctgaagagcagccagatggagcagttcacctag

SEQ ID NO: 92290 - DNA, 1518 bp, Artificial Sequence
  Description of Artificial Sequence: Synthetic coding sequence
atggccgccctgcccggcaccgtgcccagaatgatgagacccgcccccggccagaactaccccagaaccggcttccccctggaggtgagcacccccctgggccagggcagagtgaaccagctgggcggcgtgttcatcaacggcagacccctgcccaaccacatcagacacaagatcgtggagatggcccaccacggcatcagaccctgcgtgatcagcagacagctgagagtgagccacggctgcgtgagcaagatcctgtgcagataccaggagaccggcagcatcagacccggcgccatcggcggcagcaagcccagacaggtggccacccccgacgtggagaagaagatcgaggagtacaagagagagaaccccggcatgttcagctgggagatcagagacagactgctgaaggacggccactgcgacagaagcaccgtgcccagcggcctggtgagcagcatcagcagagtgctgagaatcaagttcggcaagaaggaggaggaggacgaggccgacaagaaggaggacgacggcgagaagaaggccaagcacagcatcgacggcatcctgggcgacaagggcaacagactggacgagggcagcgacgtggagagcgagcccgacctgcccctgaagagaaagcagagaagaagcagaaccaccttcaccgccgagcagctggaggagctggagaaggccttcgagagaacccactaccccgacatctacaccagagaggagctggcccagagaaccaagctgaccgaggccagagtgcaggtgtggttcagcaacagaagagccagatggagaaagcaggccggcgccaaccagctggccgccttcaaccacctgctgcccggcggcttcccccccaccggcatgcccaccctgcccccctaccagctgcccgacagcacctaccccaccaccaccatcagccaggacggcggcagcaccgtgcacagaccccagcccctgccccccagcaccatgcaccagggcggcctggccgccgccgccgccgccgccgacaccagcagcgcctacggcgccagacacagcttcagcagctacagcgacagcttcatgaaccccgccgcccccagcaaccacatgaaccccgtgagcaacggcctgagcccccaggtgatgagcatcctgggcaaccccagcgccgtgcccccccagccccaggccgacttcagcatcagccccctgcacggcggcctggacagcgccaccagcatcagcgccagctgcagccagagagccgacagcatcaagcccggcgacagcctgcccaccagccaggcctactgcccccccacctacagcaccaccggctacagcgtggaccccgtggccggctaccagtacggccagtacggccagaccgccgtggactacctggccaagaacgtgagcctgagcacccagagaagaatgaagctgggcgagcacagcgccgtgctgggcctgctgcccgtggagaccggccaggcctactag

SEQ ID NO: 92291 - DNA, 1026 bp, Artificial Sequence
  Description of Artificial Sequence: Synthetic coding sequence
atggagcccgccttcggcgaggtgaaccagctgggcggcgtgttcgtgaacggcagacccctgcccaacgccatcagactgagaatcgtggagctggcccagctgggcatcagaccctgcgacatcagcagacagctgagagtgagccacggctgcgtgagcaagatcctggccagatacaacgagaccggcagcatcctgcccggcgccatcggcggcagcaagcccagagtgaccacccccaccgtggtgaagcacatcagaacctacaagcagagagaccccggcatcttcgcctgggagatcagagacagactgctggccgacggcgtgtgcgacaagtacaacgtgcccagcgtgagcagcatcagcagaatcctgagaaacaagatcggcaacctggcccagcagggccactacgacagctacaagcagcaccagcccaccccccagcccgccctgccctacaaccacatctacagctaccccagccccatcaccgccgccgccgccaaggtgcccaccccccccggcgtgcccgccatccccggcagcgtggccatgcccagaacctggcccagcagccacagcgtgaccgacatcctgggcatcagaagcatcaccgaccaggtgagcgacagcagcccctaccacagccccaaggtggaggagtggagcagcctgggcagaaacaacttccccgccgccgccccccacgccgtgaacggcctggagaagggcgccctggagcaggaggccaagtacggccaggcccccaacggcctgcccgccgtgggcagcttcgtgagcgccagcagcatggccccctaccccacccccgcccaggtgagcccctacatgacctacagcgccgcccccagcggctacgtggccggccacggctggcagcacgccggcggcaccagcctgagcccccacaactgcgacatccccgccagcctggccttcaagggcatgcaggccgccagagagggcagccacagcgtgaccgccagcgccctgtag

SEQ ID NO: 92292 - DNA, 1026 bp, Artificial Sequence; identical to SEQ ID NO: 92291
  Description of Artificial Sequence: Synthetic coding sequence

SEQ ID NO: 92293 - DNA, 183 bp, Artificial Sequence
  Description of Artificial Sequence: Synthetic coding sequence
agcgacagcagcccctaccacagccccaaggtggaggagtggagcagcctgggcagaaacaacttccccgccgccgccccccacgccgtgaacggcctggagaagggcgccctggagcaggaggccaagtacggccagatccagaacttcttcctgctgatgatcagcagactgaagttctag

SEQ ID NO: 92294 - DNA, 912 bp, Artificial Sequence
  Description of Artificial Sequence: Synthetic coding sequence
atgggcagacccctgctgctgcccctgctgcccctgctgctgccccccgccttcctgcagcccagcggcagcaccggcagcggccccagctacctgtacggcgtgacccagcccaagcacctgagcgccagcatgggcggcagcgtggagatccccttcagcttctactacccctgggagctggccaccgcccccgacgtgagaatcagctggagaagaggccacttccacagacagagcttctacagcaccagaccccccagcatccacaaggactacgtgaacagactgttcctgaactggaccgagggccagaagagcggcttcctgagaatcagcaacctgcagaagcaggaccagagcgtgtacttctgcagagtggagctggacaccagaagcagcggcagacagcagtggcagagcatcgagggcaccaagctgagcatcacccaggccgtgaccaccaccacccagagacccagcagcatgaccaccacctggagactgagcagcaccaccaccaccaccggcctgagagtgacccagggcaagagaagaagcgacagctggcacatcagcctggagaccgccgtgggcgtggccgtggccgtgaccgtgctgggcatcatgatcctgggcctgatctgcctgctgagatggagaagaagaaagggccagcagagaaccaaggccaccacccccgccagagagcccttccagaacaccgaggagccctacgagaacatcagaaacgagggccagaacaccgaccccaagctgaaccccaaggacgacggcatcgtgtacgccagcctggccctgagcagcagcaccagccccagagccccccccagccacagacccctgaagagcccccagaacgagaccctgtacagcgtgctgaaggcctag

SEQ ID NO: 92295 - DNA, 693 bp, Artificial Sequence
  Description of Artificial Sequence: Synthetic coding sequence
atgggcagacccctgctgctgcccctgctgcccctgctgctgccccccgccttcctgcagcccagcggcagcaccggcagcggccccagctacctgtacggcgtgacccagcccaagcacctgagcgccagcatgggcggcagcgtggagatccccttcagcttctactacccctgggagctggccaccgcccccgacgtgagaatcagctggagaagaggccacttccacagacagagcttctacagcaccagaccccccagcatccacaaggactacgtgaacagactgttcctgaactggaccgagggccagaagagcggcttcctgagaatcagcaacctgcagaagcaggaccagagcgtgtacttctgcagagtggagctggacaccagaagcagcggcagacagcagtggcagagcatcgagggcaccaagctgagcatcacccagggccagcagagaaccaaggccaccacccccgccagagagcccttccagaacaccgaggagccctacgagaacatcagaaacgagggccagaacaccgaccccaagctgaaccccaaggacgacggcatcgtgtacgccagcctggccctgagcagcagcaccagccccagagccccccccagccacagacccctgaagagcccccagaacgagaccctgtacagcgtgctgaaggcctag

SEQ ID NO: 92296 - DNA, 528 bp, Artificial Sequence
  Description of Artificial Sequence: Synthetic coding sequence
atgggcagacccctgctgctgcccctgctgcccctgctgctgccccccgccttcctgcagcccagcggcagcaccggcagcggccccagctacctgtacggcgtgacccagcccaagcacctgagcgccagcatgggcggcagcgtggagatccccttcagcttctactacccctgggagctggccaccgcccccgacgtgagaatcagctggagaagaggccacttccacagacagagcttctacagcaccagaccccccagcatccacaaggactacgtgaacagactgttcctgaactggaccgagggccagaagagcggcttcctgagaatcagcaacctgcagaagcaggaccagagcgtgtacttctgcagagtggagctggacaccagaagcagcggcagacagcagtggcagagcatcgagggcaccaagctgagcatcacccagggcaaccccagcaagacccagagaagccacatgagaatcagcggcatgaaggacaagatccagatccccagctag

SEQ ID NO: 92297 - DNA, 492 bp, Artificial Sequence
  Description of Artificial Sequence: Synthetic coding sequence
atgggcagacccctgctgctgcccctgctgcccctgctgctgccccccgccttcctgcagcccagcggcagcaccggcagcggccccagctacctgtacggcgtgacccagcccaagcacctgagcgccagcatgggcggcagcgtggagatccccttcagcttctactacccctgggagctggccaccgcccccgacgtgagaatcagctggagaagaggccacttccacagacagagcttctacagcaccagaccccccagcatccacaaggactacgtgaacagactgttcctgaactggaccgagggccagaagagcggcttcctgagaatcagcaacctgcagaagcaggaccagagcgtgtacttctgcagagtggagctggacaccagaagcagcggcagacagcagtggcagagcatcgagggcaccaagctgagcatcacccagggccagcagagaaccaaggccaccacccccgccagatag

SEQ ID NO: 92298 - DNA, 684 bp, Artificial Sequence
  Description of Artificial Sequence: Synthetic coding sequence
atgggcagacccctgctgctgcccctgctgctgctgctgcagccccccgccttcctgcagcccggcggcagcaccggcagcggccccagctacctgtacggcgtgacccagcccaagcacctgagcgccagcatgggcggcagcgtggagatccccttcagcttctactacccctgggagctggccatcgtgcccaacgtgagaatcagctggagaagaggccacttccacggccagagcttctacagcaccagaccccccagcatccacaaggactacgtgaacagactgttcctgaactggaccgagggccaggagagcggcttcctgagaatcagcaacctgagaaaggaggaccagagcgtgtacttctgcagagtggagctggacaccagaagaagcggcagacagcagctgcagagcatcaagggcaccaagctgaccatcacccaggccgtgaccaccaccaccacctggagacccagcagcaccaccaccatcgccggcctgagagtgaccgagagcaagggccacagcgagagctggcacctgagcctggacaccgccatcagagtggccctggccgtggccgtgctgaagaccgtgatcctgggcctgctgtgcctgctgctgctgtggtggagaagaagaaagggcagcagagcccccagcagcgacttctag

SEQ ID NO: 92299 - DNA, 999 bp, Artificial Sequence
  Description of Artificial Sequence: Synthetic coding sequence
atgggcagagccagctacggcggcagccccgtgggccaccagagcagcagcgaccaccccagagccaagacctgcagaagccccgtgagagacggccccagaaccctgtgcggcgtgcccaccgtggccctgagcctgcacttcctgagagaggccagcagcggcagcagaacctgcggcagaagaaccagcctgtgcaccagcgccaagagcagctggacctacagaagcgccctgagacagcccctgcacagagcccccctgctgcccggccagctgtgctggagccccagacccctggagaagaacaaggccatgggcagacccctgctgctgcccctgctgctgctgctgcagccccccgccttcctgcagcccggcggcagcaccggcagcggccccagctacctgtacggcgtgacccagcccaagcacctgagcgccagcatgggcggcagcgtggagatccccttcagcttctactacccctgggagctggccatcgtgcccaacgtgagaatcagctggagaagaggccacttccacggccagagcttctacagcaccagaccccccagcatccacaaggactacgtgaacagactgttcctgaactggaccgagggccaggagagcggcttcctgagaatcagcaacctgagaaaggaggaccagagcgtgtacttctgcagagtggagctggacaccagaagaagcggcagacagcagctgcagagcatcaagggcaccaagctgaccatcacccaggccgtgaccaccaccaccacctggagacccagcagcaccaccaccatcgccggcctgagagtgaccgagagcaagggccacagcgagagctggcacctgagcctggacaccgccatcagagtggccctggccgtggccgtgctgaagaccgtgatcctgggcctgctgtgcctgctgctgctgtggtggagaagaagaaagggcagcagagcccccagcagcgacttctag

SEQ ID NO: 92300 - DNA, 384 bp, Artificial Sequence
  Description of Artificial Sequence: Synthetic coding sequence
atgggcagacccctgctgctgcccctgctgctgctgctgcagccccccgccttcctgcagcccggcggcagcaccggcagcggccccagctacctgtacggcgtgacccagcccaagcacctgagcgccagcatgggcggcagcgtggagatccccttcagcttctactacccctgggagctggccatcgtgcccaacgtgagaatcagctggagaagaggccacttccacggccagagcttctacagcaccagaccccccagcatccacaaggactacgtgaacagactgttcctgaactggaccgagggccaggagagcggcttcctgagaatcagcaacctgagaaaggaggaccagagcgtgtacttctgcagagtgtag

SEQ ID NO: 92301 - DNA, 684 bp, Artificial Sequence; identical to SEQ ID NO: 92298
  Description of Artificial Sequence: Synthetic coding sequence

SEQ ID NO: 92302 - DNA, 384 bp, Artificial Sequence; identical to SEQ ID NO: 92300
  Description of Artificial Sequence: Synthetic coding sequence

SEQ ID NO: 92303 - DNA, 183 bp, Artificial Sequence
  Description of Artificial Sequence: Synthetic coding sequence
atgggcagacccctgctgctgcccctgctgctgctgctgcagccccccgccttcctgcagcccggcctgtgcgagcccgccctgagcgagctggacagaggcagcggcgagagactgccccaggacctgaagcccgccgagggcggccccgtgtgcgtgttcctgcccagcagagccggctag

SEQ ID NO: 92304 - DNA, 366 bp, Artificial Sequence
  Description of Artificial Sequence: Synthetic coding sequence
atgggcagacccctgctgctgcccctgctgctgctgctgcagccccccgccttcctgcagcccggcggcagcaccggcagcggccccagctacctgtacggcgtgacccagcccaagcacctgagcgccagcatgggcggcagcgtggagatccccttcagcttctactacccctgggagctggccatcgtgcccaacgtgagaatcagctggagaagaggccacttccacggccagagcttctacagcaccagaccccccagcatccacaaggactacgtgaacagactgttcctgaactggaccgagggccaggagagcggcttcctgagaatcagcaacctgagaaaggaggaccagagctag

SEQ ID NO: 92305 - DNA, 384 bp, Artificial Sequence; identical to SEQ ID NO: 92300
  Description of Artificial Sequence: Synthetic coding sequence

SEQ ID NO: 92306 - DNA, 684 bp, Artificial Sequence; identical to SEQ ID NO: 92298
  Description of Artificial Sequence: Synthetic coding sequence

SEQ ID NO: 92307 - DNA, 450 bp, Artificial Sequence
  Description of Artificial Sequence: Synthetic coding sequence
atgggcagacccctgctgctgcccctgctgctgctgctgcagccccccgccttcctgcagcccggcctgtgcgagcccgccctgagcgagctggacagaggcagcggcgagagactgccccaggacctgaagcccgccgagggcggccccgtgtgcgtgttcctgcccagcagagccggccaccccgagatcagagaggccgccgtggccgtgcaccagggcgaccagacccaccaccaccccggctgccacaaccaccaccacctggaggcccagcagcacaaccaccacagcagaccccagggccacagaaagcagagagccctgagaatcatggcccccaagagcggccactgccaccagggctgcatcggctgcagatgcgcccagaactgccacttcggcaccgccgtgccccccccccccgtggtggaggagaaggagagatag

SEQ ID NO: 92308 - DNA, 816 bp, Artificial Sequence
  Description of Artificial Sequence: Synthetic coding sequence
atgggcagagccagctacggcggcagccccgtgggccaccagagcagcagcgaccaccccagagccaagacctgcagaagccccgtgagagacggccccagaaccctgtgcggcgtgcccaccgtggccctgagcctgcacttcctgagagaggccagcagcggcagcagaacctgcggcagaagaaccagcctgtgcaccagcgccaagagcagctggacctacagaagcggcagactgagctggcagagcatcaagggcacccacctgaccatcacccaggccctgagacagcccctgcacagagcccccctgctgcccggccagctgtgctggagccccagacccctggagaagaacaaggccatgggcagacccctgctgctgcccctgctgctgctgctgcagccccccgccttcctgcagcccggcctgtgcgagcccgccctgagcgagctggacagaggcagcggcgagagactgccccaggacctgaagcccgccgagggcggccccgtgtgcgtgttcctgcccagcagagccggccaccccgagatcagagaggccgccgtggccgtgcaccagggcgaccagacccaccaccaccccggctgccacaaccaccaccacctggaggcccagcagcacaaccaccacagcagaccccagggccacagaaagcagagagccctgagaatcatggcccccaagagcggccactgccaccagggctgcatcggctgcagatgcgcccagaactgccacttcggcaccgccgtgccccccccccccgtggtggaggagaaggagagatag

SEQ ID NO: 92309 - DNA, 684 bp, Artificial Sequence; identical to SEQ ID NO: 92298
  Description of Artificial Sequence: Synthetic coding sequence

SEQ ID NO: 92310 - DNA, 327 bp, Artificial Sequence
  Description of Artificial Sequence: Synthetic coding sequence
atgggcagagccagctacggcggcagccccgtgggccaccagagcagcagcgaccaccccagagccaagacctgcagaagccccgtgagagacggccccagaaccctgtgcggcgtgcccaccgtggccctgagcctgcacttcctgagagaggccagcagcggcagcagaacctgcggcagaagaaccagcctgtgcaccagcgccaagagcagctggacctacagaagcggcagactgagctggcagagcatcaagggcacccacctgaccatcacccaggccctgagacagcccctgcacagagcccccctgctgcccggctag

SEQ ID NO: 92311 - DNA, 384 bp, Artificial Sequence; identical to SEQ ID NO: 92300
  Description of Artificial Sequence: Synthetic coding sequence

SEQ ID NO: 92312 - DNA, 738 bp, Artificial Sequence
  Description of Artificial Sequence: Synthetic coding sequence
atgaccagcagctacggccacgtgctggagagacagcccgccctgggcggcagactggacagccccggcaacctggacaccctgcaggccaagaagaacttcagcgtgagccacctgctggacctggaggaggccggcgacatggtggccgcccaggccgacgagaacgtgggcgaggccggcagaagcctgctggagagccccggcctgaccagcggcagcgacaccccccagcaggacaacgaccagctgaacagcgaggagaagaagaagagaaagcagagaagaaacagaaccaccttcaacagcagccagctgcaggccctggagagagtgttcgagagaacccactaccccgacgccttcgtgagagaggacctggccagaagagtgaacctgaccgaggccagagtgcaggtgtggttccagaacagaagagccaagttcagaagaaacgagagagccatgctggccaacaagaacgccagcctgctgaagagctacagcggcgacgtgaccgccgtggagcagcccatcgtgcccagacccgcccccagacccaccgactacctgagctggggcaccgccagcccctacagcgccatggccacctacagcgccacctgcgccaacaacagccccgcccagggcatcaacatggccaacagcatcgccaacctgagactgaaggccaaggagtacagcctgcagagaaaccaggtgcccaccgtgaactag

SEQ ID NO: 92313 - DNA, 654 bp, Artificial Sequence
  Description of Artificial Sequence: Synthetic coding sequence
atgaccagcagctacggccacgtgctggagagacagcccgccctgggcggcagactggacagccccggcaacctggacaccctgcaggccaagaagaacttcagcgtgagccacctgctggacctggaggaggccggcgacatggtggccgcccaggccgacgagaacgtgggcgaggccggcagaagcctgctggagagccccggcctgaccagcggcagcgacaccccccagcaggacaacgaccagctgaacagcgaggagaagaagaagagaaagcagagaagaaacagaaccaccttcaacagcagccagctgcaggccctggagagagtgttcgagagaacccactaccccgacgccttcgtgagagaggacctggccagaagagtgaacctgaccgaggccagagtgcaggtgtggttccagaacagaagagccaagttcagaagaaacgagagagccatgctggccaacaagaacgccagcctgctgaagagctacagcggcgacgtgaccgccgtggagcagcccatcgtgcccagacccgcccccagacccaccgactacctgagctggggcaccgccagcccctacagaagcagcagcctgcccagatgctgcctgcacgagggcctgcacaacggcttctag

SEQ ID NO: 92314 - DNA, 762 bp, Artificial Sequence
  Description of Artificial Sequence: Synthetic coding sequence
atggacagcgccgccgccgccttcgccctggacaagcccgccctgggccccggcccccccccccccccccccgccctgggccccggcgactgcgcccaggccagaaagaacttcagcgtgagccacctgctggacctggaggaggtggccgccgccggcagactggccgccagacccggcgccagagccgaggccagagagggcgccgccagagagcccagcggcggcagcagcggcagcgaggccgccccccaggacggcgagtgccccagccccggcagaggcagcgccgccaagagaaagaagaagcagagaagaaacagaaccaccttcaacagcagccagctgcaggccctggagagagtgttcgagagaacccactaccccgacgccttcgtgagagaggagctggccagaagagtgaacctgagcgaggccagagtgcaggtgtggttccagaacagaagagccaagttcagaagaaacgagagagccatgctggccagcagaagcgccagcctgctgaagagctacagccaggaggccgccatcgagcagcccgtggcccccagacccaccgccctgagccccgactacctgagctggaccgccagcagcccctacagcaccgtgcccccctacagccccggcagcagcggccccgccacccccggcgtgaacatggccaacagcatcgccagcctgagactgaaggccaaggagttcagcctgcaccacagccaggtgcccaccgtgaactag

SEQ ID NO: 92315 - DNA, 855 bp, Artificial Sequence
  Description of Artificial Sequence: Synthetic coding sequence
atggactacagctacctgaacagctacgacagctgcgtggccgccatggaggccagcgcctacggcgacttcggcgcctgcagccagcccggcggcttccagtacagccccctgagacccgccttccccgccgccggccccccctgccccgccctgggcagcagcaactgcgccctgggcgccctgagagaccaccagcccgccccctacagcgccgtgccctacaagttcttccccgagcccagcggcctgcacgagaagagaaagcagagaagaatcagaaccaccttcaccagcgcccagctgaaggagctggagagagtgttcgccgagacccactaccccgacatctacaccagagaggagctggccctgaagatcgacctgaccgaggccagagtgcaggtgtggttccagaacagaagagccaagttcagaaagcaggagagagccgccagcgccaagggcgccgccggcgccgccggcgccaagaagggcgaggccagatgcagcagcgaggacgacgacagcaaggagagcacctgcagccccacccccgacagcaccgccagcctgccccccccccccgcccccggcctggccagccccagactgagccccagccccctgcccgtggccctgggcagcggccccggccccggccccggcccccagcccctgaagggcgccctgtgggccggcgtggccggcggcggcggcggcggccccggcgccggcgccgccgagctgctgaaggcctggcagcccgccgagagcggccccggccccttcagcggcgtgctgagcagcttccacagaaagcccggccccgccctgaagaccaacctgttctag

SEQ ID NO: 92316 - DNA, 1800 bp, Artificial Sequence
  Description of Artificial Sequence: Synthetic coding sequence
atgaagctgctgaagctgaccggcttcatcttcttcctgttcttcctgaccgagagcctgaccctgcccacccagcccagagacatcgagaacttcaacagcacccagaagttcatcgaggacaacatcgagtacatcaccatcatcgccttcgcccagtacgtgcaggaggccaccttcgaggagatggagaagctggtgaaggacatggtggagtacaaggacagatgcatggccgacaagaccctgcccgagtgcagcaagctgcccaacaacgtgctgcaggagaagatctgcgccatggagggcctgccccagaagcacaacttcagccactgctgcagcaaggtggacgcccagagaagactgtgcttcttctacaacaagaagagcgacgtgggcttcctgccccccttccccaccctggaccccgaggagaagtgccaggcctacgagagcaacagagagagcctgctgaaccacttcctgtacgaggtggccagaagaaaccccttcgtgttcgcccccaccctgctgaccgtggccgtgcacttcgaggaggtggccaagagctgctgcgaggagcagaacaaggtgaactgcctgcagaccagagccatccccgtgacccagtacctgaaggccttcagcagctaccagaagcacgtgtgcggcgccctgctgaagttcggcaccaaggtggtgcacttcatctacatcgccatcctgagccagaagttccccaagatcgagttcaaggagctgatcagcctggtggaggacgtgagcagcaactacgacggctgctgcgagggcgacgtggtgcagtgcatcagagacaccagcaaggtgatgaaccacatctgcagcaagcaggacagcatcagcagcaagatcaaggagtgctgcgagaagaagatccccgagagaggccagtgcatcatcaacagcaacaaggacgacagacccaaggacctgagcctgagagagggcaagttcaccgacagcgagaacgtgtgccaggagagagacgccgaccccgacaccttcttcgccaagttcaccttcgagtacagcagaagacaccccgacctgagcatccccgagctgctgagaatcgtgcagatctacaaggacctgctgagaaactgctgcaacaccgagaacccccccggctgctacagatacgccgaggacaagttcaacgagaccaccgagaagagcctgaagatggtgcagcaggagtgcaagcacttccagaacctgggcaaggacggcctgaagtaccactacctgatcagactgaccaagatcgccccccagctgagcaccgaggagctggtgagcctgggcgagaagatggtgaccgccttcaccacctgctgcaccctgagcgaggagttcgcctgcgtggacaacctggccgacctggtgttcggcgagctgtgcggcgtgaacgagaacagaaccatcaaccccgccgtggaccactgctgcaagaccaacttcgccttcagaagaccctgcttcgagagcctgaaggccgacaagacctacgtgcccccccccttcagccaggacctgttcaccttccacgccgacatgtgccagagccagaacgaggagctgcagagaaagaccgacagattcctggtgaacctggtgaagctgaagcacgagctgaccgacgaggagctgcagagcctgttcaccaacttcgccaacgtggtggacaagtgctgcaaggccgagagccccgaggtgtgcttcaacgaggagagccccaagatcggcaactag

SEQ ID NO: 92317 - DNA, 945 bp, Artificial Sequence
  Description of Artificial Sequence: Synthetic coding sequence
atggacgccttcaagggcggcatgagcctggagagactgcccgagggcctgagacccccccccccccccccccacgacatgggccccgccttccacctggccagacccgccgaccccagagagcccctggagaacagcgccagcgagagcagcgacaccgagctgcccgagaaggagagaggcggcgagcccaagggccccgaggacagcggcgccggcggcaccggctgcggcggcgccgacgaccccgccaagaagaagaagcagagaagacagagaacccacttcaccagccagcagctgcaggagctggaggccaccttccagagaaacagataccccgacatgagcatgagagaggagatcgccgtgtggaccaacctgaccgagcccagagtgagagtgtggttcaagaacagaagagccaagtggagaaagagagagagaaaccagcagctggacctgtgcaagggcggctacgtgccccagttcagcggcctggtgcagccctacgaggacgtgtacgccgccggctacagctacaacaactgggccgccaagagcctggcccccgcccccctgagcaccaagagcttcaccttcttcaacagcatgagccccctgagcagccagagcatgttcagcgcccccagcagcatcagcagcatgaccatgcccagcagcatgggccccggcgccgtgcccggcatgcccaacagcggcctgaacaacatcaacaacctgaccggcagcagcctgaacagcgccatgagccccggcgcctgcccctacggcacccccgccagcccctacagcgtgtacagagacacctgcaacagcagcctggccagcctgagactgaagagcaagcagcacagcagcttcggctacggcggcctgcagggccccgccagcggcctgaacgcctgccagtacaacagctag

SEQ ID NO: 92318 - DNA, 345 bp, Artificial Sequence
  Description of Artificial Sequence: Synthetic coding sequence
atggacgccttcaagggcggcatgagcctggagagactgcccgagggcctgagacccccccccccccccccccacgacatgggccccgccttccacctggccagacccgccgaccccagagagcccctggagaacagcgccagcgagagcagcgacaccgagctgcccgagaaggagagaggcggcgagcccaagggccccgaggacagcggcgccggcggcaccggctgcggcggcgccgacgaccccgccaagaagaagaagcagagaagacagagaacccacttcaccagccagcagctgcaggagctggaggccaccttccagagaaacagatacccctag

SEQ ID NO: 92319 - DNA, 945 bp, Artificial Sequence; identical to SEQ ID NO: 92317
  Description of Artificial Sequence: Synthetic coding sequence

SEQ ID NO: 92320 - DNA, 396 bp, Artificial Sequence
  Description of Artificial Sequence: Synthetic coding sequence
atggacgccttcaagggcggcatgagcctggagagactgcccgagggcctgagacccccccccccccccccccacgacatgggccccgccttccacctggccagacccgccgaccccagagagcccctggagaacagcgccagcgagagcagcgacaccgagctgcccgagaaggagagaggcggcgagcccaagggccccgaggacagcggcgccggcggcaccggctgcggcggcgccgacgaccccgccaagaagaagaagcagagaagacagagaacccacttcaccagccagcagctgcaggagctggaggccaccttccagagaaacagataccccgacatgagcatgagagaggagatcgccgtgtggaccaacctgaccgagccctag

SEQ ID NO: 92321 - DNA, 975 bp, Artificial Sequence
  Description of Artificial Sequence: Synthetic coding sequence
atgaactgcatgaagggccccctgcacctggagcacagagccgccggcaccaagctgagcgccgtgagcagcagcagctgccaccacccccagcccctggccatggccagcgtgctggcccccggccagcccagaagcctggacagcagcaagcacagactggaggtgcacaccatcagcgacaccagcagccccgaggccgccgagaaggacaagagccagcagggcaagaacgaggacgtgggcgccgaggaccccagcaagaagaagagacagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaaaccagcaggccgagctgtgcaagaacggcttcggcccccagttcaacggcctgatgcagccctacgacgacatgtaccccggctacagctacaacaactgggccgccaagggcctgaccagcgccagcctgagcaccaagagcttccccttcttcaacagcatgaacgtgaaccccctgagcagccagagcatgttcagcccccccaacagcatcagcagcatgagcatgagcagcagcatggtgcccagcgccgtgaccggcgtgcccggcagcagcctgaacagcctgaacaacctgaacaacctgagcagccccagcctgaacagcgccgtgcccacccccgcctgcccctacgccccccccacccccccctacgtgtacagagacacctgcaacagcagcctggccagcctgagactgaaggccaagcagcacagcagcttcggctacgccagcgtgcagaaccccgccagcaacctgagcgcctgccagtacgccgtggacagacccgtgtag

SEQ ID NO: 92322 - DNA, 954 bp, Artificial Sequence
  Description of Artificial Sequence: Synthetic coding sequence
atggagaccaactgcagaaagctggtgagcgcctgcgtgcagctgggcgtgcagcccgccgccgtggagtgcctgttcagcaaggacagcgagatcaagaaggtggagttcaccgacagccccgagagcagaaaggaggccgccagcagcaagttcttccccagacagcaccccggcgccaacgagaaggacaagagccagcagggcaagaacgaggacgtgggcgccgaggaccccagcaagaagaagagacagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaaaccagcaggccgagctgtgcaagaacggcttcggcccccagttcaacggcctgatgcagccctacgacgacatgtaccccggctacagctacaacaactgggccgccaagggcctgaccagcgccagcctgagcaccaagagcttccccttcttcaacagcatgaacgtgaaccccctgagcagccagagcatgttcagcccccccaacagcatcagcagcatgagcatgagcagcagcatggtgcccagcgccgtgaccggcgtgcccggcagcagcctgaacagcctgaacaacctgaacaacctgagcagccccagcctgaacagcgccgtgcccacccccgcctgcccctacgccccccccacccccccctacgtgtacagagacacctgcaacagcagcctggccagcctgagactgaaggccaagcagcacagcagcttcggctacgccagcgtgcagaaccccgccagcaacctgagcgcctgccagtacgccgtggacagacccgtgtag

SEQ ID NO: 92323 - DNA, 816 bp, Artificial Sequence
  Description of Artificial Sequence: Synthetic coding sequence
atggagaccaactgcagaaagctggtgagcgcctgcgtgcagctggagaaggacaagagccagcagggcaagaacgaggacgtgggcgccgaggaccccagcaagaagaagagacagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaaaccagcaggccgagctgtgcaagaacggcttcggcccccagttcaacggcctgatgcagccctacgacgacatgtaccccggctacagctacaacaactgggccgccaagggcctgaccagcgccagcctgagcaccaagagcttccccttcttcaacagcatgaacgtgaaccccctgagcagccagagcatgttcagcccccccaacagcatcagcagcatgagcatgagcagcagcatggtgcccagcgccgtgaccggcgtgcccggcagcagcctgaacagcctgaacaacctgaacaacctgagcagccccagcctgaacagcgccgtgcccacccccgcctgcccctacgccccccccacccccccctacgtgtacagagacacctgcaacagcagcctggccagcctgagactgaaggccaagcagcacagcagcttcggctacgccagcgtgcagaaccccgccagcaacctgagcgcctgccagtacgccgtggacagacccgtgtag

SEQ ID NO: 92324 - DNA, 954 bp, Artificial Sequence; identical to SEQ ID NO: 92322
  Description of Artificial Sequence: Synthetic coding sequence

SEQ ID NO: 92325 - DNA, 873 bp, Artificial Sequence
  Description of Artificial Sequence: Synthetic coding sequence
atggagaccaactgcagaaagctggtgagcgcctgcgtgcagctgggcgtgcagcccgccgccgtggagtgcctgttcagcaaggacagcgagatcaagaaggtggagttcaccgacagccccgagagcagaaaggaggccgccagcagcaagttcttccccagacagcaccccggcgccaacgagaaggacaagagccagcagggcaagaacgaggacgtgggcgccgaggaccccagcaagaagaagagacagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaaaccagcaggccgagctgtgcaagaacggcttcggcccccagttcaacggcctgatgcagccctacgacgacatgtaccccggctacagctacaacaactgggccgccaagggcctgaccagcgccagcctgagcaccaagagcttccccttcttcaacagcatgaacgtgaaccccctgagcagccagagcatgttcagcccccccaacagcatcagcagcatgagcatgagcagcagcatggtgcccagcgccgtgaccggcgtgcccggcagcagcctgaacagcctgaacaacctgaacaacctgagcagccccagcctgaacagcgccgtgcccacccccgcctgcccctacgccccccccacccccccctacgtgtacagagacacctgcaacagcagcctggccagcctgagactgaaggccaagcagtag

SEQ ID NO: 92326 - DNA, 357 bp, Artificial Sequence
  Description of Artificial Sequence: Synthetic coding sequence
atggagaccaactgcagaaagctggtgagcgcctgcgtgcagctggagaaggacaagagccagcagggcaagaacgaggacgtgggcgccgaggaccccagcaagaagaagagacagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaaaccagcaggccgagctgtgcaagaacggcttcggcccccagttcaacggcctgatgtag

SEQ ID NO: 92327 - DNA, 909 bp, Artificial Sequence
  Description of Artificial Sequence: Synthetic coding sequence
atggagttcggcctgctgagcgaggccgaggccagaagccccgccctgagcctgagcgacgccggcaccccccacccccagctgcccgagcacggctgcaagggccaggagcacagcgacagcgagaaggccagcgccagcctgcccggcggcagccccgaggacggcagcctgaagaagaagcagagaagacagagaacccacttcaccagccagcagctgcaggagctggaggccaccttccagagaaacagataccccgacatgagcaccagagaggagatcgccgtgtggaccaacctgaccgaggccagagtgagagtgtggttcaagaacagaagagccaagtggagaaagagagagagaagccagcaggccgagctgtgcaagggcagcttcgccgcccccctgggcggcctggtgcccccctacgaggaggtgtaccccggctacagctacggcaactggccccccaaggccctggccccccccctggccgccaagaccttccccttcgccttcaacagcgtgaacgtgggccccctggccagccagcccgtgttcagcccccccagcagcatcgccgccagcatggtgcccagcgccgccgccgcccccggcaccgtgcccggccccggcgccctgcagggcctgggcggcggcccccccggcctggcccccgccgccgtgagcagcggcgccgtgagctgcccctacgccagcgccgccgccgccgccgccgccgccgccagcagcccctacgtgtacagagacccctgcaacagcagcctggccagcctgagactgaaggccaagcagcacgccagcttcagctaccccgccgtgcacggccccccccccgccgccaacctgagcccctgccagtacgccgtggagagacccgtgtag

SEQ ID NO: 92328 - DNA, 909 bp, Artificial Sequence; identical to SEQ ID NO: 92327
  Description of Artificial Sequence: Synthetic coding sequence

SEQ ID NO: 92329 - DNA, 1179 bp, Artificial Sequence
  Description of Artificial Sequence: Synthetic coding sequence
atggagctggtggccggctgctacgagcaggtgctgttcggcttcgccgtgcaccccgagcccgaggcctgcggcgaccacgagcagtggaccctggtggccgacttcacccaccacgcccacaccgccagcctgagcgccgtggccgtgaacagcagattcgtggtgaccggcagcaaggacgagaccatccacatctacgacatgaagaagaagatcgagcacggcgccctggtgcaccacagcggcaccatcacctgcctgaagttctacggcaacagacacctgatcagcggcgccgaggacggcctgatctgcatctgggacgccaagaagtgggagtgcctgaagagcatcaaggcccacaagggccaggtgaccttcctgagcatccaccccagcggcaagctggccctgagcgtgggcaccgacaagaccctgagaacctggaacctggtggagggcagaagcgccttcatcaagaacatcaagcagaacgcccacatcgtggagtggagccccagaggcgagcagtacgtggtgatcatccagaacaagatcgacatctaccagctggacaccgccagcatcagcggcaccatcaccaacgagaagagaatcagcagcgtgaagttcctgagcgagagcgtgctggccgtggccggcgacgaggaggtgatcagattcttcgactgcgacagcctggtgtgcctgtgcgagttcaaggcccacgagaacagagtgaaggacatgttcagcttcgagatccccgagcaccacgtgatcgtgagcgccagcagcgacggcttcatcaagatgtggaagctgaagcaggacaagaaggtgccccccagcctgctgtgcgagatcaacaccaacgccagactgacctgcctgggcgtgtggctggacaaggtggccgacatgaaggagagcctgccccccgccgccgagcccagccccgtgagcaaggagcagagcaagatcggcaagaaggagcccggcgacaccgtgcacaaggaggagaagagaagcaagcccaacaccaagaagagaggcctgaccggcgacagcaagaaggccaccaaggagagcggcctgatcagcaccaagaagagaaagatggtggagatgctggagaagaagagaaagaagaagaagatcaagaccatgcagtag

SEQ ID NO: 92330 - DNA, 3372 bp, Artificial Sequence
  Description of Artificial Sequence: Synthetic coding sequence
atgagcggcaccagcagccacgagagcttctacgacagcctgagcgacatgcaggaggagagcaagaacaccgacttcttccccggcctgagcgccttcctgagccaggaggagatcaacaagagcctggacctggccagaagagccatcgccgacagcgagaccgaggacttcgacagcgagaaggagatcagccagatcttcagcaccagccccgccagcctgtgcgagcaccccagccacaaggagaccaagctgggcgagcacgccagcagaagaccccaggacaacagaagcacccccgtgcagcccctggccgagaagcagaccaagagcatcagcagccccgtgagcaagagaaagcccgccatgagccccctgctgaccagacccagctacatcagaagcctgagaaaggccgagaagagaggcgccaagacccccagcaccaacgtgaagcccaagaccccccaccagagaaagggcggcccccagagccagctgtgcgacaaggccgccaacctgatcgaggagctgaccagcatcttcaaggccgccaagcccagaaacagaagccccaacggcgagagcagcagccccgacagcggctacctgagccccaagaaccagcccagcgccctgctgagcgccagcgccagccagagccccatggaggaccagggcgagatggagagagaggtgaagagccccggcgccagacactgctaccaggacaaccaggacctggccgtgccccacaacagaaagagccacccccagccccacagcgccctgcacttccccgccgcccccagattcatccagaagctgagaagccaggaggtggccgagggcagcagagtgtacctggagtgcagagtgaccggcaaccccacccccagagtgagatggttctgcgagggcaaggagctgcacaacacccccgacatccagatccactgcgagggcggcgacctgcacaccctgatcatcgccgaggccttcgaggacgacaccggcagatacacctgcctggccaccaaccccagcggcagcgacaccaccagcgccgaggtgttcatcgagggcgccagcagcaccgacagcgacagcgagagcctggccttcaagagcagagccggcgccatgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgaggagatctgcaccctggtgatcgccgagaccttccccgaggacgccggcatcttcacctgcagcgccagaaacgactacggcagcgccaccagcaccgcccagctggtggtgaccagcgccaacaccgagaactgcagctacgagagcatgggcgagagcaacaacgaccacttccagcacttccccccccccccccccatcctggagaccagcagcctggagctggccagcaagaagcccagcgagatccagcaggtgaacaaccccgagctgggcctgagcagagccgccctgcagatgcagttcaacgccgccgagagagagaccaacggcgtgcaccccagcagaggcgtgaacggcctgatcaacggcaaggccaacagcaacaagagcctgcccacccccgccgtgctgctgagccccaccaaggagcccccccccctgctggccaagcccaagctgggcttccccaagaaggccagcagaaccgccagaatcgccagcgacgaggagatccagggcaccaaggacgccgtgatccaggacctggagagaaagctgagattcaaggaggacctgctgaacaacggccagcccagactgacctacgaggagagaatggccagaagactgctgggcgccgacagcgccaccgtgttcaacatccaggagcccgaggaggagaccgccaaccaggacatcggcagcccccacgccagcgtgggcagccccctggacggccagaaggagtacaaggtgagcagctgcgagcagagactgatcagcgagatcgagtacagactggagagaagccccgtggacgagagcggcgacgaggtgcagtacggcgacgtgcccgtggagaacggcatggcccccttcttcgagatgaagctgaagcactacaagatcttcgagggcatgcccgtgaccttcacctgcagagtggccggcaaccccaagcccaagatctactggttcaaggacggcaagcagatcagccccaagagcgaccactacaccatccagagagacctggacggcacctgcagcctgcacaccaccgccagcaccctggacgacgacggcaactacaccatcatggccgccaacccccagggcagaatcagctgcaccggcagactgatggtgcaggccgtgaaccagagaggcagaagccccagaagccccagcggccacccccacgtgagaagacccagaagcagaagcagagacagcggcgacgagaacgagcccatccaggagagattcttcagaccccacttcctgcaggcccccggcgacctgaccgtgcaggagggcaagctgtgcagaatggactgcaaggtgagcggcctgcccacccccgacctgagctggcagctggacggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacatcagcagacactag

SEQ ID NO: 92331 - DNA, 2019 bp, Artificial Sequence
  Description of Artificial Sequence: Synthetic coding sequence
atgagcgccctggccagcagaagcgcccccgccatgcagagcagcggcagcttcaactacgccagacccaagcagttcatcgccgcccagaacctgggccccgccagcggccacggcacccccgccagcagccccagcagcagcagcctgcccagccccatgagccccacccccagacagttcggcagagcccccgtgccccccttcgcccagcccttcggcgccgagcccgaggccccctggggcagcagcagccccagccccccccccccccccccccccgtgttcagccccaccgccgccttccccgtgcccgacgtgttccccctgccccccccccccccccccctgcccagccccggccaggccagccactgcagcagccccgccaccagattcggccacagccagacccccgccgccttcctgagcgccctgctgcccagccagcccccccccgccgccgtgaacgccctgggcctgcccaagggcgtgacccccgccggcttccccaagaaggccagcagaaccgccagaatcgccagcgacgaggagatccagggcaccaaggacgccgtgatccaggacctggagagaaagctgagattcaaggaggacctgctgaacaacggccagcccagactgacctacgaggagagaatggccagaagactgctgggcgccgacagcgccaccgtgttcaacatccaggagcccgaggaggagaccgccaaccaggagtacaaggtgagcagctgcgagcagagactgatcagcgagatcgagtacagactggagagaagccccgtggacgagagcggcgacgaggtgcagtacggcgacgtgcccgtggagaacggcatggcccccttcttcgagatgaagctgaagcactacaagatcttcgagggcatgcccgtgaccttcacctgcagagtggccggcaaccccaagcccaagatctactggttcaaggacggcaagcagatcagccccaagagcgaccactacaccatccagagagacctggacggcacctgcagcctgcacaccaccgccagcaccctggacgacgacggcaactacaccatcatggccgccaacccccagggcagaatcagctgcaccggcagactgatggtgcaggccgtgaaccagagaggcagaagccccagaagccccagcggccacccccacgtgagaagacccagaagcagaagcagagacagcggcgacgagaacgagcccatccaggagagattcttcagaccccacttcctgcaggcccccggcgacctgaccgtgcaggagggcaagctgtgcagaatggactgcaaggtgagcggcctgcccacccccgacctgagctggcagctggacggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacacccagtggcaccagcagagccagagcaccaagcccaagaaggtgagacccagcgccagcagatacgccgccctgagcgaccagggcctggacatcaaggccgccttccagcccgaggccaaccccagccacctgaccctgaacaccgccctggtggagagcgaggacctgtag

SEQ ID NO: 92332 - DNA, 2334 bp, Artificial Sequence
  Description of Artificial Sequence: Synthetic coding sequence
atgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgaggagatctgcaccctggtgatcgccgagaccttccccgaggacgccggcatcttcacctgcagcgccagaaacgactacggcagcgccaccagcaccgcccagctggtggtgaccagcgccaacaccgagaactgcagctacgagagcatgggcgagagcaacaacgaccacttccagcacttccccccccccccccccatcctggagaccagcagcctggagctggccagcaagaagcccagcgagatccagcaggtgaacaaccccgagctgggcctgagcagagccgccctgcagatgcagttcaacgccgccgagagagagaccaacggcgtgcaccccagcagaggcgtgaacggcctgatcaacggcaaggccaacagcaacaagagcctgcccacccccgccgtgctgctgagccccaccaaggagcccccccccctgctggccaagcccaagctgggcttccccaagaaggccagcagaaccgccagaatcgccagcgacgaggagatccagggcaccaaggacgccgtgatccaggacctggagagaaagctgagattcaaggaggacctgctgaacaacggccagcccagactgacctacgaggagagaatggccagaagactgctgggcgccgacagcgccaccgtgttcaacatccaggagcccgaggaggagaccgccaaccaggagtacaaggtgagcagctgcgagcagagactgatcagcgagatcgagtacagactggagagaagccccgtggacgagagcggcgacgaggtgcagtacggcgacgtgcccgtggagaacggcatggcccccttcttcgagatgaagctgaagcactacaagatcttcgagggcatgcccgtgaccttcacctgcagagtggccggcaaccccaagcccaagatctactggttcaaggacggcaagcagatcagccccaagagcgaccactacaccatccagagagacctggacggcacctgcagcctgcacaccaccgccagcaccctggacgacgacggcaactacaccatcatggccgccaacccccagggcagaatcagctgcaccggcagactgatggtgcaggccgtgaaccagagaggcagaagccccagaagccccagcggccacccccacgtgagaagacccagaagcagaagcagagacagcggcgacgagaacgagcccatccaggagagattcttcagaccccacttcctgcaggcccccggcgacctgaccgtgcaggagggcaagctgtgcagaatggactgcaaggtgagcggcctgcccacccccgacctgagctggcagctggacggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacacccagtggcaccagcagagccagagcaccaagcccaagaaggtgagacccagcgccagcagatacgccgccctgagcgaccagggcctggacatcaaggccgccttccagcccgaggccaaccccagccacctgaccctgaacaccgccctggtggagagcgaggacctgtag

SEQ ID NO: 92333 - DNA, 3321 bp, Artificial Sequence
  Description of Artificial Sequence: Synthetic coding sequence
atgagcggcaccagcagccacgagagcttctacgacagcctgagcgacatgcaggaggagagcaagaacaccgacttcttccccggcctgagcgccttcctgagccaggaggagatcaacaagagcctggacctggccagaagagccatcgccgacagcgagaccgaggacttcgacagcgagaaggagatcagccagatcttcagcaccagccccgccagcctgtgcgagcaccccagccacaaggagaccaagctgggcgagcacgccagcagaagaccccaggacaacagaagcacccccgtgcagcccctggccgagaagcagaccaagagcatcagcagccccgtgagcaagagaaagcccgccatgagccccctgctgaccagacccagctacatcagaagcctgagaaaggccgagaagagaggcgccaagacccccagcaccaacgtgaagcccaagaccccccaccagagaaagggcggcccccagagccagctgtgcgacaaggccgccaacctgatcgaggagctgaccagcatcttcaaggccgccaagcccagaaacagaagccccaacggcgagagcagcagccccgacagcggctacctgagccccaagaaccagcccagcgccctgctgagcgccagcgccagccagagccccatggaggaccagggcgagatggagagagaggtgaagagccccggcgccagacactgctaccaggacaaccaggacctggccgtgccccacaacagaaagagccacccccagccccacagcgccctgcacttccccgccgcccccagattcatccagaagctgagaagccaggaggtggccgagggcagcagagtgtacctggagtgcagagtgaccggcaaccccacccccagagtgagatggttctgcgagggcaaggagctgcacaacacccccgacatccagatccactgcgagggcggcgacctgcacaccctgatcatcgccgaggccttcgaggacgacaccggcagatacacctgcctggccaccaaccccagcggcagcgacaccaccagcgccgaggtgttcatcgagggcgccagcagcaccgacagcgacagcgagagcctggccttcaagagcagagccggcgccatgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgaggagatctgcaccctggtgatcgccgagaccttccccgaggacgccggcatcttcacctgcagcgccagaaacgactacggcagcgccaccagcaccgcccagctggtggtgaccagcgccaacaccgagaactgcagctacgagagcatgggcgagagcaacaacgaccacttccagcacttccccccccccccccccatcctggagaccagcagcctggagctggccagcaagaagcccagcgagatccagcaggtgaacaaccccgagctgggcctgagcagagccgccctgcagatgcagttcaacgccgccgagagagagaccaacggcgtgcaccccagcagaggcgtgaacggcctgatcaacggcaaggccaacagcaacaagagcctgcccacccccgccgtgctgctgagccccaccaaggagcccccccccctgctggccaagcccaagctgggcttccccaagaaggccagcagaaccgccagaatcgccagcgacgaggagatccagggcaccaaggacgccgtgatccaggacctggagagaaagctgagattcaaggaggacctgctgaacaacggccagcccagactgacctacgaggagagaatggccagaagactgctgggcgccgacagcgccaccgtgttcaacatccaggagcccgaggaggagaccgccaaccaggagtacaaggtgagcagctgcgagcagagactgatcagcgagatcgagtacagactggagagaagccccgtggacgagagcggcgacgaggtgcagtacggcgacgtgcccgtggagaacggcatggcccccttcttcgagatgaagctgaagcactacaagatcttcgagggcatgcccgtgaccttcacctgcagagtggccggcaaccccaagcccaagatctactggttcaaggacggcaagcagatcagccccaagagcgaccactacaccatccagagagacctggacggcacctgcagcctgcacaccaccgccagcaccctggacgacgacggcaactacaccatcatggccgccaacccccagggcagaatcagctgcaccggcagactgatggtgcaggccgtgaaccagagaggcagaagccccagaagccccagcggccacccccacgtgagaagacccagaagcagaagcagagacagcggcgacgagaacgagcccatccaggagagattcttcagaccccacttcctgcaggcccccggcgacctgaccgtgcaggagggcaagctgtgcagaatggactgcaaggtgagcggcctgcccacccccgacctgagctggcagctggacggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacatcagcagacactag

SEQ ID NO: 92334 - DNA, 1233 bp, Artificial Sequence
  Description of Artificial Sequence: Synthetic coding sequence
atgagccccctgctgaccagacccagctacatcagaagcctgagaaaggccgagaagagaggcgccaagacccccagcaccaacgtgaagcccaagaccccccaccagagaaagggcggcccccagagccagctgtgcgacaaggccgccaacctgatcgaggagctgaccagcatcttcaaggccgccaagcccagaaacagaagccccaacggcgagagcagcagccccgacagcggctacctgagccccaagaaccagcccagcgccctgctgagcgccagcgccagccagagccccatggaggaccagggcgagatggagagagaggtgaagagccccggcgccagacactgctaccaggacaaccaggacctggccgtgccccacaacagaaagagccacccccagccccacagcgccctgcacttccccgccgcccccagattcatccagaagctgagaagccaggaggtggccgagggcagcagagtgtacctggagtgcagagtgaccggcaaccccacccccagagtgagatggttctgcgagggcaaggagctgcacaacacccccgacatccagatccactgcgagggcggcgacctgcacaccctgatcatcgccgaggccttcgaggacgacaccggcagatacacctgcctggccaccaaccccagcggcagcgacaccaccagcgccgaggtgttcatcgagggcgccagcagcaccgacagcgacagcgagagcctggccttcaagagcagagccggcgccatgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgacgtgctgtacgtgttcgtgagagtgagatgccaccagatgaagatccagtactacaacctggcccacctgatcagcagctggctgagcagcttcctgtag

SEQ ID NO: 92335 - DNA, 3006 bp, Artificial Sequence
  Description of Artificial Sequence: Synthetic coding sequence
atgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgaggagatctgcaccctggtgatcgccgagaccttccccgaggacgccggcatcttcacctgcagcgccagaaacgactacggcagcgccaccagcaccgcccagctggtggtgaccagcgccaacaccgagaactgcagctacgagagcatgggcgagagcaacaacgaccacttccagcacttccccccccccccccccatcctggagaccagcagcctggagctggccagcaagaagcccagcgagatccagcaggtgaacaaccccgagctgggcctgagcagagccgccctgcagatgcagttcaacgccgccgagagagagaccaacggcgtgcaccccagcagaggcgtgaacggcctgatcaacggcaaggccaacagcaacaagagcctgcccacccccgccgtgctgctgagccccaccaaggagcccccccccctgctggccaagcccaagctggaccccctgaagctgcagcagctgcagaaccagatcagactggagcaggaggccggcgccagacagcccccccccgcccccagaagcgccccccccagcccccccttcccccccccccccgccttccccgagctggccgcctgcaccccccccgccagccccgagcccatgagcgccctggccagcagaagcgcccccgccatgcagagcagcggcagcttcaactacgccagacccaagcagttcatcgccgcccagaacctgggccccgccagcggccacggcacccccgccagcagccccagcagcagcagcctgcccagccccatgagccccacccccagacagttcggcagagcccccgtgccccccttcgcccagcccttcggcgccgagcccgaggccccctggggcagcagcagccccagccccccccccccccccccccccgtgttcagccccaccgccgccttccccgtgcccgacgtgttccccctgccccccccccccccccccctgcccagccccggccaggccagccactgcagcagccccgccaccagattcggccacagccagacccccgccgccttcctgagcgccctgctgcccagccagcccccccccgccgccgtgaacgccctgggcctgcccaagggcgtgacccccgccggcttccccaagaaggccagcagaaccgccagaatcgccagcgacgaggagatccagggcaccaaggacgccgtgatccaggacctggagagaaagctgagattcaaggaggacctgctgaacaacggccagcccagactgacctacgaggagagaatggccagaagactgctgggcgccgacagcgccaccgtgttcaacatccaggagcccgaggaggagaccgccaaccaggagtacaaggtgagcagctgcgagcagagactgatcagcgagatcgagtacagactggagagaagccccgtggacgagagcggcgacgaggtgcagtacggcgacgtgcccgtggagaacggcatggcccccttcttcgagatgaagctgaagcactacaagatcttcgagggcatgcccgtgaccttcacctgcagagtggccggcaaccccaagcccaagatctactggttcaaggacggcaagcagatcagccccaagagcgaccactacaccatccagagagacctggacggcacctgcagcctgcacaccaccgccagcaccctggacgacgacggcaactacaccatcatggccgccaacccccagggcagaatcagctgcaccggcagactgatggtgcaggccgtgaaccagagaggcagaagccccagaagccccagcggccacccccacgtgagaagacccagaagcagaagcagagacagcggcgacgagaacgagcccatccaggagagattcttcagaccccacttcctgcaggcccccggcgacctgaccgtgcaggagggcaagctgtgcagaatggactgcaaggtgagcggcctgcccacccccgacctgagctggcagctggacggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacacccagtggcaccagcagagccagagcaccaagcccaagaaggtgagacccagcgccagcagatacgccgccctgagcgaccagggcctggacatcaaggccgccttccagcccgaggccaaccccagccacctgaccctgaacaccgccctggtggagagcgaggacctgtag

SEQ ID NO: 92336 - DNA, 483 bp, Artificial Sequence
  Description of Artificial Sequence: Synthetic coding sequence
tgaggcaagcccgtgagacccgacagcgcccacaagatgctggtgagagagaacggcgtgcacagcctgatcatcgagcccgtgaccagcagagacgccggcatctacacctgcatcgccaccaacagagccggccagaacagcttcagcctggagctggtggtggccgccaaggaggcccacaagccccccgtgttcatcgagaagctgcagaacaccggcgtggccgacggctaccccgtgagactggagtgcagagtgctgggcgtgccccccccccagatcttctggaagaaggagaacgagagcctgacccacagcaccgacagagtgagcatgcaccaggacaaccacggctacatctgcctgctgatccagggcgccaccaaggaggacgccggctggtacaccgtgagcgccaagaacgaggccggcatcgtgagctgcaccgccagactggacgtgtacatcagcagacactag

SEQ ID NO: 92337 - DNA, 1539 bp, Artificial Sequence
  Description of Artificial Sequence: Synthetic coding sequence
aagaacaccgacttcttccccggcctgagcgccttcctgagccaggaggagatcaacaagagcctggacctggccagaagagccatcgccgacagcgagaccgaggacttcgacagcgagaaggagatcagccagatcttcagcaccagccccgccagcctgtgcgagcaccccagccacaaggagaccaagctgggcgagcacgccagcagaagaccccaggacaacagaagcacccccgtgcagcccctggccgagaagcagaccaagagcatcagcagccccgtgagcaagagaaagcccgccatgagccccctgctgaccagacccagctacatcagaagcctgagaaaggccgagaagagaggcgccaagacccccagcaccaacgtgaagcccaagaccccccaccagagaaagggcggcccccagagccagctgtgcgacaaggccgccaacctgatcgaggagctgaccagcatcttcaaggccgccaagcccagaaacagaagccccaacggcgagagcagcagccccgacagcggctacctgagccccaagaaccagcccagcgccctgctgagcgccagcgccagccagagccccatggaggaccagggcgagatggagagagaggtgaagagccccggcgccagacactgctaccaggacaaccaggacctggccgtgccccacaacagaaagagccacccccagccccacagcgccctgcacttccccgccgcccccagattcatccagaagctgagaagccaggaggtggccgagggcagcagagtgtacctggagtgcagagtgaccggcaaccccacccccagagtgagatggttctgcgagggcaaggagctgcacaacacccccgacatccagatccactgcgagggcggcgacctgcacaccctgatcatcgccgaggccttcgaggacgacaccggcagatacacctgcctggccaccaaccccagcggcagcgacaccaccagcgccgaggtgttcatcgagggcgccagcagcaccgacagcgacagcgagagcctggccttcaagagcagagccggcgccatgccccaggcccagaagaagaccaccagcgtgagcctgaccatcggcagcagcagccccaagaccggcgtgaccaccgccgtgatccagcccctgagcgtgcccgtgcagcaggtgcacagccccaccagctacctgtgcagacccgacggcaccaccaccgcctacttcccccccgtgttcaccaaggagctgcagaacaccgccgtggccgagggccaggtggtggtgctggagtgcagagtgagaggcgccccccccctgcaggtgcagtggttcagacagggcagcgagatccaggacagccccgacttcagaatcctgcagaagaagcccagaagcaccgccgagcccgacgtgctgtacgtgttcgtgagagtgagatgccaccagatgaagatccagtactacaacctggcccacctgatcagcagctggctgagcagcttcctgtag

SEQ ID NO: 92338 - DNA, 87 bp, Artificial Sequence
  Description of Artificial Sequence: Synthetic coding sequence
atgagcggcaccagcagccacgagagcttctacgacagcctgagcgacatgcaggaggagagcaagaacaccgacttcttcccctag

SEQ ID NO: 92339 - DNA, 690 bp, Artificial Sequence
  Description of Artificial Sequence: Synthetic coding sequence
atggccgcccagcccctgagacacagaagcagatgcgccaccccccccagaggcgacttctgcggcggcaccgagagagccatcgaccaggccagcttcaccaccagcatggagtgggacacccaggtggtgaagggcagcagccccctgggccccgccggcctgggcgccgaggagcccgccgccggcccccagctgcccagctggctgcagcccgagagatgcgccgtgttccagtgcgcccagtgccacgccgtgctggccgacagcgtgcacctggcctgggacctgagcagaagcctgggcgccgtggtgttcagcagagtgaccaacaacgtggtgctggaggcccccttcctggtgggcatcgagggcagcctgaagggcagcacctacaacctgctgttctgcggcagctgcggcatccccgtgggcttccacctgtacagcacccacgccgccctggccgccctgagaggccacttctgcctgagcagcgacaagatggtgtgctacctgctgaagaccaaggccatcgtgaacgccagcgagatggacatccagaacgtgcccctgagcgagaagatcgccgagctgaaggagaagatcgtgctgacccacaacagactgaagagcctgatgaagatcctgagcgaggtgacccccgaccagagcaagcccgagaactag

SEQ ID NO: 92340 - DNA, 816 bp, Artificial Sequence
  Description of Artificial Sequence: Synthetic coding sequence
atggccagccccggctgcctgtggctgctggccgtggccctgctgccctggacctgcgccagcagagccctgcagcacctggacccccccgcccccctgcccctggtgatctggcacggcatgggcagcagatacgtggcccagaccggcctggagctgctggccagcagcaacccccccgccagcagctaccagagcgccggcatgatcggcgacagctgctgcaaccccctgagcatgggcgccatcaagaagatggtggagaagaagatccccggcatctacgtgctgagcctggagatcggcaagaccctgatggaggacgtggagaacagcttcttcctgaacgtgaacagccaggtgaccaccgtgtgccaggccctggccaaggaccccaagctgcagcagggctacaacgccatgggcttcagccagggcggccagttcctgagagccgtggcccagagatgccccagcccccccatgatcaacctgatcagcgtgggcggccagcaccagggcgtgttcggcctgcccagatgccccggcgagagcagccacatctgcgacttcatcagaaagaccctgaacgccggcgcctacagcaaggtggtgcaggagagactggtgcaggccgagtactggcacgaccccatcaaggaggacgtgtacagaaaccacagcatcttcctggccgacatcaaccaggagagaggcatcaacgagagctacaagaagaacctgatggccctgaagaagttcgtgatggtgaagttcctgaacgacagcatcgtggaccccgtggacagcgagtag

SEQ ID NO: 92341 - DNA, 921 bp, Artificial Sequence
  Description of Artificial Sequence: Synthetic coding sequence
atggccagccccggctgcctgtggctgctggccgtggccctgctgccctggacctgcgccagcagagccctgcagcacctggacccccccgcccccctgcccctggtgatctggcacggcatgggcgacagctgctgcaaccccctgagcatgggcgccatcaagaagatggtggagaagaagatccccggcatctacgtgctgagcctggagatcggcaagaccctgatggaggacgtggagaacagcttcttcctgaacgtgaacagccaggtgaccaccgtgtgccaggccctggccaaggaccccaagctgcagcagggctacaacgccatgggcttcagccagggcggccagttcctgagagccgtggcccagagatgccccagcccccccatgatcaacctgatcagcgtgggcggccagcaccagggcgtgttcggcctgcccagatgccccggcgagagcagccacatctgcgacttcatcagaaagaccctgaacgccggcgcctacagcaaggtggtgcaggagagactggtgcaggccgagtactggcacgaccccatcaaggaggacgtgtacagaaaccacagcatcttcctggccgacatcaaccaggagagaggcatcaacgagagctacaagaagaacctgatggccctgaagaagttcgtgatggtgaagttcctgaacgacagcatcgtggaccccgtggacagcgagtggttcggcttctacagaagcggccaggccaaggagaccatccccctgcaggagaccagcctgtacacccaggacagactgggcctgaaggagatggacaacgccggccagctggtgttcctggccaccgagggcgaccacctgcagctgagcgaggagtggttctacgcccacatcatccccttcctgggctag

SEQ ID NO: 92342 - DNA, 612 bp, Artificial Sequence
  Description of Artificial Sequence: Synthetic coding sequence
atggccagccccggctgcctgtggctgctggccgtggccctgctgccctggacctgcgccagcagagccctgcagcacctggacccccccgcccccctgcccctggtgatctggcacggcatgggcgtgttcggcctgcccagatgccccggcgagagcagccacatctgcgacttcatcagaaagaccctgaacgccggcgcctacagcaaggtggtgcaggagagactggtgcaggccgagtactggcacgaccccatcaaggaggacgtgtacagaaaccacagcatcttcctggccgacatcaaccaggagagaggcatcaacgagagctacaagaagaacctgatggccctgaagaagttcgtgatggtgaagttcctgaacgacagcatcgtggaccccgtggacagcgagtggttcggcttctacagaagcggccaggccaaggagaccatccccctgcaggagaccagcctgtacacccaggacagactgggcctgaaggagatggacaacgccggccagctggtgttcctggccaccgagggcgaccacctgcagctgagcgaggagtggttctacgcccacatcatccccttcctgggctag

SEQ ID NO: 92343 - DNA, 921 bp, Artificial Sequence; identical to SEQ ID NO: 92341
  Description of Artificial Sequence: Synthetic coding sequence

SEQ ID NO: 92344 - DNA, 909 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92345 - DNA, 927 bp, Artificial Sequence
  Description of Artificial Sequence: Synthetic coding sequence
atgaagagctgcggcagcatgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92346 - DNA, 909 bp, Artificial Sequence; identical to SEQ ID NO: 92344
  Description of Artificial Sequence: Synthetic coding sequence

SEQ ID NO: 92347 - DNA, 909 bp, Artificial Sequence; identical to SEQ ID NO: 92344
  Description of Artificial Sequence: Synthetic coding sequence

SEQ ID NO: 92348 - DNA, 927 bp, Artificial Sequence
  Description of Artificial Sequence: Synthetic coding sequence
atgaagagctgcggcagcatgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92349 - DNA, 927 bp, Artificial Sequence
  Description of Artificial Sequence: Synthetic coding sequence
atgaagagctgcggcagcatgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92350 - DNA, 909 bp, Artificial Sequence; identical to SEQ ID NO: 92344
  Description of Artificial Sequence: Synthetic coding sequence

SEQ ID NO: 92351 - DNA, 909 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92352 - DNA, 909 bp, Artificial Sequence; identical to SEQ ID NO: 92351
  Description of Artificial Sequence: Synthetic coding sequence

SEQ ID NO: 92353 - DNA, 909 bp, Artificial Sequence; identical to SEQ ID NO: 92351
  Description of Artificial Sequence: Synthetic coding sequence

SEQ ID NO: 92354 - DNA, 909 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctggtgtacctgagagacagcttcggcctgaagaccctgctggccagaggcgccatcgtgagatgccccatggccggcatcagccacaccgcctggcacagcaacagaaccctgtacgagacctgcatcgagccctggctgagctag

SEQ ID NO: 92355 - DNA, 909 bp, Artificial Sequence; identical to SEQ ID NO: 92354
  Description of Artificial Sequence: Synthetic coding sequence

SEQ ID NO: 92356 - DNA, 909 bp, Artificial Sequence; identical to SEQ ID NO: 92354
  Description of Artificial Sequence: Synthetic coding sequence

SEQ ID NO: 92357 - DNA, 927 bp, Artificial Sequence; identical to SEQ ID NO: 92349
  Description of Artificial Sequence: Synthetic coding sequence

SEQ ID NO: 92358 - DNA, 282 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagggcgccctgtgcgccggcctgtgcttcctgagctggatgatcaccacctggatcctgagcagccccagccccctgcacagatgggacagcatggagtag

SEQ ID NO: 92359 - DNA, 543 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcactag

SEQ ID NO: 92360 - DNA, 927 bp, Artificial Sequence; identical to SEQ ID NO: 92349
  Description of Artificial Sequence: Synthetic coding sequence

SEQ ID NO: 92361 - DNA, 603 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggctag

SEQ ID NO: 92362 - DNA, 477 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92363 - DNA, 543 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcactag

SEQ ID NO: 92364 - DNA, 477 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92365 - DNA, 543 bp, Artificial Sequence; identical to SEQ ID NO: 92363
  Description of Artificial Sequence: Synthetic coding sequence

SEQ ID NO: 92366 - DNA, 909 bp, Artificial Sequence; identical to SEQ ID NO: 92354
  Description of Artificial Sequence: Synthetic coding sequence

SEQ ID NO: 92367 - DNA, 909 bp, Artificial Sequence; identical to SEQ ID NO: 92354
  Description of Artificial Sequence: Synthetic coding sequence

SEQ ID NO: 92368 - DNA, 927 bp, Artificial Sequence; identical to SEQ ID NO: 92349
  Description of Artificial Sequence: Synthetic coding sequence

SEQ ID NO: 92369 - DNA, 282 bp, Artificial Sequence; identical to SEQ ID NO: 92358
  Description of Artificial Sequence: Synthetic coding sequence

SEQ ID NO: 92370 - DNA, 909 bp, Artificial Sequence; identical to SEQ ID NO: 92354
  Description of Artificial Sequence: Synthetic coding sequence

SEQ ID NO: 92371 - DNA, 477 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92372 - DNA, 711 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92373 - DNA, 543 bp, Artificial Sequence; identical to SEQ ID NO: 92363
  Description of Artificial Sequence: Synthetic coding sequence

SEQ ID NO: 92374 - DNA, 711 bp, Artificial Sequence; identical to SEQ ID NO: 92372
  Description of Artificial Sequence: Synthetic coding sequence

SEQ ID NO: 92375 - DNA, 603 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggctag

SEQ ID NO: 92376 - DNA, 909 bp, Artificial Sequence; identical to SEQ ID NO: 92354
  Description of Artificial Sequence: Synthetic coding sequence

SEQ ID NO: 92377 - DNA, 603 bp, Artificial Sequence; identical to SEQ ID NO: 92375
  Description of Artificial Sequence: Synthetic coding sequence

SEQ ID NO: 92378 - DNA, 729 bp, Artificial Sequence
  Description of Artificial Sequence: Synthetic coding sequence
atgaagagctgcggcagcatgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92379 - DNA, 711 bp, Artificial Sequence; identical to SEQ ID NO: 92372
  Description of Artificial Sequence: Synthetic coding sequence

SEQ ID NO: 92380 - DNA, 543 bp, Artificial Sequence; identical to SEQ ID NO: 92363
  Description of Artificial Sequence: Synthetic coding sequence

SEQ ID NO: 92381 - DNA, 477 bp, Artificial Sequence; identical to SEQ ID NO: 92364
  Description of Artificial Sequence: Synthetic coding sequence

SEQ ID NO: 92382 - DNA, 603 bp, Artificial Sequence; identical to SEQ ID NO: 92361
  Description of Artificial Sequence: Synthetic coding sequence

SEQ ID NO: 92383 - DNA, 603 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggctag

SEQ ID NO: 92384 - DNA, 441 bp, Artificial Sequence
  Description of Artificial Sequence: Synthetic coding sequence
atggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctgcccgtgggcagcagcgtgaaggccaaccacggcgtgcagggctag

SEQ ID NO: 92385 - DNA, 477 bp, Artificial Sequence; identical to SEQ ID NO: 92364
  Description of Artificial Sequence: Synthetic coding sequence

SEQ ID NO: 92386 - DNA, 909 bp, Artificial Sequence; identical to SEQ ID NO: 92354
  Description of Artificial Sequence: Synthetic coding sequence

SEQ ID NO: 92387 - DNA, 909 bp, Artificial Sequence; identical to SEQ ID NO: 92354
  Description of Artificial Sequence: Synthetic coding sequence

SEQ ID NO: 92388 - DNA, 909 bp, Artificial Sequence; identical to SEQ ID NO: 92354
  Description of Artificial Sequence: Synthetic coding sequence

SEQ ID NO: 92389 - DNA, 282 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagggcgccctgtgcgccggcctgtgcttcctgagctggatgatcaccacctggatcctgagcagccccagccccctgcacagatgggacagcatggagtag

SEQ ID NO: 92390 - DNA, 603 bp, Artificial Sequence; identical to SEQ ID NO: 92375
  Description of Artificial Sequence: Synthetic coding sequence

SEQ ID NO: 92391 - DNA, 603 bp, Artificial Sequence; identical to SEQ ID NO: 92375
  Description of Artificial Sequence: Synthetic coding sequence

SEQ ID NO: 92392 - DNA, 909 bp, Artificial Sequence; identical to SEQ ID NO: 92354
  Description of Artificial Sequence: Synthetic coding sequence

SEQ ID NO: 92393 - DNA, 906 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctgcccgccagacccacccaccagagcgagctgctgctgctgagactggtgtgcctgaagccccccagaagaaagaagcccgcctgcagagtgcagagacagagcgagagctggggccccggcctgagctgcgccctgagctag

SEQ ID NO: 92394 - DNA, 477 bp, Artificial Sequence; identical to SEQ ID NO: 92362
  Description of Artificial Sequence: Synthetic coding sequence

SEQ ID NO: 92395 - DNA, 543 bp, Artificial Sequence; identical to SEQ ID NO: 92363
  Description of Artificial Sequence: Synthetic coding sequence

SEQ ID NO: 92396 - DNA, 603 bp, Artificial Sequence; identical to SEQ ID NO: 92375
  Description of Artificial Sequence: Synthetic coding sequence

SEQ ID NO: 92397 - DNA, 909 bp, Artificial Sequence; identical to SEQ ID NO: 92354
  Description of Artificial Sequence: Synthetic coding sequence

SEQ ID NO: 92398 - DNA, 909 bp, Artificial Sequence; identical to SEQ ID NO: 92354
  Description of Artificial Sequence: Synthetic coding sequence

SEQ ID NO: 92399 - DNA, 282 bp, Artificial Sequence; identical to SEQ ID NO: 92358
  Description of Artificial Sequence: Synthetic coding sequence

SEQ ID NO: 92400 - DNA, 282 bp, Artificial Sequence
  Description of Artificial Sequence: Synthetic coding sequence
atgctgggcctgtgcggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagggcgccctgtgcgccggcctgtgcttcctgagctggatgatcaccacctggatcctgagcagccccagccccctgcacagatgggacagcatggagtag

SEQ ID NO: 92401 - DNA, 909 bp, Artificial Sequence; identical to SEQ ID NO: 92354
  Description of Artificial Sequence: Synthetic coding sequence

SEQ ID NO: 92402 - DNA, 909 bp, Artificial Sequence; identical to SEQ ID NO: 92354
  Description of Artificial Sequence: Synthetic coding sequence

SEQ ID NO: 92403 - DNA, 543 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcactag

SEQ ID NO: 92404 - DNA, 543 bp, Artificial Sequence; identical to SEQ ID NO: 92403
  Description of Artificial Sequence: Synthetic coding sequence

SEQ ID NO: 92405 - DNA, 282 bp, Artificial Sequence; identical to SEQ ID NO: 92389
  Description of Artificial Sequence: Synthetic coding sequence

SEQ ID NO: 92406 - DNA, 711 bp, Artificial Sequence; identical to SEQ ID NO: 92372
  Description of Artificial Sequence: Synthetic coding sequence

SEQ ID NO: 92407 - DNA, 165 bp, Artificial Sequence
  Description of Artificial Sequence: Synthetic coding sequence
tgacacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagctag

SEQ ID NO: 92408 - DNA, 711 bp, Artificial Sequence; identical to SEQ ID NO: 92372
  Description of Artificial Sequence: Synthetic coding sequence

SEQ ID NO: 92409 - DNA, 909 bp, Artificial Sequence; identical to SEQ ID NO: 92354
  Description of Artificial Sequence: Synthetic coding sequence

SEQ ID NO: 92410 - DNA, 909 bp, Artificial Sequence; identical to SEQ ID NO: 92354
  Description of Artificial Sequence: Synthetic coding sequence

SEQ ID NO: 92411 - DNA, 909 bp, Artificial Sequence; identical to SEQ ID NO: 92354
  Description of Artificial Sequence: Synthetic coding sequence

SEQ ID NO: 92412 - DNA, 441 bp, Artificial Sequence; identical to SEQ ID NO: 92384
  Description of Artificial Sequence: Synthetic coding sequence

SEQ ID NO: 92413 - DNA, 927 bp, Artificial Sequence; identical to SEQ ID NO: 92349
  Description of Artificial Sequence: Synthetic coding sequence

SEQ ID NO: 92414 - DNA, 882 bp, Artificial Sequence; identical to SEQ ID NO: 80184
  Description of Artificial Sequence: Synthetic coding sequence

SEQ ID NO: 92415 - DNA, 906 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagccagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctgcccgccagacccacccaccagagcgagctgctgctgctgagactggtgtgcctgaagccccccagaagaaagaagcccgcctgcagagtgcagagacagagcgagagctggggccccggcctgagctgcgccctgagctag

SEQ ID NO: 92416 - DNA, 909 bp, Artificial Sequence; identical to SEQ ID NO: 92351
  Description of Artificial Sequence: Synthetic coding sequence

SEQ ID NO: 92417 - DNA, 441 bp, Artificial Sequence; identical to SEQ ID NO: 92384
  Description of Artificial Sequence: Synthetic coding sequence

SEQ ID NO: 92418 - DNA, 882 bp, Artificial Sequence; identical to SEQ ID NO: 80184
  Description of Artificial Sequence: Synthetic coding sequence

SEQ ID NO: 92419 - DNA, 906 bp, Artificial Sequence; identical to SEQ ID NO: 92415
  Description of Artificial Sequence: Synthetic coding sequence

SEQ ID NO: 92420 - DNA, 441 bp, Artificial Sequence; identical to SEQ ID NO: 92384
  Description of Artificial Sequence: Synthetic coding sequence

SEQ ID NO: 92421 - DNA, 906 bp, Artificial Sequence; identical to SEQ ID NO: 92415
  Description of Artificial Sequence: Synthetic coding sequence

SEQ ID NO: 92422 - DNA, 441 bp, Artificial Sequence; identical to SEQ ID NO: 92384
  Description of Artificial Sequence: Synthetic coding sequence

SEQ ID NO: 92423 - DNA, 882 bp, Artificial Sequence; identical to SEQ ID NO: 80184
  Description of Artificial Sequence: Synthetic coding sequence

SEQ ID NO: 92424 - DNA, 882 bp, Artificial Sequence; identical to SEQ ID NO: 80184
  Description of Artificial Sequence: Synthetic coding sequence

SEQ ID NO: 92425 - DNA, 909 bp, Artificial Sequence; identical to SEQ ID NO: 92354
  Description of Artificial Sequence: Synthetic coding sequence

SEQ ID NO: 92426 - DNA, 441 bp, Artificial Sequence; identical to SEQ ID NO: 92384
  Description of Artificial Sequence: Synthetic coding sequence

SEQ ID NO: 92427 - DNA, 909 bp, Artificial Sequence; identical to SEQ ID NO: 92354
  Description of Artificial Sequence: Synthetic coding sequence

SEQ ID NO: 92428 - DNA, 441 bp, Artificial Sequence; identical to SEQ ID NO: 92384
  Description of Artificial Sequence: Synthetic coding sequence

SEQ ID NO: 92429 - DNA, 906 bp, Artificial Sequence; identical to SEQ ID NO: 92415
  Description of Artificial Sequence: Synthetic coding sequence

SEQ ID NO: 92430 - DNA, 906 bp, Artificial Sequence
  Description of Artificial Sequence: Synthetic coding sequence
atgctgggcctgtggggccagagactgcccgccgcctgggtgctgctgctgctgcccttcctgcccctgctgctgctggccgcccccgccccccacagagagagctacaagcccgtgatcgtggtgcacggcctgttcgacagcagctacagcttcagacacctgctggagtacatcaacgagacccaccccggcaccgtggtgaccgtgctggacctgttcgacggcagagagagcctgagacccctgtgggagcaggtgcagggcttcagagaggccgtggtgcccatcatggccaaggccccccagggcgtgcacctgatctgctacagccagggcggcctggtgtgcagagccctgctgagcgtgatggacgaccacaacgtggacagcttcatcagcctgagcagcccccagatgggccagtacggcgacaccgactacctgaagtggctgttccccaccagcatgagaagcaacctgtacagaatctgctacagcccctggggccaggagttcagcatctgcaactactggcacgacccccaccacgacgacctgtacctgaacgccagcagcttcctggccctgatcaacggcgagagagaccaccccaacgccaccgtgtggagaaagaacttcctgagagtgggccacctggtgctgatcggcggccccgacgacggcgtgatcaccccctggcagagcagcttcttcggcttctacgacgccaacgagaccgtgctggagatggaggagcagctgcccgccagacccacccaccagagcgagctgctgctgctgagactggtgtgcctgaagccccccagaagaaagaagcccgcctgcagagtgcagagacagagcgagagctggggccccggcctgagctgcgccctgagctag

SEQ ID NO: 92431 - DNA, 906 bp, Artificial Sequence; identical to SEQ ID NO: 92415
  Description of Artificial Sequence: Synthetic coding sequence

SEQ ID NO: 92432 - DNA, 909 bp, Artificial Sequence; identical to SEQ ID NO: 92354
  Description of Artificial Sequence: Synthetic coding sequence

SEQ ID NO: 92433 - DNA, 3606 bp, Artificial Sequence
  Description of Artificial Sequence: Synthetic coding sequence
atgaacttcgagggcctggaccccggcctggccgagtacgcccccgccatgcacagcgccctggaccccgtgctggacgcccacctgaaccccagcctgctgcagaacgtggagctggaccccgagggcgtggccctggaggccctgcccgtgcaggagagcgtgcacatcatggagggcgtgtacagcgagctgcacagcgtggtggccgaggtgggcgtgcccgtgagcgtgagccacttcgacctgcacgaggagatgctgtgggtgggcagccacggcggccacgccaccagcttcttcggccccgccctggagagatacagcagcttccaggtgaacggcagcgacgacatcagacagatccagagcctggagaacggcatcctgttcctgaccaagaacaacctgaagtacatggccagaggcggcctgatcatcttcgactacctgctggacgagaacgaggacatgcacagcctgctgctgaccgacagcagcaccctgctggtgggcggcctgcagaaccacatcatcgagatcgacctgaacaccgtgcaggagacccagaagtacgccgtggagacccccggcgtgaccatcatgagacagaccaacagattcttcttctgcggccacaccagcggcaaggtgagcctgagagacctgagaaccttcaaggtggagcacgagttcgacgccttcagcggcagcctgagcgacttcgacgtgcacggcaacctgctggccgcctgcggcttcagcagcagactgaccggcctggcctgcgacagattcctgaaggtgtacgacctgagaatgatgagagccatcacccccctgcaggtgcacgtggaccccgccttcctgagattcatccccacctacaccagcagactggccatcatcagccagagcggccagtgccagttctgcgagcccaccggcctggccaaccccgccgacatcttccacgtgaaccccgtgggccccctgctgatgaccttcgacgtgagcgccagcaagcaggccctggccttcggcgacagcgagggctgcgtgcacctgtggaccgacagccccgagcccagcttcaacccctacagcagagagaccgagttcgccctgccctgcctggtggacagcctgccccccctggactggagccaggacctgctgcccctgagcctgatccccgtgcccctgaccaccgacaccctgctgagcgactggcccgccgccaacagcgcccccgcccccagaagagccccccccgtggacgccgagatcctgagaaccatgaagaaggtgggcttcatcggctacgcccccaaccccagaaccagactgagaaaccagatcccctacagactgaaggagagcgacagcgagttcgacagcttcagccaggtgaccgagagccccgtgggcagagaggaggagccccacctgcacatggtgagcaagaagtacagaaaggtgaccatcaagtacagcaagctgggcctggaggacttcgacttcaagcactacaacaagaccctgttcgccggcctggagccccacatccccaacgcctactgcaactgcatgatccaggtgctgtacttcctggagcccgtgagatgcctgatccagaaccacctgtgccagaaggagttctgcctggcctgcgagctgggcttcctgttccacatgctggacctgagcagaggcgacccctgccagggcaacaacttcctgagagccttcagaaccatccccgaggccagcgccctgggcctgatcctggccgacagcgacgaggccagcggcaagggcaacctggccagactgatccagagatggaacagattcatcctgacccagctgcaccaggacatgcaggagctggagatcccccaggcctacagaggcgccggcggcagcttctgcagcagcggcgacagcgtgatcggccagctgttcagctgcgagatggagaactgcagcctgtgcagatgcggcagcgagaccgtgagagccagcagcaccctgctgttcaccctgagctaccccgacggcagcaagagcgacaagaccggcaagaactacgacttcgcccaggtgctgaagagaagcatctgcctggaccagaacacccaggcctggtgcgacacctgcgagaagtaccagcccaccatccagaccagaaacatcagacacctgcccgacatcctggtgatcaactgcgaggtgaacagcagcaaggaggccgacttctggagaatgcaggccgaggtggccttcaagatggccgtgaagaagcacggcggcgagatcagcaagaacaaggagttcgccctggccgactggaaggagctgggcagccccgagggcgtgctggtgtgccccagcatcgaggagctgaagaacgtgtggctgcccttcagcatcagaatgaagatgaccaagaacaagggcctggacgtgtgcaactggaccgacggcgacgagatgcagtggggccccgccagagccgaggaggagcacggcgtgtacgtgtacgacctgatggccaccgtggtgcacatcctggacagcagaaccggcggcagcctggtggcccacatcaaggtgggcgagacctaccaccagagaaaggagggcgtgacccaccagcagtggtacctgttcaacgacttcctgatcgagcccatcgacaagcacgaggccgtgcagttcgacatgaactggaaggtgcccgccatcctgtactacgtgaagagaaacctgaacagcagatacaacctgaacatcaagaaccccatcgaggccagcgtgctgctggccgaggccagcctggccagaaagcagagaaagacccacaccaccttcatccccctgatgctgaacgagatgccccagatcggcgacctggtgggcctggacgccgagttcgtgaccctgaacgaggaggaggccgagctgagaagcgacggcaccaagagcaccatcaagcccagccagatgagcgtggccagaatcacctgcgtgagaggccagggccccaacgagggcatccccttcatcgacgactacatcagcacccaggagcaggtggtggactacctgacccagtacagcggcatcaagcccggcgacctggacgccaagatcagcagcaagcacctgaccaccctgaagagcacctacctgaagctgagattcctgatcgacatcggcgtgaagttcgtgggccacggcctgcagaaggacttcagagtgatcaacctgatggtgcccaaggaccaggtgctggacaccgtgtacctgttccacatgcccagaaagagaatgatcagcctgagattcctggcctggtacttcctggacctgaagatccagggcgagacccacgacagcatcgaggacgccagaaccgccctgcagctgtacagaaagtacctggagctgagcaagaacggcaccgagcccgagagcttccacaaggtgctgaagggcctgtacgagaagggcagaaagatggactggaaggtgcccgagcccgagggccagaccagccccaagaacgccgccgtgttcagcagcgtgctggccctgtag

SEQ ID NO: 92434 - DNA, 3609 bp, Artificial Sequence
  Description of Artificial Sequence: Synthetic coding sequence
atgaacttcgagggcctggaccccggcctggccgagtacgcccccgccatgcacagcgccctggaccccgtgctggacgcccacctgaaccccagcctgctgcagaacgtggagctggaccccgagggcgtggccctggaggccctgcccgtgcaggagagcgtgcacatcatggagggcgtgtacagcgagctgcacagcgtggtggccgaggtgggcgtgcccgtgagcgtgagccacttcgacctgcacgaggagatgctgtgggtgggcagccacggcggccacgccaccagcttcttcggccccgccctggagagatacagcagcttccaggtgaacggcagcgacgacatcagacagatccagagcctggagaacggcatcctgttcctgaccaagaacaacctgaagtacatggccagaggcggcctgatcatcttcgactacctgctggacgagaacgaggacatgcacagcctgctgctgaccgacagcagcaccctgctggtgggcggcctgcagaaccacatcatcgagatcgacctgaacaccgtgcaggagacccagaagtacgccgtggagacccccggcgtgaccatcatgagacagaccaacagattcttcttctgcggccacaccagcggcaaggtgagcctgagagacctgagaaccttcaaggtggagcacgagttcgacgccttcagcggcagcctgagcgacttcgacgtgcacggcaacctgctggccgcctgcggcttcagcagcagactgaccggcctggcctgcgacagattcctgaaggtgtacgacctgagaatgatgagagccatcacccccctgcaggtgcacgtggaccccgccttcctgagattcatccccacctacaccagcagactggccatcatcagccagagcggccagtgccagttctgcgagcccaccggcctggccaaccccgccgacatcttccacgtgaaccccgtgggccccctgctgatgaccttcgacgtgagcgccagcaagcaggccctggccttcggcgacagcgagggctgcgtgcacctgtggaccgacagccccgagcccagcttcaacccctacagcagagagaccgagttcgccctgccctgcctggtggacagcctgccccccctggactggagccaggacctgctgcccctgagcctgatccccgtgcccctgaccaccgacaccctgctgagcgactggcccgccgccaacagcgcccccgcccccagaagagccccccccgtggacgccgagatcctgagaaccatgaagaaggtgggcttcatcggctacgcccccaaccccagaaccagactgagaaaccagatcccctacagactgaaggagagcgacagcgagttcgacagcttcagccaggtgaccgagagccccgtgggcagagaggaggagccccacctgcacatggtgagcaagaagtacagaaaggtgaccatcaagtacagcaagctgggcctggaggacttcgacttcaagcactacaacaagaccctgttcgccggcctggagccccacatccccaacgcctactgcaactgcatgatccaggtgctgtacttcctggagcccgtgagatgcctgatccagaaccacctgtgccagaaggagttctgcctggcctgcgagctgggcttcctgttccacatgctggacctgagcagaggcgacccctgccagggcaacaacttcctgagagccttcagaaccatccccgaggccagcgccctgggcctgatcctggccgacagcgacgaggccagcggcaagggcaacctggccagactgatccagagatggaacagattcatcctgacccagctgcaccaggacatgcaggagctggagatcccccaggcctacagaggcgccggcggcagcagcttctgcagcagcggcgacagcgtgatcggccagctgttcagctgcgagatggagaactgcagcctgtgcagatgcggcagcgagaccgtgagagccagcagcaccctgctgttcaccctgagctaccccgacggcagcaagagcgacaagaccggcaagaactacgacttcgcccaggtgctgaagagaagcatctgcctggaccagaacacccaggcctggtgcgacacctgcgagaagtaccagcccaccatccagaccagaaacatcagacacctgcccgacatcctggtgatcaactgcgaggtgaacagcagcaaggaggccgacttctggagaatgcaggccgaggtggccttcaagatggccgtgaagaagcacggcggcgagatcagcaagaacaaggagttcgccctggccgactggaaggagctgggcagccccgagggcgtgctggtgtgccccagcatcgaggagctgaagaacgtgtggctgcccttcagcatcagaatgaagatgaccaagaacaagggcctggacgtgtgcaactggaccgacggcgacgagatgcagtggggccccgccagagccgaggaggagcacggcgtgtacgtgtacgacctgatggccaccgtggtgcacatcctggacagcagaaccggcggcagcctggtggcccacatcaaggtgggcgagacctaccaccagagaaaggagggcgtgacccaccagcagtggtacctgttcaacgacttcctgatcgagcccatcgacaagcacgaggccgtgcagttcgacatgaactggaaggtgcccgccatcctgtactacgtgaagagaaacctgaacagcagatacaacctgaacatcaagaaccccatcgaggccagcgtgctgctggccgaggccagcctggccagaaagcagagaaagacccacaccaccttcatccccctgatgctgaacgagatgccccagatcggcgacctggtgggcctggacgccgagttcgtgaccctgaacgaggaggaggccgagctgagaagcgacggcaccaagagcaccatcaagcccagccagatgagcgtggccagaatcacctgcgtgagaggccagggccccaacgagggcatccccttcatcgacgactacatcagcacccaggagcaggtggtggactacctgacccagtacagcggcatcaagcccggcgacctggacgccaagatcagcagcaagcacctgaccaccctgaagagcacctacctgaagctgagattcctgatcgacatcggcgtgaagttcgtgggccacggcctgcagaaggacttcagagtgatcaacctgatggtgcccaaggaccaggtgctggacaccgtgtacctgttccacatgcccagaaagagaatgatcagcctgagattcctggcctggtacttcctggacctgaagatccagggcgagacccacgacagcatcgaggacgccagaaccgccctgcagctgtacagaaagtacctggagctgagcaagaacggcaccgagcccgagagcttccacaaggtgctgaagggcctgtacgagaagggcagaaagatggactggaaggtgcccgagcccgagggccagaccagccccaagaacgccgccgtgttcagcagcgtgctggccctgtag

SEQ ID NO: 92435 - DNA, 3597 bp, Artificial Sequence
  Description of Artificial Sequence: Synthetic coding sequence
atgaacttcgagggcctggaccccggcctggccgagtacgcccccgccatgcacagcgccctggaccccgtgctggacgcccacctgaaccccagcctgctgcagaacgtggagctggaccccgagggcgtggccctggaggccctgcccgtgcaggagagcgtgcacatcatggagggcgtgtacagcgagctgcacagcgtggtggccgaggtgggcgtgcccgtgagcgtgagccacttcgacctgcacgaggagatgctgtgggtgggcagccacggcggccacgccaccagcttcttcggccccgccctggagagatacagcagcttccaggtgaacggcagcgacgacatcagacagatccagagcctggagaacggcatcctgttcctgaccaagaacaacctgaagtacatggccagaggcggcctgatcatcttcgactacctgctggacgagaacgaggacatgcacagcctgctgctgaccgacagcagcaccctgctggtgggcggcctgcagaaccacatcatcgagatcgacctgaacaccgtgcaggagacccagaagtacgccgtggagacccccggcgtgaccatcatgagacagaccaacagattcttcttctgcggccacaccagcggcaaggtgagcctgagagacctgagaaccttcaaggtggagcacgagttcgacgccttcagcggcagcctgagcgacttcgacgtgcacggcaacctgctggccgcctgcggcttcagcagcagactgaccggcctggcctgcgacagattcctgaaggtgtacgacctgagaatgatgagagccatcacccccctgcaggtgcacgtggaccccgccttcctgagattcatccccacctacaccagcagactggccatcatcagccagagcggccagtgccagttctgcgagcccaccggcctggccaaccccgccgacatcttccacgtgaaccccgtgggccccctgctgatgaccttcgacgtgagcgccagcaagcaggccctggccttcggcgacagcgagggctgcgtgcacctgtggaccgacagccccgagcccagcttcaacccctacagcagagagaccgagttcgccctgccctgcctggtggacagcctgccccccctggactggagccaggacctgctgcccctgagcctgatccccgtgcccctgaccaccgacaccctgctgagcgactggcccgccgccaacagcgcccccgcccccagaagagccccccccgtggacgccgagatcctgagaaccatgaagaaggtgggcttcatcggctacgcccccaaccccagaaccagactgagaaaccagatcccctacagactgaaggagagcgacagcgagttcgacagcttcagccaggtgaccgagagccccgtgggcagagaggaggagccccacctgcacatggtgagcaagaagtacagaaaggtgaccatcaagtacagcaagctgggcctggaggacttcgacttcaagcactacaacaagaccctgttcgccggcctggagccccacatccccaacgcctactgcaactgcatgatccaggtgctgtacttcctggagcccgtgagatgcctgatccagaaccacctgtgccagaaggagttctgcctggcctgcgagctgggcttcctgttccacatgctggacctgagcagaggcgacccctgccagggcaacaacttcctgagagccttcagaaccatccccgaggccagcgccctgggcctgatcctggccgacagcgacgaggccagcggcaagggcaacctggccagactgatccagagatggaacagattcatcctgacccagctgcaccaggacatgcaggagctggagatcccccaggcctacagaggcgccggcggcagcagcttctgcagcagcggcgacagcgtgatcggccagctgttcagctgcgagatggagaactgcagcctgtgcagatgcggcagcgagaccgtgagagccagcagcaccctgctgttcaccctgagctaccccgacgacaagaccggcaagaactacgacttcgcccaggtgctgaagagaagcatctgcctggaccagaacacccaggcctggtgcgacacctgcgagaagtaccagcccaccatccagaccagaaacatcagacacctgcccgacatcctggtgatcaactgcgaggtgaacagcagcaaggaggccgacttctggagaatgcaggccgaggtggccttcaagatggccgtgaagaagcacggcggcgagatcagcaagaacaaggagttcgccctggccgactggaaggagctgggcagccccgagggcgtgctggtgtgccccagcatcgaggagctgaagaacgtgtggctgcccttcagcatcagaatgaagatgaccaagaacaagggcctggacgtgtgcaactggaccgacggcgacgagatgcagtggggccccgccagagccgaggaggagcacggcgtgtacgtgtacgacctgatggccaccgtggtgcacatcctggacagcagaaccggcggcagcctggtggcccacatcaaggtgggcgagacctaccaccagagaaaggagggcgtgacccaccagcagtggtacctgttcaacgacttcctgatcgagcccatcgacaagcacgaggccgtgcagttcgacatgaactggaaggtgcccgccatcctgtactacgtgaagagaaacctgaacagcagatacaacctgaacatcaagaaccccatcgaggccagcgtgctgctggccgaggccagcctggccagaaagcagagaaagacccacaccaccttcatccccctgatgctgaacgagatgccccagatcggcgacctggtgggcctggacgccgagttcgtgaccctgaacgaggaggaggccgagctgagaagcgacggcaccaagagcaccatcaagcccagccagatgagcgtggccagaatcacctgcgtgagaggccagggccccaacgagggcatccccttcatcgacgactacatcagcacccaggagcaggtggtggactacctgacccagtacagcggcatcaagcccggcgacctggacgccaagatcagcagcaagcacctgaccaccctgaagagcacctacctgaagctgagattcctgatcgacatcggcgtgaagttcgtgggccacggcctgcagaaggacttcagagtgatcaacctgatggtgcccaaggaccaggtgctggacaccgtgtacctgttccacatgcccagaaagagaatgatcagcctgagattcctggcctggtacttcctggacctgaagatccagggcgagacccacgacagcatcgaggacgccagaaccgccctgcagctgtacagaaagtacctggagctgagcaagaacggcaccgagcccgagagcttccacaaggtgctgaagggcctgtacgagaagggcagaaagatggactggaaggtgcccgagcccgagggccagaccagccccaagaacgccgccgtgttcagcagcgtgctggccctgtag

SEQ ID NO: 92436 - DNA, 3609 bp, Artificial Sequence; identical to SEQ ID NO: 92434
  Description of Artificial Sequence: Synthetic coding sequence

SEQ ID NO: 92437 - DNA, 987 bp, Artificial Sequence
  Description of Artificial Sequence: Synthetic coding sequence
atggacgccgtgctgctggagcacttccccggcggcctggacgccttccccagcagctacttcgacgaggacgacttcttcaccgaccagagcagcagagaccccctggaggacggcgacgagctgctggccgacgagcaggccgaggtggagttcctgagccaccagctgcacgagtactgctacagagacggcgcctgcctgctgctgcagcccgccccccccgccgcccccctggccctggccccccccagcagcggcggcctgggcgagcccgacgacggcggcggcggcggctactgctgcgagaccggcgccccccccggcggcttcccctacagccccggcagcccccccagctgcctggcctacccctgcgccggcgccgccgtgctgagccccggcgccagactgagaggcctgagcggcgccgccgccgccgccgccagaagaagaagaagagtgagaagcgaggccgagctgcagcagctgagacaggccgccaacgtgagagagagaagaagaatgcagagcatcaacgacgccttcgagggcctgagaagccacatccccaccctgccctacgagaagagactgagcaaggtggacaccctgagactggccatcggctacatcaacttcctgagcgagctggtgcaggccgacctgcccctgagaggcggcggcgccggcggctgcggcggccccggcggcggcggcagactgggcggcgacagccccggcagccaggcccagaaggtgatcatctgccacagaggcaccagaagccccagccccagcgaccccgactacggcctgccccccctggccggccacagcctgagctggaccgacgagaagcagctgaaggagcagaacatcatcagaaccgccaaggtgtggacccccgaggaccccagaaagctgaacagcaagagcagcttcaacaacatcgagaacgagccccccttcgagttcgtgagctag

SEQ ID NO: 92438 - DNA, 852 bp, Artificial Sequence
  Description of Artificial Sequence: Synthetic coding sequence
atgaacggcgaggagcagtactacgccgccacccagctgtacaaggacccctgcgccttccagagaggccccgcccccgagttcagcgccagcccccccgcctgcctgtacatgggcagacagcccccccccccccccccccaccccttccccggcgccctgggcgccctggagcagggcagcccccccgacatcagcccctacgaggtgccccccctggccgacgaccccgccgtggcccacctgcaccaccacctgcccgcccagctggccctgccccacccccccgccggccccttccccgagggcgccgagcccggcgtgctggaggagcccaacagagtgcagctgcccttcccctggatgaagagcaccaaggcccacgcctggaagggccagtgggccggcggcgcctacgccgccgagcccgaggagaacaagagaaccagaaccgcctacaccagagcccagctgctggagctggagaaggagttcctgttcaacaagtacatcagcagacccagaagagtggagctggccgtgatgctgaacctgaccgagagacacatcaagatctggttccagaacagaagaatgaagtggaagaaggaggaggacaagaagagaggcggcggcaccgccgtgggcggcggcggcgtggccgagcccgagcaggactgcgccgtgaccagcggcgaggagctgctggccctgccccccccccccccccccggcggcgccgtgccccccgccgcccccgtggccgccagagagggcagactgccccccggcctgagcgccagcccccagcccagcagcgtggcccccagaagaccccaggagcccagatag

SEQ ID NO: 92439 - DNA, 1398 bp, Artificial Sequence
  Description of Artificial Sequence: Synthetic coding sequence
atgctgcccctgtggaccctgagcctgctgctgggcgccgtggccggcaaggaggtgtgctacgagagactgggctgcttcagcgacgacagcccctggagcggcatcaccgagagacccctgcacatcctgccctggagccccaaggacgtgaacaccagattcctgctgtacaccaacgagaaccccaacaacttccaggaggtggccgccgacagcagcagcatcagcggcagcaacttcaagaccaacagaaagaccagattcatcatccacggcttcatcgacaagggcgaggagaactggctggccaacgtgtgcaagaacctgttcaaggtggagagcgtgaactgcatctgcgtggactggaagggcggcagcagaaccggctacacccaggccagccagaacatcagaatcgtgggcgccgaggtggcctacttcgtggagttcctgcagagcgccttcggctacagccccagcaacgtgcacgtgatcggccacagcctgggcgcccacgccgccggcgaggccggcagaagaaccaacggcaccatcggcagaatcaccggcctggaccccgccgagccctgcttccagggcacccccgagctggtgagactggaccccagcgacgccaagttcgtggacgtgatccacaccgacggcgcccccatcgtgcccaacctgggcttcggcatgagccaggtggtgggccacctggacttcttccccaacggcggcgtggagatgcccggctgcaagaagaacatcctgagccagatcgtggacatcgacggcatctgggagggcaccagagacttcgccgcctgcaaccacctgagaagctacaagtactacaccgacagcatcgtgaaccccgacggcttcgccggcttcccctgcgccagctacaacgtgttcaccgccaacaagtgcttcccctgccccagcggcggctgcccccagatgggccactacgccgacagataccccggcaagaccaacgacgtgggccagaagttctacctggacaccggcgacgccagcaacttcgccagatggagatacaaggtgagcgtgaccctgagcggcaagaaggtgaccggccacatcctggtgagcctgttcggcaacaagggcaacagcaagcagtacgagatcttcaagggcaccctgaagcccgacagcacccacagcaacgagttcgacagcgacgtggacgtgggcgacctgcagatggtgaagttcatctggtacaacaacgtgatcaaccccaccctgcccagagtgggcgccagcaagatcatcgtggagaccaacgtgggcaagcagttcaacttctgcagccccgagaccgtgagagaggaggtgctgctgaccctgaccccctgctag

SEQ ID NO: 92440 - DNA, 3372 bp, Artificial Sequence
  Description of Artificial Sequence: Synthetic coding sequence
atgaacagccccaacgagagcgccgacggcatgagcggcagagagcccagcctggagatcctgcccagaaccagcctgcacagcatccccgtgaccgtggaggtgaagcccgtgctgcccagagccatgcccagcagcatgggcggcggcggcggcggcagccccagccccgtggagctgagaggcgccctggtgggcagcgtggaccccaccctgagagagcagcagctgcagcaggagctgctggccctgaagcagcagcagcagctgcagaagcagctgctgttcgccgagttccagaagcagcacgaccacctgaccagacagcacgaggtgcagctgcagaagcacctgaagcagcagcaggagatgctggccgccaagcagcagcaggagatgctggccgccaagagacagcaggagctggagcagcagagacagagagagcagcagagacaggaggagctggagaagcagagactggagcagcagctgctgatcctgagaaacaaggagaagagcaaggagagcgccatcgccagcaccgaggtgaagctgagactgcaggagttcctgctgagcaagagcaaggagcccacccccggcggcctgaaccacagcctgccccagcaccccaagtgctggggcgcccaccacgccagcctggaccagagcagccccccccagagcggcccccccggcaccccccccagctacaagctgcccctgcccggcccctacgacagcagagacgacttccccctgagaaagaccgccagcgagcccaacctgaaggtgagaagcagactgaagcagaaggtggccgagagaagaagcagccccctgctgagaagaaaggacggcaccgtgatcagcaccttcaagaagagagccgtggagatcaccggcgccggccccggcgccagcagcgtgtgcaacagcgcccccggcagcggccccagcagccccaacagcagccacagcaccatcgccgagaacggcttcaccggcagcgtgcccaacatccccaccgagatgctgccccagcacagagccctgcccctggacagcagccccaaccagttcagcctgtacaccagccccagcctgcccaacatcagcctgggcctgcaggccaccgtgaccgtgaccaacagccacctgaccgccagccccaagctgagcacccagcaggaggccgagagacaggccctgcagagcctgagacagggcggcaccctgaccggcaagttcatgagcaccagcagcatccccggctgcctgctgggcgtggccctggagggcgacggcagcccccacggccacgccagcctgctgcagcacgtgctgctgctggagcaggccagacagcagagcaccctgatcgccgtgcccctgcacggccagagccccctggtgaccggcgagagagtggccaccagcatgagaaccgtgggcaagctgcccagacacagacccctgagcagaacccagagcagccccctgccccagagcccccaggccctgcagcagctggtgatgcagcagcagcaccagcagttcctggagaagcagaagcagcagcagctgcagctgggcaagatcctgaccaagaccggcgagctgcccagacagcccaccacccaccccgaggagaccgaggaggagctgaccgagcagcaggaggtgctgctgggcgagggcgccctgaccatgcccagagagggcagcaccgagagcgagagcacccaggaggacctggaggaggaggacgaggaggacgacggcgaggaggaggaggactgcatccaggtgaaggacgaggagggcgagagcggcgccgaggagggccccgacctggaggagcccggcgccggctacaagaagctgttcagcgacgcccagcccctgcagcccctgcaggtgtaccaggcccccctgagcctggccaccgtgccccaccaggccctgggcagaacccagagcagccccgccgcccccggcggcatgaagagcccccccgaccagcccgtgaagcacctgttcaccaccggcgtggtgtacgacaccttcatgctgaagcaccagtgcatgtgcggcaacacccacgtgcaccccgagcacgccggcagaatccagagcatctggagcagactgcaggagaccggcctgctgagcaagtgcgagagaatcagaggcagaaaggccaccctggacgagatccagaccgtgcacagcgagtaccacaccctgctgtacggcaccagccccctgaacagacagaagctggacagcaagaagctgctgggccccatcagccagaagatgtacgccgtgctgccctgcggcggcatcggcgtggacagcgacaccgtgtggaacgagatgcacagcagcagcgccgtgagaatggccgtgggctgcctgctggagctggccttcaaggtggccgccggcgagctgaagaacggcttcgccatcatcagaccccccggccaccacgccgaggagagcaccgccatgggcttctgcttcttcaacagcgtggccatcaccgccaagctgctgcagcagaagctgaacgtgggcaaggtgctgatcgtggactgggacatccaccacggcaacggcacccagcaggccttctacaacgaccccagcgtgctgtacatcagcctgcacagatacgacaacggcaacttcttccccggcagcggcgcccccgaggaggtgggcggcggccccggcgtgggctacaacgtgaacgtggcctggaccggcggcgtggacccccccatcggcgacgtggagtacctgaccgccttcagaaccgtggtgatgcccatcgcccacgagttcagccccgacgtggtgctggtgagcgccggcttcgacgccgtggagggccacctgagccccctgggcggctacagcgtgaccgccagatgcttcggccacctgaccagacagctgatgaccctggccggcggcagagtggtgctggccctggagggcggccacgacctgaccgccatctgcgacgccagcgaggcctgcgtgagcgccctgctgagcgtggagctgcagcccctggacgaggccgtgctgcagcagaagcccaacatcaacgccgtggccaccctggagaaggtgatcgagatccagagcaagcactggagctgcgtgcagaagttcgccgccggcctgggcagaagcctgagagaggcccaggccggcgagaccgaggaggccgagaccgtgagcgccatggccctgctgagcgtgggcgccgagcaggcccaggccgccgccgccagagagcacagccccagacccgccgaggagcccatggagcaggagcccgccctgtag

SEQ ID NO: 92441 - DNA, 1128 bp, Artificial Sequence
  Description of Artificial Sequence: Synthetic coding sequence
atgaacaccagccacctgctggccctgctgctgcccaagagcccccagggcgagaacagaagcaagcccctgggcaccccctacaacttcagcgagcactgccaggacagcgtggacgtgatggtgttcatcgtgaccagctacagcatcgagaccgtggtgggcgtgctgggcaacctgtgcctgatgtgcgtgaccgtgagacagaaggagaaggccaacgtgaccaacctgctgatcgccaacctggccttcagcgacttcctgatgtgcctgctgtgccagcccctgaccgccgtgtacaccatcatggactactggatcttcggcgagaccctgtgcaagatgagcgccttcatccagtgcatgagcgtgaccgtgagcatcctgagcctggtgctggtggccctggagagacaccagctgatcatcaaccccaccggctggaagcccagcatcagccaggcctacctgggcatcgtgctgatctgggtgatcgcctgcgtgctgagcctgcccttcctggccaacagcatcctggagaacgtgttccacaagaaccacagcaaggccctggagttcctggccgacaaggtggtgtgcaccgagagctggcccctggcccaccacagaaccatctacaccaccttcctgctgctgttccagtactgcctgcccctgggcttcatcctggtgtgctacgccagaatctacagaagactgcagagacagggcagagtgttccacaagggcacctacagcctgagagccggccacatgaagcaggtgaacgtggtgctggtggtgatggtggtggccttcgccgtgctgtggctgcccctgcacgtgttcaacagcctggaggactggcaccacgaggccatccccatctgccacggcaacctgatcttcctggtgtgccacctgctggccatggccagcacctgcgtgaaccccttcatctacggcttcctgaacaccaacttcaagaaggagatcaaggccctggtgctgacctgccagcagagcgcccccctggaggagagcgagcacctgcccctgagcaccgtgcacaccgaggtgagcaagggcagcctgagactgagcggcagaagcaaccccatctag

SEQ ID NO: 92442 - DNA, 1128 bp, Artificial Sequence; identical to SEQ ID NO: 92441
  Description of Artificial Sequence: Synthetic coding sequence

SEQ ID NO: 92443 - DNA, 1797 bp, Artificial Sequence
  Description of Artificial Sequence: Synthetic coding sequence
atgctgaagctggtgggcggcggcggcggccaggactgggcctgcagcgtggccggcaccagcctgggcggcgaggaggccgccttcgaggtggccagacccggcgaccagggcaaggccggcggcggcagccccggctggggctgcgccggcatccccgacagcgcccccggcgccggcgtgctgcaggccggcgccgtgggccccgccagaggcggccagggcgccgaggaggtgggcgagagcgccggcggcggcgaggagagaagagtgagacacccccaggcccccgccctgagactgctgaacagaaagccccagggcggcagcggcgagatcaagacccccgagaacgacctgcagagaggcagactgagcagaggccccagaaccgccccccccgcccccggcatgggcgacagaagcggccagcaggagagaagcgtgccccacagccccggcgcccccgtgggcaccagcgccgccgccgtgaacggcctgctgcacaacggcttccaccccccccccgtgcagcccccccacgtgtgcagcagaggccccgtgggcggcagcgacgccgccccccagagactgcccctgctgcccgagctgcagccccagcccctgctgccccagcacgacagccccgccaagaagtgcagactgagaagaagaatggacagcggcagaaagaacagaccccccttcccctggttcggcatggacatcggcggcaccctggtgaagctggtgtacttcgagcccaaggacatcaccgccgaggaggagcaggaggaggtggagaacctgaagagcatcagaaagtacctgaccagcaacaccgcctacggcaagaccggcatcagagacgtgcacctggagctgaagaacctgaccatgtgcggcagaaagggcaacctgcacttcatcagattccccagctgcgccatgcacagattcatccagatgggcagcgagaagaacttcagcagcctgcacaccaccctgtgcgccaccggcggcggcgccttcaagttcgaggaggacttcagaatgatcgccgacctgcagctgcacaagctggacgagctggactgcctgatccagggcctgctgtacgtggacagcgtgggcttcaacggcaagcccgagtgctactacttcgagaaccccaccaaccccgagctgtgccagaagaagccctactgcctggacaacccctaccccatgctgctggtgaacatgggcagcggcgtgagcatcctggccgtgtacagcaaggacaactacaagagagtgaccggcaccagcctgggcggcggcaccttcctgggcctgtgctgcctgctgaccggctgcgagaccttcgaggaggccctggagatggccgccaagggcgacagcaccaacgtggacaagctggtgaaggacatctacggcggcgactacgagagattcggcctgcagggcagcgccgtggccagcagcttcggcaacatgatgagcaaggagaagagagacagcatcagcaaggaggacctggccagagccaccctggtgaccatcaccaacaacatcggcagcatcgccagaatgtgcgccctgaacgagaacatcgacagagtggtgttcgtgggcaacttcctgagaatcaacatggtgagcatgaagctgctggcctacgccatggacttctggagcaagggccagctgaaggccctgttcctggagcacgagggctacttcggcgccgtgggcgccctgctggagctgttcaagatgaccgacgacaagtag

SEQ ID NO: 92444 - DNA, 945 bp, Artificial Sequence
  Description of Artificial Sequence: Synthetic coding sequence
atgaagctgatcaacggcaagaagcagaccttcccctggttcggcatggacatcggcggcaccctggtgaagctggtgtacttcgagcccaaggacatcaccgccgaggaggagcaggaggaggtggagaacctgaagagcatcagaaagtacctgaccagcaacaccgcctacggcaagaccggcatcagagacgtgcacctggagctgaagaacctgaccatgtgcggcagaaagggcaacctgcacttcatcagattccccagctgcgccatgcacagattcatccagatgggcagcgagaagaacttcagcagcctgcacaccaccctgtgcgccaccggcggcggcgccttcaagttcgaggaggacttcagaatgatcgccgacctgcagctgcacaagctggacgagctggactgcctgatccagggcctgctgtacgtggacagcgtgggcttcaacggcaagcccgagtgctactacttcgagaaccccaccaaccccgagctgtgccagaagaagccctactgcctggacaacccctaccccatgctgctggtgaacatgggcagcggcgtgagcatcctggccgtgtacagcaaggacaactacaagagagtgaccggcaccagcttcggcaacatgatgagcaaggagaagagagacagcatcagcaaggaggacctggccagagccaccctggtgaccatcaccaacaacatcggcagcatcgccagaatgtgcgccctgaacgagaacatcgacagagtggtgttcgtgggcaacttcctgagaatcaacatggtgagcatgaagctgctggcctacgccatggacttctggagcaagggccagctgaaggccctgttcctggagcacgagggctacttcggcgccgtgggcgccctgctggagctgttcaagatgaccgacgacaagtag

SEQ ID NO: 92445 - DNA, 1122 bp, Artificial Sequence
  Description of Artificial Sequence: Synthetic coding sequence
atgaagctgatcaacggcaagaagcagaccttcccctggttcggcatggacatcggcggcaccctggtgaagctggtgtacttcgagcccaaggacatcaccgccgaggaggagcaggaggaggtggagaacctgaagagcatcagaaagtacctgaccagcaacaccgcctacggcaagaccggcatcagagacgtgcacctggagctgaagaacctgaccatgtgcggcagaaagggcaacctgcacttcatcagattccccagctgcgccatgcacagattcatccagatgggcagcgagaagaacttcagcagcctgcacaccaccctgtgcgccaccggcggcggcgccttcaagttcgaggaggacttcagaatgatcgccgacctgcagctgcacaagctggacgagctggactgcctgatccagggcctgctgtacgtggacagcgtgggcttcaacggcaagcccgagtgctactacttcgagaaccccaccaaccccgagctgtgccagaagaagccctactgcctggacaacccctaccccatgctgctggtgaacatgggcagcggcgtgagcatcctggccgtgtacagcaaggacaactacaagagagtgaccggcaccagcctgggcggcggcaccttcctgggcctgtgctgcctgctgaccggctgcgagaccttcgaggaggccctggagatggccgccaagggcgacagcaccaacgtggacaagctggtgaaggacatctacggcggcgactacgagagattcggcctgcagggcagcgccgtggccagcagcttcggcaacatgatgagcaaggagaagagagacagcatcagcaaggaggacctggccagagccaccctggtgaccatcaccaacaacatcggcagcatcgccagaatgtgcgccctgaacgagaacatcgacagagtggtgttcgtgggcaacttcctgagaatcaacatggtgagcatgaagctgctggcctacgccatggacttctggagcaagggccagctgaaggccctgttcctggagcacgagggctacttcggcgccgtgggcgccctgctggagctgttcaagatgaccgacgacaagtag

SEQ ID NO: 92446 - DNA, 1203 bp, Artificial Sequence
  Description of Artificial Sequence: Synthetic coding sequence
atggccaagagcaagcacgccctgctgcccttctgccacggcatgatgcagcaggagggcctgcaccagatgcagagcctggacctgggcctgctgagcctgcagaacagcttcccctggttcggcatggacatcggcggcaccctggtgaagctggtgtacttcgagcccaaggacatcaccgccgaggaggagcaggaggaggtggagaacctgaagagcatcagaaagtacctgaccagcaacaccgcctacggcaagaccggcatcagagacgtgcacctggagctgaagaacctgaccatgtgcggcagaaagggcaacctgcacttcatcagattccccagctgcgccatgcacagattcatccagatgggcagcgagaagaacttcagcagcctgcacaccaccctgtgcgccaccggcggcggcgccttcaagttcgaggaggacttcagaatgatcgccgacctgcagctgcacaagctggacgagctggactgcctgatccagggcctgctgtacgtggacagcgtgggcttcaacggcaagcccgagtgctactacttcgagaaccccaccaaccccgagctgtgccagaagaagccctactgcctggacaacccctaccccatgctgctggtgaacatgggcagcggcgtgagcatcctggccgtgtacagcaaggacaactacaagagagtgaccggcaccagcctgggcggcggcaccttcctgggcctgtgctgcctgctgaccggctgcgagaccttcgaggaggccctggagatggccgccaagggcgacagcaccaacgtggacaagctggtgaaggacatctacggcggcgactacgagagattcggcctgcagggcagcgccgtggccagcagcttcggcaacatgatgagcaaggagaagagagacagcatcagcaaggaggacctggccagagccaccctggtgaccatcaccaacaacatcggcagcatcgccagaatgtgcgccctgaacgagaacatcgacagagtggtgttcgtgggcaacttcctgagaatcaacatggtgagcatgaagctgctggcctacgccatggacttctggagcaagggccagctgaaggccctgttcctggagcacgagggctacttcggcgccgtgggcgccctgctggagctgttcaagatgaccgacgacaagtag

SEQ ID NO: 92447 - DNA, 1386 bp, Artificial Sequence
  Description of Artificial Sequence: Synthetic coding sequence
atgggcgacagaagcggccagcaggagagaagcgtgccccacagccccggcgcccccgtgggcaccagcgccgccgccgtgaacggcctgctgcacaacggcttccaccccccccccgtgcagcccccccacgtgtgcagcagaggccccgtgggcggcagcgacgccgccccccagagactgcccctgctgcccgagctgcagccccagcccctgctgccccagcacgacagccccgccaagaagtgcagactgagaagaagaatggacagcggcagaaagaacagaccccccttcccctggttcggcatggacatcggcggcaccctggtgaagctggtgtacttcgagcccaaggacatcaccgccgaggaggagcaggaggaggtggagaacctgaagagcatcagaaagtacctgaccagcaacaccgcctacggcaagaccggcatcagagacgtgcacctggagctgaagaacctgaccatgtgcggcagaaagggcaacctgcacttcatcagattccccagctgcgccatgcacagattcatccagatgggcagcgagaagaacttcagcagcctgcacaccaccctgtgcgccaccggcggcggcgccttcaagttcgaggaggacttcagaatgatcgccgacctgcagctgcacaagctggacgagctggactgcctgatccagggcctgctgtacgtggacagcgtgggcttcaacggcaagcccgagtgctactacttcgagaaccccaccaaccccgagctgtgccagaagaagccctactgcctggacaacccctaccccatgctgctggtgaacatgggcagcggcgtgagcatcctggccgtgtacagcaaggacaactacaagagagtgaccggcaccagcctgggcggcggcaccttcctgggcctgtgctgcctgctgaccggctgcgagaccttcgaggaggccctggagatggccgccaagggcgacagcaccaacgtggacaagctggtgaaggacatctacggcggcgactacgagagattcggcctgcagggcagcgccgtggccagcagcttcggcaacatgatgagcaaggagaagagagacagcatcagcaaggaggacctggccagagccaccctggtgaccatcaccaacaacatcggcagcatcgccagaatgtgcgccctgaacgagaacatcgacagagtggtgttcgtgggcaacttcctgagaatcaacatggtgagcatgaagctgctggcctacgccatggacttctggagcaagggccagctgaaggccctgttcctggagcacgagggctacttcggcgccgtgggcgccctgctggagctgttcaagatgaccgacgacaagtag

SEQ ID NO: 92448 - DNA, 1713 bp, Artificial Sequence
  Description of Artificial Sequence: Synthetic coding sequence
atgagaagactgggccccttccaccccagagtgcactgggccgccccccccagcctgagcagcggcctgcacagactgctgttcctgagaggcaccagaatccccagcagcaccaccctgagcccccccagacacgacagcctgagcctggacggcggcaccgtgaacccccccagagtgagagagcccaccggcagagaggccttcggccccagccccgccagcagcgactggctgcccgccagatggagaaacggcagaggcggcagacccagagccagactgtgcagcggctggaccgccgccgaggaggccagaagaaaccccaccctgggcggcctgctgggcagacagagactgctgctgagaatgggcggcggcagactgggcgcccccatggagagacacggcagagccagcgccaccagcgtgagcagcgccggcgagcaggccgccggcgaccccgagggcagaagacaggagcccctgagaagaagagccagcagcgccagcgtgcccgccgtgggcgccagcgccgagggcaccagaagagacagactgggcagctacagcggccccaccagcgtgagcagacagagagtggagagcctgagaaagaagagacccctgttcccctggttcggcctggacatcggcggcaccctggtgaagctggtgtacttcgagcccaaggacatcaccgccgaggaggaggaggaggaggtggagagcctgaagagcatcagaaagtacctgaccagcaacgtggcctacggcagcaccggcatcagagacgtgcacctggagctgaaggacctgaccctgtgcggcagaaagggcaacctgcacttcatcagattccccacccacgacatgcccgccttcatccagatgggcagagacaagaacttcagcagcctgcacaccgtgttctgcgccaccggcggcggcgcctacaagttcgagcaggacttcctgaccatcggcgacctgcagctgtgcaagctggacgagctggactgcctgatcaagggcatcctgtacatcgacagcgtgggcttcaacggcagaagccagtgctactacttcgagaaccccgccgacagcgagaagtgccagaagctgcccttcgacctgaagaacccctaccccctgctgctggtgaacatcggcagcggcgtgagcatcctggccgtgtacagcaaggacaactacaagagagtgaccggcaccagcctgggcggcggcaccttcttcggcctgtgctgcctgctgaccggctgcaccaccttcgaggaggccctggagatggccagcagaggcgacagcaccaaggtggacaagctggtgagagacatctacggcggcgactacgagagattcggcctgcccggctgggccgtggccagcagcttcggcaacatgatgagcaaggagaagagagaggccgtgagcaaggaggacctggccagagccaccctgatcaccatcaccaacaacatcggcagcatcgccagaatgtgcgccctgaacgagaacatcaaccaggtggtgttcgtgggcaacttcctgagaatcaacaccatcgccatgagactgctggcctacgccctggactactggagcaagggccagctgaaggccctgttcagcgagcacgagggctacttcggcgccgtgggcgccctgctggagctgctgaagatcccctag

SEQ ID NO: 92449 - DNA, 1161 bp, Artificial Sequence
  Description of Artificial Sequence: Synthetic coding sequence
agcggcagagtgaaccccgccggcggcctgggctgcagcgagagcggcaccttcggcggcccccccgcccccatcgtgttcccctggttcggcctggacatcggcggcaccctggtgaagctggtgtacttcgagcccaaggacatcaccgccgaggaggaggaggaggaggtggagagcctgaagagcatcagaaagtacctgaccagcaacgtggcctacggcagcaccggcatcagagacgtgcacctggagctgaaggacctgaccctgtgcggcagaaagggcaacctgcacttcatcagattccccacccacgacatgcccgccttcatccagatgggcagagacaagaacttcagcagcctgcacaccgtgttctgcgccaccggcggcggcgcctacaagttcgagcaggacttcctgaccatcggcgacctgcagctgtgcaagctggacgagctggactgcctgatcaagggcatcctgtacatcgacagcgtgggcttcaacggcagaagccagtgctactacttcgagaaccccgccgacagcgagaagtgccagaagctgcccttcgacctgaagaacccctaccccctgctgctggtgaacatcggcagcggcgtgagcatcctggccgtgtacagcaaggacaactacaagagagtgaccggcaccagcctgggcggcggcaccttcttcggcctgtgctgcctgctgaccggctgcaccaccttcgaggaggccctggagatggccagcagaggcgacagcaccaaggtggacaagctggtgagagacatctacggcggcgactacgagagattcggcctgcccggctgggccgtggccagcagcttcggcaacatgatgagcaaggagaagagagaggccgtgagcaaggaggacctggccagagccaccctgatcaccatcaccaacaacatcggcagcatcgccagaatgtgcgccctgaacgagaacatcaaccaggtggtgttcgtgggcaacttcctgagaatcaacaccatcgccatgagactgctggcctacgccctggactactggagcaagggccagctgaaggccctgttcagcgagcacgagggctacttcggcgccgtgggcgccctgctggagctgctgaagatcccctag

SEQ ID NO: 92450 - DNA, 840 bp, Artificial Sequence
  Description of Artificial Sequence: Synthetic coding sequence
atgcccgccttcatccagatgggcagagacaagaacttcagcagcctgcacaccgtgttctgcgccaccggcggcggcgcctacaagttcgagcaggacttcctgaccatcggcgacctgcagctgtgcaagctggacgagctggactgcctgatcaagggcatcctgtacatcgacagcgtgggcttcaacggcagaagccagtgctactacttcgagaaccccgccgacagcgagaagtgccagaagctgcccttcgacctgaagaacccctaccccctgctgctggtgaacatcggcagcggcgtgagcatcctggccgtgtacagcaaggacaactacaagagagtgaccggcaccagcctgggcggcggcaccttcttcggcctgtgctgcctgctgaccggctgcaccaccttcgaggaggccctggagatggccagcagaggcgacagcaccaaggtggacaagctggtgagagacatctacggcggcgactacgagagattcggcctgcccggctgggccgtggccagcagcttcggcaacatgatgagcaaggagaagagagaggccgtgagcaaggaggacctggccagagccaccctgatcaccatcaccaacaacatcggcagcatcgccagaatgtgcgccctgaacgagaacatcaaccaggtggtgttcgtgggcaacttcctgagaatcaacaccatcgccatgagactgctggcctacgccctggactactggagcaagggccagctgaaggccctgttcagcgagcacgagggctacttcggcgccgtgggcgccctgctggagctgctgaagatcccctag

SEQ ID NO: 92451 - DNA, 1113 bp, Artificial Sequence
  Description of Artificial Sequence: Synthetic coding sequence
atgaagatcaaggacgccaagaagcccagcttcccctggttcggcatggacatcggcggcaccctggtgaagctgagctacttcgagcccatcgacatcaccgccgaggaggagcaggaggaggtggagagcctgaagagcatcagaaagtacctgaccagcaacgtggcctacggcagcaccggcatcagagacgtgcacctggagctgaaggacctgaccctgttcggcagaagaggcaacctgcacttcatcagattccccacccaggacctgcccaccttcatccagatgggcagagacaagaacttcagcaccctgcagaccgtgctgtgcgccaccggcggcggcgcctacaagttcgagaaggacttcagaaccatcggcaacctgcacctgcacaagctggacgagctggactgcctggtgaagggcctgctgtacatcgacagcgtgagcttcaacggccaggccgagtgctactacttcgccaacgccagcgagcccgagagatgccagaagatgcccttcaacctggacgacccctaccccctgctggtggtgaacatcggcagcggcgtgagcatcctggccgtgcacagcaaggacaactacaagagagtgaccggcaccagcctgggcggcggcaccttcctgggcctgtgcagcctgctgaccggctgcgagagcttcgaggaggccctggagatggccagcaagggcgacagcacccaggccgacaagctggtgagagacatctacggcggcgactacgagagattcggcctgcccggctgggccgtggccagcagcttcggcaacatgatctacaaggagaagagagagagcgtgagcaaggaggacctggccagagccaccctggtgaccatcaccaacaacatcggcagcgtggccagaatgtgcgccgtgaacgagaagatcaacagagtggtgttcgtgggcaacttcctgagagtgaacaccctgagcatgaagctgctggcctacgccctggactactggagcaagggccagctgaaggccctgttcctggagcacgagggctacttcggcgccgtgggcgccctgctgggcctgcccaacttcagctag

SEQ ID NO: 92452 - DNA, 2322 bp, Artificial Sequence
  Description of Artificial Sequence: Synthetic coding sequence
atggccgagtgcggcgccagcggcagcggcagcagcggcgacagcctggacaagagcatcaccctgccccccgacgagatcttcagaaacctggagaacgccaagagattcgccatcgacatcggcggcagcctgaccaagctggcctactacagcaccgtgcagcacaaggtggccaaggtgagaagcttcgaccacagcggcaaggacaccgagagagagcacgagcccccctacgagatcagcgtgcaggaggagatcaccgccagactgcacttcatcaagttcgagaacacctacatcgaggcctgcctggacttcatcaaggaccacctggtgaacaccgagaccaaggtgatccaggccaccggcggcggcgcctacaagttcaaggacctgatcgaggagaagctgagactgaaggtggacaaggaggacgtgatgacctgcctgatcaagggctgcaacttcgtgctgaagaacatcccccacgaggccttcgtgtaccagaaggacagcgaccccgagttcagattccagaccaaccacccccacatcttcccctacctgctggtgaacatcggcagcggcgtgagcatcgtgaaggtggagaccgaggacagattcgagtgggtgggcggcagcagcatcggcggcggcaccttctggggcctgggcgccctgctgaccaagaccaagaagttcgacgagctgctgcacctggccagcagaggccagcacagcaacgtggacatgctggtgagagacgtgtacggcggcgcccaccagaccctgggcctgagcggcaacctgatcgccagcagcttcggcaagagcgccaccgccgaccaggagttcagcaaggaggacatggccaagagcctgctgcacatgatcagcaacgacatcggccagctggcctgcctgcacgccagactgcacagcctggacagagtgtacttcggcggcttcttcatcagaggccaccccgtgaccatgagaaccatcacctacagcatcaacttcttcagcaagggcgaggtgcaggccctgttcctgagacacgagggctacctgggcgccatcggcgccttcctgaagggcgccgagcaggacaaccccaaccagtacagctggggcgagaactacgccggcagcagcggcctgatgagcgccagccccgagctgggccccgcccagagagccagaagcggcaccttcgacctgctggagatggacagactggagagacccctggtggacctgcccctgctgctggacccccccagctacgtgcccgacaccgtggacctgaccgacgacgccctggccagaaagtactggctgacctgcttcgaggaggccctggacggcgtggtgaagagagccgtggccagccagcccgacagcgtggacgccgccgagagagccgagaagttcagacagaagtactggaacaagctgcagaccctgagacagcagcccttcgcctacggcaccctgaccgtgagaagcctgctggacaccagagagcactgcctgaacgagttcaacttccccgacccctacagcaaggtgaagcagagagagaacggcgtggccctgagatgcttccccggcgtggtgagaagcctggacgccctgggctgggaggagagacagctggccctggtgaagggcctgctggccggcaacgtgttcgactggggcgccaaggccgtgagcgccgtgctggagagcgacccctacttcggcttcgaggaggccaagagaaagctgcaggagagaccctggctggtggacagctacagcgagtggctgcagagactgaagggccccccccacaagtgcgccctgatcttcgccgacaacagcggcatcgacatcatcctgggcgtgttccccttcgtgagagagctgctgctgagaggcaccgaggtgatcctggcctgcaacagcggccccgccctgaacgacgtgacccacagcgagagcctgatcgtggccgagagaatcgccggcatggaccccgtggtgcacagcgccctgcaggaggagagactgctgctggtgcagaccggcagcagcagcccctgcctggacctgagcagactggacaagggcctggccgccctggtgagagagagaggcgccgacctggtggtgatcgagggcatgggcagagccgtgcacaccaactaccacgccgccctgagatgcgagagcctgaagctggccgtgatcaagaacgcctggctggccgagagactgggcggcagactgttcagcgtgatcttcaagtacgaggtgcccgccgagtag

SEQ ID NO: 92453 - DNA, 1455 bp, Artificial Sequence
  Description of Artificial Sequence: Synthetic coding sequence
atgttccccaacagcatcctgggcagaccccccttcacccccaaccaccagcagcacaacaacttcttcaccctgagccccaccgtgtacagccaccagcagctgatcgacgcccagttcaacttccagaacgccgacctgagcagagccgtgagcctgcagcagctgacctacggcaacgtgagccccatccagaccagcgccagccccctgttcagaggcagaaagagactgagcgacgagaagaacctgcccctggacggcaagagacagagattccacagcccccaccaggagcccaccgtggtgaaccagatcgtgcccctgagcggcgagagaagatacagcatgccccccctgttccacacccactacgtgcccgacatcgtgagatgcgtgccccccttcagagagatcgccttcctggagcccagagagatcaccctgcccgaggccaaggacaagctgagccagcagatcctggagctgttcgagacctgccagcagcagatcagcgacctgaagaagaaggagctgtgcagaacccagctgcagagagagatccagctgctgttcccccagagcagactgttcctggtgggcagcagcctgaacggcttcggcaccagaagcagcgacggcgacctgtgcctggtggtgaaggaggagccctgcttcttccaggtgaaccagaagaccgaggccagacacatcctgaccctggtgcacaagcacttctgcaccagactgagcggctacatcgagagaccccagctgatcagagccaaggtgcccatcgtgaagttcagagacaaggtgagctgcgtggagttcgacctgaacgtgaacaacatcgtgggcatcagaaacaccttcctgctgagaacctacgcctacctggagaacagagtgagacccctggtgctggtgatcaagaagtgggccagccaccaccagatcaacgacgccagcagaggcaccctgagcagctacagcctggtgctgatggtgctgcactacctgcagaccctgcccgagcccatcctgcccagcctgcagaagatctaccccgagagcttcagccccgccatccagctgcacctggtgcaccaggccccctgcaacgtgcccccctacctgagcaagaacgagagcaacctgggcgacctgctgctgggcttcctgaagtactacgccaccgagttcgactggaacagccagatgatcagcgtgagagaggccaaggccatccccagacccgacggcatcgagtggagaaacaagtacatctgcgtggaggagcccttcgacggcaccaacaccgccagagccgtgcacgagaagcagaagttcgacatgatcaaggaccagttcctgaagagctggcacagactgaagaacaagagagacctgaacagcatcctgcccgtgagagccgccgtgctgaagagatag

SEQ ID NO: 92454 - DNA, 1443 bp, Artificial Sequence
  Description of Artificial Sequence: Synthetic coding sequence
atgttccccaacagcatcctgggcagaccccccttcacccccaaccaccagcagcacaacaacttcttcaccctgagccccaccgtgtacagccaccagcagctgatcgacgcccagttcaacttccagaacgccgacctgagcagagccgtgagcctgcagcagctgacctacggcaacgtgagccccatccagaccagcgccagccccctgttcagaggcagaaagagactgagcgacgagaagaacctgcccctggacggcaagagacagagattccacagcccccaccaggagcccaccgtggtgaaccagatcgtgcccctgagcggcgagagaagatacagcatgccccccctgttccacacccactacgtgcccgacatcgtgagatgcgtgccccccttcagagagatcgccttcctggagcccagagagatcaccctgcccgaggccaaggacaagctgagccagcagatcctggagctgttcgagacctgccagcagcagatcagcgacctgaagaagaaggagctgtgcagaacccagctgcagagagagatccagctgctgttcccccagagcagactgttcctggtgggcagcagcctgaacggcttcggcaccagaagcagcgacggcgacctgtgcctggtggtgaaggaggagcccgtgaaccagaagaccgaggccagacacatcctgaccctggtgcacaagcacttctgcaccagactgagcggctacatcgagagaccccagctgatcagagccaaggtgcccatcgtgaagttcagagacaaggtgagctgcgtggagttcgacctgaacgtgaacaacatcgtgggcatcagaaacaccttcctgctgagaacctacgcctacctggagaacagagtgagacccctggtgctggtgatcaagaagtgggccagccaccaccagatcaacgacgccagcagaggcaccctgagcagctacagcctggtgctgatggtgctgcactacctgcagaccctgcccgagcccatcctgcccagcctgcagaagatctaccccgagagcttcagccccgccatccagctgcacctggtgcaccaggccccctgcaacgtgcccccctacctgagcaagaacgagagcaacctgggcgacctgctgctgggcttcctgaagtactacgccaccgagttcgactggaacagccagatgatcagcgtgagagaggccaaggccatccccagacccgacggcatcgagtggagaaacaagtacatctgcgtggaggagcccttcgacggcaccaacaccgccagagccgtgcacgagaagcagaagttcgacatgatcaaggaccagttcctgaagagctggcacagactgaagaacaagagagacctgaacagcatcctgcccgtgagagccgccgtgctgaagagatag

SEQ ID NO: 92455 - DNA, 1455 bp, Artificial Sequence; identical to SEQ ID NO: 92453
  Description of Artificial Sequence: Synthetic coding sequence

SEQ ID NO: 92456 - DNA, 1455 bp, Artificial Sequence; identical to SEQ ID NO: 92453
  Description of Artificial Sequence: Synthetic coding sequence

SEQ ID NO: 92457 - DNA, 1476 bp, Artificial Sequence
  Description of Artificial Sequence: Synthetic coding sequence
atgagcctggtggcctacgccagcagcgacgagagcgagcccgacgaggccgagcccgagcccgaggaggaggaggccgtggcccccaccagcggccccgccctgggcggcctgttcgccagcctgcccgcccccaagggccccgccctgctgcccccccccccccagatgctggcccccgccttccccccccccctgctgctgcccccccccaccggcgaccccagactgcagccccccccccccctgcccttcggcctgggcggcttcccccccccccccggcgtgagccccgccgaggccgccggcgtgggcgagggcctgggcctgggcctgcccagccccagaggccccggcctgaacctgcccccccccatcggcggcgccggcccccccctgggcctgcccaagcccaagaagagaaaggagcccgtgaagatcgccgcccccgagctgcacaagggcgacagcgacagcgaggaggacgagcccaccaagaagaagaccatcctgcagggcagcagcgagggcaccggcctgagcgccctgctgccccagcccaagaacctgaccgtgaaggagaccaacagactgctgctgccccacgccttcagcagaaagcccagcgacggcagccccgacaccaagcccagcagactggccagcaagaccaagaccagcagcctggcccccgtggtgggcaccaccaccaccacccccagccccagcgccatcaaggccgccgccaagagcgccgccctgcaggtgaccaagcagatcacccaggaggaggacgacagcgacgaggaggtggcccccgagaacttcttcagcctgcccgagaaggccgagccccccggcgtggagccctacccctaccccatccccaccgtgcccgaggagctgccccccggcaccgagcccgagcccgccttccaggacgacgccgccaacgcccccctggagttcaagatggccgccggcagcagcggcgccccctggatgcccaagcccggcgacgactacagctacaaccagttcagcacctacggcgacgccaacgccgccggcgcctactaccaggactactacagcggcggctactaccccgcccaggaccccgccctggtgcccccccaggagatcgcccccgacgccagcttcatcgacgacgaggccttcaagagactgcagggcaagagaaacagaggcagagaggagatcaacttcgtggagatcaagggcgacgaccagctgagcggcgcccagcagtggatgaccaagagcctgaccgaggagaagaccatgaagagcttcagcaagaagaagggcgagcagcccaccggccagcagagaagaaagcaccagatcacctacctgatccaccaggccaaggagagagagctggagctgaagaacacctggagcgagaacaagctgagcagaagacagacccaggccaagtacggcttctag

SEQ ID NO: 92458 - DNA, 1380 bp, Artificial Sequence
  Description of Artificial Sequence: Synthetic coding sequence
atgagcctggtggcctacgccagcagcgacgagagcgagcccgacgaggccgagcccgagcccgaggaggaggaggccgtggcccccaccagcggccccgccctgggcggcctgttcgccagcctgcccgcccccaagggccccgccctgctgcccccccccccccagatgctggcccccgccttccccccccccctgctgctgcccccccccaccggcgaccccagactgcagccccccccccccctgcccttcggcctgggcggcttcccccccccccccggcgtgagccccgccgaggccgccggcgtgggcgagggcctgggcctgggcctgcccagccccagaggccccggcctgaacctgcccccccccatcggcggcgccggcccccccctgggcctgcccaagcccaagaagagaaaggagcccgtgaagatcgccgcccccgagctgcacaagggcgacagcgacagcgaggaggacgagcccaccaagaagaagaccatcctgcagggcagcagcgagggcaccggcctgagcgccctgctgccccagcccaagaacctgaccgtgaaggagaccaacagactgctgctgccccacgccttcagcagaaagcccagcgacggcagccccgacaccaagcccagcagactggccagcaagaccaagaccagcagcctggcccccgtggtgggcaccaccaccaccacccccagccccagcgccatcaaggccgccgccaagagcgccgccctgcaggtgaccaagcagatcacccaggaggaggacgacagcgacgaggaggtggcccccgagaacttcttcagcctgcccgagaaggccgagccccccggcgtggagccctacccctaccccatccccaccgtgcccgaggagctgccccccggcaccgagcccgagcccgccttccaggacgacgccgccaacgcccccctggagttcaagatggccgccggcagcagcggcgccccctggatgcccaagcccggcgacgactacagctacaaccagttcagcacctacggcgacgccaacgccgccggcgcctactaccagttcaagagactgcagggcaagagaaacagaggcagagaggagatcaacttcgtggagatcaagggcgacgaccagctgagcggcgcccagcagtggatgaccaagagcctgaccgaggagaagaccatgaagagcttcagcaagaagaagggcgagcagcccaccggccagcagagaagaaagcaccagatcacctacctgatccaccaggccaaggagagagagctggagctgaagaacacctggagcgagaacaagctgagcagaagacagacccaggccaagtacggcttctag

SEQ ID NO: 92459 - DNA, 1404 bp, Artificial Sequence
  Description of Artificial Sequence: Synthetic coding sequence
atgctggcccccgccttccccccccccctgctgctgcccccccccaccggcgaccccagactgcagccccccccccccctgcccttcggcctgggcggcttcccccccccccccggcgtgagccccgccgaggccgccggcgtgggcgagggcctgggcctgggcctgcccagccccagaggccccggcctgaacctgcccccccccatcggcggcgccggcccccccctgggcctgcccaagcccaagaagagaaaggagcccgtgaagatcgccgcccccgagctgcacaagggcgacagcgacagcgaggaggacgagcccaccaagaagaagaccatcctgcagggcagcagcgagggcaccggcctgagcgccctgctgccccagcccaagaacctgaccgtgaaggagaccaacagactgctgctgccccacgccttcagcagaaagcccagcgacggcagccccgacaccaagcccagcagactggccagcaagaccaagaccagcagcctggcccccgtggtgggcaccaccaccaccacccccagccccagcgccatcaaggccgccgccaagagcgccgccctgcaggtgaccaagcagatcacccaggaggaggacgacagcgacgaggaggtggcccccgagaacttcttcagcctgcccgagaaggccgagccccccggcgtggagccctacccctaccccatccccaccgtgcccgaggagctgccccccggcaccgagcccgagcccgccttccaggacgacgccgccaacgcccccctggagttcaagatggccgccggcagcagcggcgccccctggatgcccaagcccggcgacgactacagctacaaccagttcagcacctacggcgacgccaacgccgccggcgcctactaccagggcctgcagcagcacctgggccacagccccctgagaggcatcatgagattcctgaacagcaagagcggcaagagaacctgcttcgtgcccagcttcgactactacagcggcggctactaccccgcccaggaccccgccctggtgcccccccaggagatcgcccccgacgccagcttcatcgacgacgaggccttcaagagactgcagggcaagagaaacagaggcagagaggagatcaacttcgtggagatcaagggcgacgaccagctgagcggcgcccagcagtggatgaccaagagcctgaccgaggagaagaccatgaagagcttcagcaagaagaagggcgagcagcccaccggccagcagagaagaaagcaccagatcacctacctgatccaccaggccaaggagagagagctggagctgaagaacacctggagcgagaacaagctgagcagaagacagacccaggccaagtacggcttctag

SEQ ID NO: 92460 - DNA, 3096 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaacgccgagcccagccagatgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagcctggccaagctgaagcccgagaagagatag

SEQ ID NO: 92461 - DNA, 3960 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaacgccgagcccagccagatgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcgagagcggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92462 - DNA, 3933 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92463 - DNA, 540 bp, Artificial Sequence
  Description of Artificial Sequence: Synthetic coding sequence
atgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcacctag

SEQ ID NO: 92464 - DNA, 3006 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaacgccgagcccagccagatgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagcctggccaagctgaagcccgagaagagatag

SEQ ID NO: 92465 - DNA, 2967 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagcctggccaagctgaagcccgagaagagatag

SEQ ID NO: 92466 - DNA, 4062 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaacgccgagcccagccagatgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92467 - DNA, 4071 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaacgccgagcccagccagatgcagatccccaaggagaccaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcgagagcggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92468 - DNA, 3891 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92469 - DNA, 3735 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcagcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92470 - DNA, 2244 bp, Artificial Sequence
  Description of Artificial Sequence: Synthetic coding sequence
atggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctggtggccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagcctggccaagctgaagcccgagaagagatag

SEQ ID NO: 92471 - DNA, 3801 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92472 - DNA, 4023 bp, Artificial Sequence
  Description of Artificial Sequence: Synthetic coding sequence
atgaaggtgaccgtgtgcttcggcagaaccagagtggtggtgccctgcggcgacggccacatgaaggtgttcagcctgatccagcaggccgtgaccagatacagaaaggccatcgccaaggaccccaactactggatccaggtgcacagactggagcacggcgacggcggcatcctggacctggacgacatcctgtgcgacgtggccgacgacaaggacagactggtggccgtgttcgacgagcaggacccccaccacggcggcgacggcaccagcgccagcagcaccggcacccagagccccgagatcttcggcagcgagctgggcaccaacaacgtgagcgccttccagccctaccaggccaccagcgagatcgaggtgacccccagcgtgctgagagccaacatgcccctgcacgtgagaagaagcagcgaccccgccctgatcggcctgagcaccagcgtgagcgacagcaacttcagcagcgaggagcccagcagaaagaaccccaccagatggagcaccaccgccggcttcctgaagcagaacaccgccggcagccccaagacctgcgacagaaagaaggacgagaactacagaagcctgcccagagacaccagcaactggagcaaccagttccagagagacaacgccagaagcagcctgagcgccagccaccccatggtgggcaagtggctggagaagcaggagcaggacgaggacggcaccgaggaggacaacagcagagtggagcccgtgggccacgccgacaccggcctggagcacatccccaacttcagcctggacgacatggtgaagctggtggaggtgcccaacgacggcggccccctgggcatccacgtggtgcccttcagcgccagaggcggcagaaccctgggcctgctggtgaagagactggagaagggcggcaaggccgagcacgagaacctgttcagagagaacgactgcatcgtgagaatcaacgacggcgacctgagaaacagaagattcgagcaggcccagcacatgttcagacaggccatgagaacccccatcatctggttccacgtggtgcccgccgccaacaaggagcagtacgagcagctgagccagagcgagaagaacaactactacagcagcagattcagccccgacagccagtacatcgacaacagaagcgtgaacagcgccggcctgcacaccgtgcagagagcccccagactgaaccacccccccgagcagatcgacagccacagcagactgccccacagcgcccaccccagcggcaagccccccagcgcccccgccagcgccccccagaacgtgttcagcaccaccgtgagcagcggctacaacaccaagaagatcggcaagagactgaacatccagctgaagaagggcaccgagggcctgggcttcagcatcaccagcagagacgtgaccatcggcggcagcgcccccatctacgtgaagaacatcctgcccagaggcgccgccatccaggacggcagactgaaggccggcgacagactgatcgaggtgaacggcgtggacctggtgggcaagagccaggaggaggtggtgagcctgctgagaagcaccaagatggagggcaccgtgagcctgctggtgttcagacaggaggacgccttccaccccagagagctgaaggccgaggacgaggacatcgtgctgacccccgacggcaccagagagttcctgaccttcgaggtgcccctgaacgacagcggcagcgccggcctgggcgtgagcgtgaagggcaacagaagcaaggagaaccacgccgacctgggcatcttcgtgaagagcatcatcaacggcggcgccgccagcaaggacggcagactgagagtgaacgaccagctgatcgccgtgaacggcgagagcctgctgggcaagaccaaccaggacgccatggagaccctgagaagaagcatgagcaccgagggcaacaagagaggcatgatccagctgatcgtggccagaagaatcagcaagtgcaacgagctgaagagccccggcagcccccccggccccgagctgcccatcgagaccgccctggacgacagagagagaagaatcagccacagcctgtacagcggcatcgagggcctggacgagagccccagcagaaacgccgccctgagcagaatcatgggcaagtaccagctgagccccaccgtgaacatgccccaggacgacaccgtgatcatcgaggacgacagactgcccgtgctgcccccccacctgagcgaccagagcagcagcagcagccacgacgacgtgggcttcgtgaccgccgacgccggcacctgggccaaggccgccatcagcgacagcgccgactgcagcctgagccccgacgtggaccccgtgctggccttccagagagagggcttcggcagacagagcatgagcgagaagagaaccaagcagttcagcgacgccagccagctggacttcgtgaagaccagaaagagcaagagcatggacctgggcatcgccgacgagaccaagctgaacaccgtggacgaccagaaggccggcagccccagcagagacgtgggccccagcctgggcctgaagaagagcagcagcctggagagcctgcagaccgccgtggccgaggtgaccctgaacggcgacatccccttccacagacccagacccagaatcatcagaggcagaggctgcaacgagagcttcagagccgccatcgacaagagctacgacaagcccgccgtggacgacgacgacgagggcatggagaccctggaggaggacaccgaggagagcagcagaagcggcagagagagcgtgagcaccgccagcgaccagcccagccacagcctggagagacagatgaacggcaaccaggagaagggcgacaagaccgacagaaagaaggacaagaccggcaaggagaagaagaaggacagagacaaggagaaggacaagatgaaggccaagaagggcatgctgaagggcctgggcgacatgttcagattcggcaagcacagaaaggacgacaagatcgagaagaccggcaagatcaagatccaggagagcttcaccagcgaggaggagagaatcagaatgaagcaggagcaggagagaatccaggccaagaccagagagttcagagagagacaggccagagagagagactacgccgagatccaggacttccacagaaccttcggctgcgacgacgagctgatgtacggcggcgtgagcagctacgagggcagcatggccctgaacgccagaccccagagccccagagagggccacatgatggacgccctgtacgcccaggtgaagaagcccagaaacagcaagcccagccccgtggacagcaacagaagcacccccagcaaccacgacagaatccagagactgagacaggagttccagcaggccaagcaggacgaggacgtggaggacagaagaagaacctacagcttcgagcagccctggcccaacgccagacccgccacccagagcggcagacacagcgtgagcgtggaggtgcagatgcagagacagagacaggaggagagagagagcagccagcaggcccagagacagtacagcagcctgcccagacagagcagaaagaacgccagcagcgtgagccaggacagctgggagcagaactacagccccggcgagggcttccagagcgccaaggagaaccccagatacagcagctaccagggcagcagaaacggctacctgggcggccacggcttcaacgccagagtgatgctggagacccaggagctgctgagacaggagcagagaagaaaggagcagcagatgaagaagcagccccccagcgagggccccagcaactacgacagctacaagaaggtgcaggaccccagctacgccccccccaagggccccttcagacaggacgtgccccccagccccagccaggtggccagactgaacagactgcagacccccgagaagggcagacccttctacagctag

SEQ ID NO: 92473 - DNA, 1119 bp, Artificial Sequence
  Description of Artificial Sequence: Synthetic coding sequence
atgaacagaagccacagacacggcgccggcagcggctgcctgggcaccatggaggtgaagagcaagttcggcgccgagttcagaagattcagcctggagagaagcaagcccggcaagttcgaggagttctacggcctgctgcagcacgtgcacaagatccccaacgtggacgtgctggtgggctacgccgacatccacggcgacctgctgcccatcaacaacgacgacaactaccacaaggccgtgagcaccgccaaccccctgctgagaatcttcatccagaagaaggaggaggccgactacagcgccttcggcaccgacaccctgatcaagaagaagaacgtgctgaccaacgtgctgagacccgacaaccacagaaagaagccccacatcgtgatcagcatgccccaggacttcagacccgtgagcagcatcatcgacgtggacatcctgcccgagacccacagaagagtgagactgtacaagtacggcaccgagaagcccctgggcttctacatcagagacggcagcagcgtgagagtgaccccccacggcctggagaaggtgcccggcatcttcatcagcagactggtgcccggcggcctggcccagagcaccggcctgctggccgtgaacgacgaggtgctggaggtgaacggcatcgaggtgagcggcaagagcctggaccaggtgaccgacatgatgatcgccaacagcagaaacctgatcatcaccgtgagacccgccaaccagagaaacaacgtggtgagaaacagcagaaccagcggcagcagcggccagagcaccgacaacagcctgctgggctacccccagcagatcgagcccagcttcgagcccgaggacgaggacagcgaggaggacgacatcatcatcgaggacaacggcgtgccccagcagatccccaaggccgtgcccaacaccgagagcctggagagcctgacccagatcgagctgagcttcgagagcggccagaacggcttcatccccagcaacgaggtgagcctggccgccatcgccagcagcagcaacaccgagttcgagacccacgcccccgaccagaagctgctggaggaggacggcaccatcatcaccctgtag

SEQ ID NO: 92474 - DNA, 1131 bp, Artificial Sequence
  Description of Artificial Sequence: Synthetic coding sequence
atgaacagaagcttccacaagagccagaccctgagattctacgactgcagcgccgtggaggtgaagagcaagttcggcgccgagttcagaagattcagcctggacagacacaagcccggcaagttcgaggacttctacaagctggtggtgcacacccaccacatcagcaacagcgacgtgaccatcggctacgccgacgtgcacggcgacctgctgcccatcaacaacgacgacaacttctgcaaggccgtgagcagcgccaaccccctgctgagagtgttcatccagaagagagaggaggccgagagaggcagcctgggcgccggcagcctgtgcagaagaagaagagccctgggcgccctgagagacgagggccccagaagaagagcccacctggacatcggcctgcccagagacttcagacccgtgagcagcatcatcgacgtggacctggtgcccgagacccacagaagagtgagactgcacagacacggctgcgagaagcccctgggcttctacatcagagacggcgccagcgtgagagtgaccccccacggcctggagaaggtgcccggcatcttcatcagcagaatggtgcccggcggcctggccgagagcaccggcctgctggccgtgaacgacgaggtgctggaggtgaacggcatcgaggtggccggcaagaccctggaccaggtgaccgacatgatgatcgccaacagccacaacctgatcgtgaccgtgaagcccgccaaccagagaaacaacgtggtgagaggcggcagagccctgggcagcagcggcccccccagcgacggcaccgccggcttcgtgggcccccccgcccccagagtgctgcagaacttccaccccgacgaggccgagagcgacgaggacaacgacgtggtgatcgagggcaccctggagcccgccagacccccccagacccccggcgcccccgccggcagcctgagcagagtgaacggcgccggcctggcccagagactgcagagagacctggccctggacggcggcctgcagagactgctgagcagcctgagagccgaccccagacacagcctggccctgccccccggcggcgtggaggagcacggccccgccgtgaccctgtag

SEQ ID NO: 92475 - DNA, 1236 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccgccgtgtacgccatggagatcaacgtggagaaggacaagcagaccggcgagaccaagatcctgagcaccagcaccatcggccccgagggcgtgcaccagaagggcgtgaaggtgtacgacgacggcaccaaggtggtgtacgaggtgagaagcggcggcaccgtggtggagaacggcgtgcacaagctgagcaccaaggacgtggaggagctgatccagaaggccggccagagcagcctgggcggcggccacgtgagcgagagaaccgtgatcgccgacggcagcctgagccaccccaaggagcacatgctgtgcaaggaggccaagctggagatggtgcacaagagcagaaaggaccacagcagcggcaaccccggccagcaggcccaggcccccagcgccgccggccccgaggccaacctggaccagcccgtgaccatgatcttcatgggctaccagaacatcgaggacgaggaggagaccaagaaggtgctgggctacgacgagaccatcaaggccgagctggtgctgatcgacgaggacgacgagaagagcctgagagagaagaccgtgaccgacgtgagcaccatcgacggcaacgccgccgagctggtgagcggcagacccgtgagcgacaccaccgagcccagcagccccgagggcaaggaggagagcctggccaccgagcccgcccccggcacccagaagaagaagagatgccagtgctgcgtggtgatgtag

SEQ ID NO: 92476 - DNA, 1140 bp, Artificial Sequence
  Description of Artificial Sequence: Synthetic coding sequence
atggagatggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgccgtgtacgccatggagatcaacgtggagaaggacaagcagaccggcgagaccaagatcctgagcaccagcaccatcggccccgagggcgtgcaccagaagggcgtgaaggtgtacgacgacggcaccaaggtggtgtacgaggtgagaagcggcggcaccgtggtggagaacggcgtgcacaagctgagcaccaaggacgtggaggagctgatccagaaggccggccagagcagcctgggcggcggccacgtgagcgagagaaccgtgatcgccgacggcagcctgagccaccccaaggagcacatgctgtgcaaggaggccaagctggagatggtgcacaagagcagaaaggaccacagcagcggcaaccccggccagcaggcccaggcccccagcgccgccggccccgaggccaacctggaccagcccgtgaccatgatcttcatgggctaccagaacatcgaggacgaggaggagaccaagaaggtgctgggctacgacgagaccatcaaggccgagctggtgctgatcgacgaggacgacgagaagagcctgagagagaagaccgtgaccgacgtgagcaccatcgacggcaacgccgccgagctggtgagcggcagacccgtgagcgacaccaccgagcccagcagccccgagggcaaggaggagagcctggccaccgagcccgcccccggcacccagaagaagaagagatgccagtgctgcgtggtgatgtag

SEQ ID NO: 92477 - DNA, 1242 bp, Artificial Sequence
  Description of Artificial Sequence: Synthetic coding sequence
atggagatggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccgccgtgtacgccatggagatcaacgtggagaaggacaagcagaccggcgagaccaagatcctgagcaccagcaccatcggccccgagggcgtgcaccagaagggcgtgaaggtgtacgacgacggcaccaaggtggtgtacgaggtgagaagcggcggcaccgtggtggagaacggcgtgcacaagctgagcaccaaggacgtggaggagctgatccagaaggccggccagagcagcctgggcggcggccacgtgagcgagagaaccgtgatcgccgacggcagcctgagccaccccaaggagcacatgctgtgcaaggaggccaagctggagatggtgcacaagagcagaaaggaccacagcagcggcaaccccggccagcaggcccaggcccccagcgccgccggccccgaggccaacctggaccagcccgtgaccatgatcttcatgggctaccagaacatcgaggacgaggaggagaccaagaaggtgctgggctacgacgagaccatcaaggccgagctggtgctgatcgacgaggacgacgagaagagcctgagagagaagaccgtgaccgacgtgagcaccatcgacggcaacgccgccgagctggtgagcggcagacccgtgagcgacaccaccgagcccagcagccccgagggcaaggaggagagcctggccaccgagcccgcccccggcacccagaagaagaagagatgccagtgctgcgtggtgatgtag

SEQ ID NO: 92478 - DNA, 1167 bp, Artificial Sequence
  Description of Artificial Sequence: Synthetic coding sequence
atgggcagagccagaagattccagtggcccctgctgctgctgtgggccgccgccgccggccccggcgccggccaggaggtgcagaccgagaacgtgaccgtggccgagggcggcgtggccgagatcacctgcagactgcaccagtacgacggcagcatcgtggtgatccagaaccccgccagacagaccctgttcttcaacggcaccagagccctgaaggacgagagattccagctggaggagttcagccccagaagagtgagaatcagactgagcgacgccagactggaggacgagggcggctacttctgccagctgtacaccgaggacacccaccaccagatcgccaccctgaccgtgctggtggcccccgagaaccccgtggtggaggtgagagagcaggccgtggagggcggcgaggtggagctgagctgcctggtgcccagaagcagacccgccgccaccctgagatggtacagagacagaaaggagctgaagggcgtgagcagcagccaggagaacggcaaggtgtggagcgtggccagcaccgtgagattcagagtggacagaaaggacgacggcggcatcatcatctgcgaggcccagaaccaggccctgcccagcggccacagcaagcagacccagtacgtgctggacgtgcagtacagccccaccgccagaatccacgccagccaggccgtggtgagagagggcgacaccctggtgctgacctgcgccgtgaccggcaaccccagacccaaccagatcagatggaacagaggcaacgagagcctgcccgagagagccgaggccgtgggcgagaccctgaccctgcccggcctggtgagcgccgacaacggcacctacacctgcgaggccagcaacaagcacggccacgccagagccctgtacgtgctggtggtgtacgaccccggcgccgtggtggaggcccagaccagcgtgccctacgccatcgtgggcggcatcctggccctgctggtgttcctgatcatctgcgtgctggtgggcatggtgtggtgcagcgtgagacagaagggcagctacctgacccacgaggccagcggcctggacgagcagggcgaggccagagaggccttcctgaacggcagcgacggccacaagagaaaggaggagttcttcatctag

SEQ ID NO: 92479 - DNA, 1068 bp, Artificial Sequence
  Description of Artificial Sequence: Synthetic coding sequence
atgggcaagctggtggccctggtgctgctgggcgtgggcctgagcctggtgggcgagatgttcctggccttcagagagagagtgaacgccagcagagaggtggagcccgtggagcccgagaactgccacctgatcgaggagctggagaccggcagcgaggacctggagatcctgcccaacggcctggccttcatcagcagcggcctgaagtaccccggcatcaagagcttcaaccccaacagccccggcaagatcctgctgatggacctgaacgaggaggaccccaccgtgctggagctgggcatcaccggcagcaagttcgacgtgagcagcttcaacccccacggcatcagcaccttcaccgacgaggacaacgccatgtacctgctggtggtgaaccaccccgacgccaagagcaccgtggagctgttcaagttccaggaggaggagaagagcctgctgcacctgaagaccatcagacacaagctgctgcccaacctgaacgacatcgtggccgtgggccccgagcacttctacggcaccaacgaccactacttcctggacccctacctgcagagctgggagatgtacctgggcctggcctggagctacgtggtgtactacagccccagcgaggtgagagtggtggccgagggcttcgacttcgccaacggcatcaacatcagccccgacggcaagtacgtgtacatcgccgagctgctggcccacaagatccacgtgtacgagaagcacgccaactggaccctgacccccctgaagagcctggacttcaacaccctggtggacaacatcagcgtggaccccgagaccggcgacctgtgggtgggctgccaccccaacggcatgaagatcttcttctacgacagcgagaacccccccgccagcgaggtgctgagaatccagaacatcctgaccgaggagcccaaggtgacccaggtgtacgccgagaacggcaccgtgctgcagggcagcaccgtggccagcgtgtacaagggcaagctgctgatcggcaccgtgttccacaaggccctgtactgcgagctgtag

SEQ ID NO: 92480 - DNA, 1017 bp, Artificial Sequence
  Description of Artificial Sequence: Synthetic coding sequence
atggccgccggctgcagcgaggcccccagacccgccgccgccagcgacggcagcctggtgggccaggccggcgtgctgccctgcctggagctgcccacctacgccgccgcctgcgccctggtgaacagcagatacagctgcctggtggccggcccccaccagagacacatcgccctgagccccagatacctgaacagaaagagaaccggcatcagagagcagctggacgccgagctgctgagatacagcgagagcctgctgggcgtgcccatcgcctacgacaacatcaaggtggtgggcgagctgggcgacatctacgacgaccagggccacatccacctgaacatcgaggccgacttcgtgatcttctgccccgagcccggccagaagctgatgggcatcgtgaacaaggtgagcagcagccacatcggctgcctggtgcacggctgcttcaacgccagcatccccaagcccgagcagctgagcgccgagcagtggcagaccatggagatcaacatgggcgacgagctggagttcgaggtgttcagactggacagcgacgccgccggcgtgttctgcatcagaggcaagctgaacatcaccagcctgcagttcaagagaagcgaggtgagcgaggaggtgaccgagaacggcaccgaggaggccgccaagaagcccaagaagaagaagaagaagaaggaccccgagacctacgaggtggacagcggcaccaccaagctggccgacgacgccgacgacacccccatggaggagagcgccctgcagaacaccaacaacgccaacggcatctgggaggaggagcccaagaagaagaagaagaagaagaagcaccaggaggtgcaggaccaggaccccgtgttccagggcagcgacagcagcggctaccagagcgaccacaagaagaagaagaagaagagaaagcacagcgaggaggccgagttcaccccccccctgaagtgcagccccaagagaaagggcaagagcaacttcctgtag

SEQ ID NO: 92481 - DNA, 1059 bp, Artificial Sequence
  Description of Artificial Sequence: Synthetic coding sequence
ggcgccgccggcggctgcggcctggccggcgacagagccggcctgggcgagagactgctggccctgagaaacagactgaaggccagcagagaggtggagagcgtggacctgccccactgccacctgatcaagggcatcgaggccggcagcgaggacatcgacatcctgcccaacggcctggccttcttcagcgtgggcctgaagttccccggcctgcacagcttcgcccccgacaagcccggcggcatcctgatgatggacctgaaggaggagaagcccagagccagagagctgagaatcagcagaggcttcgacctggccagcttcaacccccacggcatcagcaccttcatcgacaacgacgacaccgtgtacctgttcgtggtgaaccaccccgagttcaagaacaccgtggagatcttcaagttcgaggaggccgagaacagcctgctgcacctgaagaccgtgaagcacgagctgctgcccagcgtgaacgacatcaccgccgtgggccccgcccacttctacgccaccaacgaccactacttcagcgaccccttcctgaagtacctggagacctacctgaacctgcactgggccaacgtggtgtactacagccccaacgaggtgaaggtggtggccgagggcttcgacagcgccaacggcatcaacatcagccccgacgacaagtacatctacgtggccgacatcctggcccacgagatccacgtgctggagaagcacaccaacatgaacctgacccagctgaaggtgctggagctggacaccctggtggacaacctgagcatcgaccccagcagcggcgacatctgggtgggctgccaccccaacggccagaagctgttcgtgtacgaccccaacaacccccccagcagcgaggtgctgagaatccagaacatcctgagcgagaagcccaccgtgaccaccgtgtacgccaacaacggcagcgtgctgcagggcagcagcgtggccagcgtgtacgacggcaagctgctgatcggcaccctgtaccacagagccctgtactgcgagctgtag

SEQ ID NO: 92482 - DNA, 1128 bp, Artificial Sequence
  Description of Artificial Sequence: Synthetic coding sequence
atggccccccccaccgagctgctggccagacccgagagaggcagcgcccccggcagcagagccatgggcagactggtggccgtgggcctgctgggcatcgccctggccctgctgggcgagagactgctggccctgagaaacagactgaaggccagcagagaggtggagagcgtggacctgccccactgccacctgatcaagggcatcgaggccggcagcgaggacatcgacatcctgcccaacggcctggccttcttcagcgtgggcctgaagttccccggcctgcacagcttcgcccccgacaagcccggcggcatcctgatgatggacctgaaggaggagaagcccagagccagagagctgagaatcagcagaggcttcgacctggccagcttcaacccccacggcatcagcaccttcatcgacaacgacgacaccgtgtacctgttcgtggtgaaccaccccgagttcaagaacaccgtggagatcttcaagttcgaggaggccgagaacagcctgctgcacctgaagaccgtgaagcacgagctgctgcccagcgtgaacgacatcaccgccgtgggccccgcccacttctacgccaccaacgaccactacttcagcgaccccttcctgaagtacctggagacctacctgaacctgcactgggccaacgtggtgtactacagccccaacgaggtgaaggtggtggccgagggcttcgacagcgccaacggcatcaacatcagccccgacgacaagtacatctacgtggccgacatcctggcccacgagatccacgtgctggagaagcacaccaacatgaacctgacccagctgaaggtgctggagctggacaccctggtggacaacctgagcatcgaccccagcagcggcgacatctgggtgggctgccaccccaacggccagaagctgttcgtgtacgaccccaacaacccccccagcagcgaggtgctgagaatccagaacatcctgagcgagaagcccaccgtgaccaccgtgtacgccaacaacggcagcgtgctgcagggcagcagcgtggccagcgtgtacgacggcaagctgctgatcggcaccctgtaccacagagccctgtactgcgagctgtag

SEQ ID NO: 92483 - DNA, 1029 bp, Artificial Sequence
  Description of Artificial Sequence: Synthetic coding sequence
atgggcagactggtggccgtgggcctgctgggcatcgccctggccctgctgggcgagagactgctggccctgagaaacagactgaaggccagcagagaggtggagagcgtggacctgccccactgccacctgatcaagggcatcgaggccggcagcgaggacatcgacatcctgcccaacggcctggccttcttcagcgtgggcctgaagttccccggcctgcacagcttcgcccccgacaagcccggcggcatcctgatgatggacctgaaggaggagaagcccagagccagagagctgagaatcagcagaggcttcgacctggccagcttcaacccccacggcatcagcaccttcatcgacaacgagttcaagaacaccgtggagatcttcaagttcgaggaggccgagaacagcctgctgcacctgaagaccgtgaagcacgagctgctgcccagcgtgaacgacatcaccgccgtgggccccgcccacttctacgccaccaacgaccactacttcagcgaccccttcctgaagtacctggagacctacctgaacctgcactgggccaacgtggtgtactacagccccaacgaggtgaaggtggtggccgagggcttcgacagcgccaacggcatcaacatcagccccgacgacaagtacatctacgtggccgacatcctggcccacgagatccacgtgctggagaagcacaccaacatgaacctgacccagctgaaggtgctggagctggacaccctggtggacaacctgagcatcgaccccagcagcggcgacatctgggtgggctgccaccccaacggccagaagctgttcgtgtacgaccccaacaacccccccagcagcgaggtgctgagaatccagaacatcctgagcgagaagcccaccgtgaccaccgtgtacgccaacaacggcagcgtgctgcagggcagcagcgtggccagcgtgtacgacggcaagctgctgatcggcaccctgtaccacagagccctgtactgcgagctgtag

SEQ ID NO: 92484 - DNA, 1065 bp, Artificial Sequence
  Description of Artificial Sequence: Synthetic coding sequence
atgggcaagctggtggccctggtgctgctgggcgtgggcctgagcctggtgggcgagatgttcctggccttcagagagagagtgaacgccagcagagaggtggagcccgtggagcccgagaactgccacctgatcgaggagctggagagcggcagcgaggacatcgacatcctgcccagcggcctggccttcatcagcagcggcctgaagtaccccggcatgcccaacttcgcccccgacgagcccggcaagatcttcctgatggacctgaacgagcagaaccccagagcccaggccctggagatcagcggcggcttcgacaaggagctgttcaacccccacggcatcagcatcttcatcgacaaggacaacaccgtgtacctgtacgtggtgaaccacccccacatgaagagcaccgtggagatcttcaagttcgaggagcagcagagaagcctggtgtacctgaagaccatcaagcacgagctgctgaagagcgtgaacgacatcgtggtgctgggccccgagcagttctacgccaccagagaccactacttcaccaacagcctgctgagcttcttcgagatgatcctggacctgagatggacctacgtgctgttctacagccccagagaggtgaaggtggtggccaagggcttctgcagcgccaacggcatcaccgtgagcgccgaccagaagtacgtgtacgtggccgacgtggccgccaagaacatccacatcatggagaagcacgacaactgggacctgacccagctgaaggtgatccagctgggcaccctggtggacaacctgaccgtggaccccgccaccggcgacatcctggccggctgccaccccaaccccatgaagctgctgaactacaaccccgaggacccccccggcagcgaggtgctgagaatccagaacgtgctgagcgagaagcccagagtgagcaccgtgtacgccaacaacggcagcgtgctgcagggcaccagcgtggccagcgtgtaccacggcaagatcctgatcggcaccgtgttccacaagaccctgtactgcgagctgtag

SEQ ID NO: 92485 - DNA, 1572 bp, Artificial Sequence
  Description of Artificial Sequence: Synthetic coding sequence
atgatgctgagaggcaacctgaagcaggtgagaatcgagaagaaccccgccagactgagagccctggagagcgccgtgggcgagagcgagcccgccgccgccgccgccatggccctggccctggccggcgagcccgccccccccgcccccgccccccccgaggaccaccccgacgaggagatgggcttcaccatcgacatcaagagcttcctgaagcccggcgagaagacctacacccagagatgcagactgttcgtgggcaacctgcccaccgacatcaccgaggaggacttcaagagactgttcgagagatacggcgagcccagcgaggtgttcatcaacagagacagaggcttcggcttcatcagactggagagcagaaccctggccgagatcgccaaggccgagctggacggcaccatcctgaagagcagacccctgagaatcagattcgccacccacggcgccgccctgaccgtgaagaacctgagccccgtggtgagcaacgagctgctggagcaggccttcagccagttcggccccgtggagaaggccgtggtggtggtggacgacagaggcagagccaccggcaagggcttcgtggagttcgccgccaagccccccgccagaaaggccctggagagatgcggcgacggcgccttcctgctgaccaccacccccagacccgtgatcgtggagcccatggagcagttcgacgacgaggacggcctgcccgagaagctgatgcagaagacccagcagtaccacaaggagagagagcagccccccagattcgcccagcccggcaccttcgagttcgagtacgccagcagatggaaggccctggacgagatggagaagcagcagagagagcaggtggacagaaacatcagagaggccaaggagaagctggaggccgagatggaggccgccagacacgagcaccagctgatgctgatgagacaggacctgatgagaagacaggaggagctgagaagactggaggagctgagaaaccaggagctgcagaagagaaagcagatccagctgagacacgaggaggagcacagaagaagagaggaggagatgatcagacacagagagcaggaggagctgagaagacagcaggagggcttcaagcccaactacatggagaacagagagcaggagatgagaatgggcgacatgggccccagaggcgccatcaacatgggcgacgccttcagccccgcccccgccggcaaccagggccccccccccatgatgggcatgaacatgaacaacagagccaccatccccggcccccccatgggccccggccccgccatgggccccgagggcgccgccaacatgggcacccccatgatgcccgacaacggcgccgtgcacaacgacagattcccccagggcccccccagccagatgggcagccccatgggcagcagaaccggcagcgagaccccccaggcccccatgagcggcgtgggccccgtgagcggcggccccggcggcttcggcagaggcagccagggcggcaacttcgagggccccaacaagagaagaagatactag

SEQ ID NO: 92486 - DNA, 1392 bp, Artificial Sequence
  Description of Artificial Sequence: Synthetic coding sequence
atgggcttcaccatcgacatcaagagcttcctgaagcccggcgagaagacctacacccagagatgcagactgttcgtgggcaacctgcccaccgacatcaccgaggaggacttcaagagactgttcgagagatacggcgagcccagcgaggtgttcatcaacagagacagaggcttcggcttcatcagactggagagcagaaccctggccgagatcgccaaggccgagctggacggcaccatcctgaagagcagacccctgagaatcagattcgccacccacggcgccgccctgaccgtgaagaacctgagccccgtggtgagcaacgagctgctggagcaggccttcagccagttcggccccgtggagaaggccgtggtggtggtggacgacagaggcagagccaccggcaagggcttcgtggagttcgccgccaagccccccgccagaaaggccctggagagatgcggcgacggcgccttcctgctgaccaccacccccagacccgtgatcgtggagcccatggagcagttcgacgacgaggacggcctgcccgagaagctgatgcagaagacccagcagtaccacaaggagagagagcagccccccagattcgcccagcccggcaccttcgagttcgagtacgccagcagatggaaggccctggacgagatggagaagcagcagagagagcaggtggacagaaacatcagagaggccaaggagaagctggaggccgagatggaggccgccagacacgagcaccagctgatgctgatgagacaggacctgatgagaagacaggaggagctgagaagactggaggagctgagaaaccaggagctgcagaagagaaagcagatccagctgagacacgaggaggagcacagaagaagagaggaggagatgatcagacacagagagcaggaggagctgagaagacagcaggagggcttcaagcccaactacatggagaacagagagcaggagatgagaatgggcgacatgggccccagaggcgccatcaacatgggcgacgccttcagccccgcccccgccggcaaccagggccccccccccatgatgggcatgaacatgaacaacagagccaccatccccggcccccccatgggccccggccccgccatgggccccgagggcgccgccaacatgggcacccccatgatgcccgacaacggcgccgtgcacaacgacagattcccccagggcccccccagccagatgggcagccccatgggcagcagaaccggcagcgagaccccccaggcccccatgagcggcgtgggccccgtgagcggcggccccggcggcttcggcagaggcagccagggcggcaacttcgagggccccaacaagagaagaagatactag

SEQ ID NO: 92487 - DNA, 747 bp, Artificial Sequence
  Description of Artificial Sequence: Synthetic coding sequence
atgatgctgagaggcaacctgaagcaggtgagaatcgagaagaaccccgccagactgagagccctggagagcgccgtgggcgagagcgagcccgccgccgccgccgccatggccctggccctggccggcgagcccgccccccccgcccccgccccccccgaggaccaccccgacgaggagatgggcttcaccatcgacatcaagagcttcctgaagcccggcgagaagacctacacccagagatgcagactgttcgtgggcaacctgcccaccgacatcaccgaggaggacttcaagagactgttcgagagatacggcgagcccagcgaggtgttcatcaacagagacagaggcttcggcttcatcagactggagagcagaaccctggccgagatcgccaaggccgagctggacggcaccatcctgaagagcagacccctgagaatcagattcgccacccacggcgccgccctgaccgtgaagaacctgagccccgtggtgagcaacgagctgctggagcaggccttcagccagttcggccccgtggagaaggccgtggtggtggtggacgacagaggcagagccaccggcaagggcttcgtggagttcgccgccaagccccccgccagaaaggccctggagagatgcggcgacggcgccttcctgctgaccaccacccccagacccgtgatcgtggagcccatggagcagttcgacgacgaggacggcctgcccgagaagctgtag

SEQ ID NO: 92488 - DNA, 309 bp, Artificial Sequence
  Description of Artificial Sequence: Synthetic coding sequence
atgagcgagaagagcgtggaggccgccgccgagctgagcgccaaggacctgaaggagaagaaggagaaggtggaggagaaggccagcagaaaggagagaaagaaggaggtggtggaggaggaggagaacggcgccgaggaggaggaggaggagaccgccgaggacggcgaggaggaggacgagggcgaggaggaggacgaggaggaggaggaggaggacgacgagggccccgccctgaagagagccgccgaggaggaggacgaggccgaccccaagagacagaagaccgagaacggcgccagcgcctag

SEQ ID NO: 92489 - DNA, 315 bp, Artificial Sequence
  Description of Artificial Sequence: Synthetic coding sequence
atgagcgagaagagcgtggaggccgccgccgagctgagcgccaaggacctgaaggagaagaaggagaaggtggaggagaaggccagcagaaaggagagaaagaaggaggtggtggaggcccccgtgcccctggtggtgatggtgggcaaggcctgcagccagcccgaggccacccccagccccggcccccacagaagaagaagaaccggcctgagaagaaagaagaagaagctgcccagaatggagagaagaaagatgaagggcaagaagaagatgagaaagaagaagaagagaatgatgaagggccccagatag

SEQ ID NO: 92490 - DNA, 306 bp, Artificial Sequence
  Description of Artificial Sequence: Synthetic coding sequence
agcagagaccccgcctgcagagccgccgagctgagcgccaaggacctgaaggagaagaaggagaaggtggaggagaaggccagcagaaaggagagaaagaaggaggtggtggaggaggaggagaacggcgccgaggaggaggaggaggagaccgccgaggacggcgaggaggaggacgagggcgaggaggaggacgaggaggaggaggaggaggacgacgagggccccgccctgaagagagccgccgaggaggaggacgaggccgaccccaagagacagaagaccgagaacggcgccagcgcctag

SEQ ID NO: 92491 - DNA, 528 bp, Artificial Sequence
  Description of Artificial Sequence: Synthetic coding sequence
atgcagagaagactggtgcagcagtggagcgtggccgtgttcctgctgagctacgccgtgcccagctgcggcagaagcgtggagggcctgagcagaagactgaagagagccgtgagcgagcaccagctgctgcacgacaagggcaagagcatccaggacctgagaagaagattcttcctgcaccacctgatcgccgagatccacaccgccgagatcagagccaccagcgaggtgagccccaacagcaagcccagccccaacaccaagaaccaccccgtgagattcggcagcgacgacgagggcagatacctgacccaggagaccaacaaggtggagacctacaaggagcagcccctgaagacccccggcaagaagaagaagggcaagcccggcaagagaaaggagcaggagaagaagaagagaagaaccagaagcgcctggctggacagcggcgtgaccggcagcggcctggagggcgaccacctgagcgacaccagcaccaccagcctggagctggacagcagatag

SEQ ID NO: 92492 - DNA, 630 bp, Artificial Sequence
  Description of Artificial Sequence: Synthetic coding sequence
atgcagagaagactggtgcagcagtggagcgtggccgtgttcctgctgagctacgccgtgcccagctgcggcagaagcgtggagggcctgagcagaagactgaagagagccgtgagcgagcaccagctgctgcacgacaagggcaagagcatccaggacctgagaagaagattcttcctgcaccacctgatcgccgagatccacaccgccgagatcagagccaccagcgaggtgagccccaacagcaagcccagccccaacaccaagaaccaccccgtgagattcggcagcgacgacgagggcagatacctgacccaggagaccaacaaggtggagacctacaaggagcagcccctgaagacccccggcaagaagaagaagggcaagcccggcaagagaaaggagcaggagaagaagaagagaagaaccagaagcgcctggctggacagcggcgtgaccggcagcggcctggagggcgaccacctgagcgacaccagcaccaccagcctggagctggacagcagaaccgccctgctgtggggcctgaagaagaagaaggagaacaacagaagaacccaccacatgcagctgatgatcagcctgttcaagagccccctgctgctgctgtag

SEQ ID NO: 92493 - DNA, 528 bp, Artificial Sequence; identical to SEQ ID NO: 92491
  Description of Artificial Sequence: Synthetic coding sequence

SEQ ID NO: 92494 - DNA, 534 bp, Artificial Sequence
  Description of Artificial Sequence: Synthetic coding sequence
atgcagagaagactggtgcagcagtggagcgtggccgtgttcctgctgagctacgccgtgcccagctgcggcagaagcgtggagggcctgagcagaagactgaagagagccgtgagcgagcaccagctgctgcacgacaagggcaagagcatccaggacctgagaagaagattcttcctgcaccacctgatcgccgagatccacaccgccgagatcagagccaccagcgaggtgagccccaacagcaagcccagccccaacaccaagaaccaccccgtgagattcggcagcgacgacgagggcagatacctgacccaggagaccaacaaggtggagacctacaaggagcagcccctgaagacccccggcaagaagaagaagggcaagcccggcaagagaaaggagcaggagaagaagaagagaagaaccagaagcgcctggctggacagcggcgtgaccggcagcggcctggagggcgaccacctgagcgacaccagcaccaccagcctggagctggacagcagaagacactag

SEQ ID NO: 92495 - DNA, 528 bp, Artificial Sequence; identical to SEQ ID NO: 92491
  Description of Artificial Sequence: Synthetic coding sequence

SEQ ID NO: 92496 - DNA, 81 bp, Artificial Sequence
  Description of Artificial Sequence: Synthetic coding sequence
accgccctgctgtggggcctgaagaagaagggcaagcagcagaagaacaccagctacgccaccaacgacctgatcatctag

SEQ ID NO: 92497 - DNA, 630 bp, Artificial Sequence; identical to SEQ ID NO: 92492
  Description of Artificial Sequence: Synthetic coding sequence

SEQ ID NO: 92498 - DNA, 534 bp, Artificial Sequence; identical to SEQ ID NO: 92494
  Description of Artificial Sequence: Synthetic coding sequence
